United States Patent 8,344,211 (PLANT NUCLEOTIDE SEQUENCES AND CORRESPONDING POLYPEPTIDES) - sequence listing, part 20

SEQ ID NO: 76205 - protein, 143 aa, Zea mays
  misc_feature: Ceres CLONE 1560865
MEALWKQAFRLKDQVSRQGVFKQFGYGNSDNAFTDESEVKLHQRLEKLYLSTRAAKHFQRDIVRGVEGYIVTGSKQVEIGNKLSDDSQKYGVGNTCTSGDTLSKAATYFGKARSQMEKERGNMLKAFGTQVAEPLRAMGYGCT

SEQ ID NO: 76206 - DNA, 611 bp, Zea mays
  misc_feature: Ceres CLONE 1560866
  misc_feature: Translation starting site: 155
  misc_feature (132)..(132): n is a, c, t, g, unknown, or other
  misc_feature (139)..(139): n is a, c, t, g, unknown, or other
  misc_feature (182)..(182): n is a, c, t, g, unknown, or other
  misc_feature (272)..(272): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
tggactccccgcggtggcgccgctctaaactagtggatcccccgggctgcaggaattcgtctcacccctagaaaaacccgcggtctgctcgttcgatctgtgcagcagatctgaggtcccgggcgaccgtgnaagcagngcttcaatcgtcggcatggcgctcgtattgcatagtggggctnggaaaaccaaagaaatgccttcaaagcacttattgctgcagaatacagtggggatcaaagtttgagttgacaaaggattttgagatgggntgtctcaaacaagacccctgaatttcctaaaaatgacccccctggggaagggtccccggttgtnnnntccggggagaaaacccccccgtatagaggcccccctttttttttaaaaaaaatatgggcttttcccccccccccttttttttgcccccccccttaaaaaaaaaaaaaaaaaaaccccccccttttttttggggggcgccccccccccccctttttggaaaaaaaaaaaaccccccccccccccttttttgtgaaaacaaagggggggggggggggtgttttttttttttttcccccccacccccccaaaaaaaaaaaaaatttttttgtttt

SEQ ID NO: 76207 - DNA, 855 bp, Zea mays
  misc_feature: Ceres CLONE 1560868
  misc_feature: SWISSPROT Homolog: EC 1.11.1.11 L-ascorbate peroxidase
tggagctccccgcggtggcggccgctctagaactagtggatcccccgggctgcaggaattcgtctcacccctagaaaaagacgcaagcacccctgttgttcttgcggtcgttctttaccagcgtcccagcagatcgtgctctacaagtcaatgctctctgcttccaggggaccttaggagatgaactaccacttgcgtgagccccgactgactggcagcccctacgacaatcgtaggcgcgggctcggcgcccgtcatctccgagaacagctgcgcacccctggtgctctgactctgcgtggcactccggagggacgttcagacctgtcctcgaggaccggcaggcccttcggtactatgaaagtggcctgcggaactgggtcacggcgccaacgcggggatagacatcagcggtgcagctgctcgaacccatcaaagaggagttccccaccctctcctatggccacttctaccagcttgccagacttgtggcctgcgatgcctccgtgagggcctgagatccccttgcacccccgcagggaggagaaacctcacccggcacctgcagtgccgtcttgctgatgccaccaaaggttctgacgccctgtacgcaagtctttggcttgcacatgggtttgactgatcgggacatgactgccctctctggaggccaccggttgggacggtgccacaaataggagtctggttgtaacggtgcctggactacgaaccctttggtctgtgatcactcattagtcaacggaccttcttagtggtgactaggattgtctgtcttcaacttcgaagtgacaaaggccctgctgagctacactgtcttccggccctatttgtgga

SEQ ID NO: 76208 - DNA, 845 bp, Zea mays
  misc_feature: Ceres CLONE 1560871
  misc_feature: Encodes the peptide sequence at SEQ ID NO. 76209
tggagctccccgcggtggcggccgctctagaactagtggatcccccgggctgcaggaattcgtctcacccctagaaaaagacactttgttgagtattgtgtttttggttgggagaatctccctaggacactcctcatgtacttcacaaatgtgatgctacctctagagggttatttccattcggttgcatgcaactcggacttccacaatttcacagtgaacaacgacttgcggtatgtggtgtgggacgatccacctcagatggagccccatttcctaaatgttacacattatgatgagctagtagagactggggttccttttgcccggaagtttaaggaggatgaacccctgttggacatgattgatgataaagtgcttcgacgctggcgtcacaggcctgttcctggcgcatggtgcacaggcaaaaggaggtggttcagtgatccttgctcccagtggagcaacgtcaacattgtaagacccggtcctcaagctgcgaagttccgaacatatataaaccagattatggaagaatcgaagtcaagcaacaactcttgcaagcaatagcggtagaatccgagcacgaggcttcacttcccgcagttgaagcgttgagcttgtctcattttgcgctgaggagctctccatgtctcgagcacttcctggcatctgcttcaggagcaagcatttttgcacctgttgtatgaactgaacacacagccaaggtgagagatggatttattctttccagatttttttttttggggtgacatggcttcaagggcttagtgcacactagtgtttgtggaaagcaagagaccctactgtggggatacagaagc

SEQ ID NO: 76209 - protein, 144 aa, Zea mays
  misc_feature: Ceres CLONE 1560871
MYFTNVMLPLEGYFHSVACNSDFHNFTVNNDLRYVVWDDPPQMEPHFLNVTHYDELVETGVPFARKFKEDEPLLDMIDDKVLRRWRHRPVPGAWCTGKRRWFSDPCSQWSNVNIVRPGPQAAKFRTYINQIMEESKSSNNSCKQ

SEQ ID NO: 76210 - DNA, 847 bp, Zea mays
  misc_feature: Ceres CLONE 1560872
  misc_feature: Encodes the peptide sequence at SEQ ID NO. 76211
ggagctccccgcggtggcggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgcggaagtcatcctcgtcggcggcgcccagtactaccggatcaccaacggactgggactagaagacaagctgcaccccgggtgggcccttcaacccccctgggcctgggccagggaacccgaccagggccgcccatccccagggggaaaggagatcaagaaacggcccggcttggccaa

SEQ ID NO: 76211 - protein, 238 aa, Zea mays
  misc_feature: Ceres CLONE 1560872
  misc_feature (83)..(225): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLNYFGNSIPINLVVAVIAEVILVGGAQYYRITNGLGLEDKLHPGWALQPPWAWAREPDQGRPSPGGKEIKKRPGLA

SEQ ID NO: 76212 - DNA, 833 bp, Zea mays
  misc_feature: Ceres CLONE 1560874
  misc_feature: Encodes the peptide sequence at SEQ ID NO. 76213
  misc_feature (690)..(690): n is a, c, t, g, unknown, or other
ctggagctccccgcggtggcggccgctctagaactagtggatcccccgggctgcaggaattcgtctcacccctagaaaaagtccaaacgcagccgaagaggaaaggagagaggcggcgaggatggggcggaagcggaaggagttgctgtcgtcggctccatggaggacgggggagtcggcggaggacgaggacgcggcaaggatgagccgagaggggaaggtcagcgtcaccagcaaccccggggagacgcccaccatgagcgtgccccggagcaagcgccaggacctcgacctcaccgtcgacgacttcgaggaggacgagatcgaccccgagctgcgctactccttccagcggaacagcaggtttctgaagagagtttttagcgtggacacacttgtcaagcctcttcctcctgtaatggcatacagtgtatcccgcaatataaacttcttcttccggatcttcacacagttttgggatgaagaaggaattgccaatgcccagaagtcccttggactggggaacgaggacggctcccgccgaatgcgctgatcatggtcaaaccaagttttctgtaccgggttcagaactcttttgccctagacactggagacgtgttatacgcctcgaaagacatggcatgggacatttttagggaaatttggatccataccattaaaagatcaccnactttggatccataccattattatatcaccttacatgtgggttcacatgagtcaatgacatggtgggggtcaatggtattatatctaaagtttggatctttttaatggtatagatcccaattgttccacaattttttaaggtg

SEQ ID NO: 76213 - protein, 143 aa, Zea mays
  misc_feature: Ceres CLONE 1560874
MGRKRKELLSSAPWRTGESAEDEDAARMSREGKVSVTSNPGETPTMSVPRSKRQDLDLTVDDFEEDEIDPELRYSFQRNSRFLKRVFSVDTLVKPLPPVMAYSVSRNINFFFRIFTQFWDEEGIANAQKSLGLGNEDGSRRMR

SEQ ID NO: 76214 - DNA, 838 bp, Zea mays
  misc_feature: Ceres CLONE 1560877
  misc_feature: Encodes the peptide sequence at SEQ ID NO. 76215
ggagctccccgcggtggcggccgctctagaactagtggatcccccgggctgcaggaattcgtctcacccctagaaaaagcagcagtgcgcccagcctatctaccccccacccctcgaattgttcccatggccgccgccattcgcggaagccctacccgcgccgccgcgccgacccagcctcgcgcggtgctgcgggtggcgtcgtccgccgcgccagcctcctcctcctccgcccgcccgcgcaggggcgccgtggcagaggccgcaatgcagccggccaaggcggtcgccgcggaggcggcctcccccgctgccgcgctggagatggggaacggcgccgcggtcgcggggctgcagcggcccgacgccatggggaggtttgggaggttcggcggcaagtacgtccccgagacgctcatgcacgcgctcaccgagctcgagaacgccttccacgcactcgccaccgacgacgagtgccagaaagaactcgacggtattctcaaggactacgttggacgtgagagccccctttacttcgcggagcgcctgacggagcactacaagcgcgctgatggcacaggcccgctcatctacctcaagagggaggacctcaaccacacaggcgcccacaagatcaacaatgctgtggcgcaggccctgctcgccaagcgacttgggaagcagcgcatcattgccgagacaggggctgggcagcacggtgtccgccaccccactgtgtgcgcccgtttcgggctgcagtgcatcatctacttgggcgcgcaagacatggaaaagcacgcaccccatggtcttccggatgaagcttccttggtgccac

SEQ ID NO: 76215 - protein, 237 aa, Zea mays
  misc_feature: Ceres CLONE 1560877
  misc_feature: SWISSPROT Homolog: EC 4.2.1.20 Tryptophan synthase
MAAAIRGSPTRAAAPTQPRAVLRVASSAAPASSSSARPRRGAVAEAAMQPAKAVAAEAASPAAALEMGNGAAVAGLQRPDAMGRFGRFGGKYVPETLMHALTELENAFHALATDDECQKELDGILKDYVGRESPLYFAERLTEHYKRADGTGPLIYLKREDLNHTGAHKINNAVAQALLAKRLGKQRIIAETGAGQHGVRHPTVCARFGLQCIIYLGAQDMEKHAPHGLPDEASLVP

SEQ ID NO: 76216 - DNA, 810 bp, Zea mays
  misc_feature: Ceres CLONE 1560878
  misc_feature: Encodes the peptide sequence at SEQ ID NO. 76217
tccccgcggtggcggccgctctagaactagtggatcccccgggctgcaggaattcgtctcacccctagaaaaaaagcaaccagcggagcggaggaggagagactgatccagacgcaaagggcatcgacagagaccgagcccaataataaatcttgctggatacatacaggaaacagcgcgagggaacgagaagttagtttccatggagaagaagcagaagaagcacgcacacgcgaggtcaaggagcttcaccggcggcgggctggcctccttcctcaggtccaccgtctcctccttctcctccgccttcccgcccagcggcaggaggtcctccttcaaccaccgcaacgccttctcgggccccatcgtcgtctccatcgtcccgccggaggctcgcggcggcggcggcaggaggaagcgcccggggtacgtgacgcccgagccgtcgtcgcccaaggtgtcctgcatcggccagatcaagcgcagcaactccaggcgccagaagaaggtcaacccgtcgtgcggcaagggcggcggcgcctgcccgctccccgcgagggccgcagcggaagaacagaagccctgcagcaggaccagcagcagcagggggctcctcgtgaagcggatgcccttttctcgccgcagcaggtcgcgtcctcgctcaagggcggcgtcgtccaaagatgggctcatcgtcctcggtaacgggaaaaaaaagcgacggccaacgcgcccggtggcggaatcaggcgccccccccccccccccaatggggccccgggccaaaaaaaaaacgggtctcccagccgg

SEQ ID NO: 76217 - protein, 202 aa, Zea mays
  misc_feature: Ceres CLONE 1560878
MEKKQKKHAHARSRSFTGGGLASFLRSTVSSFSSAFPPSGRRSSFNHRNAFSGPIVVSIVPPEARGGGGRRKRPGYVTPEPSSPKVSCIGQIKRSNSRRQKKVNPSCGKGGGACPLPARAAAEEQKPCSRTSSSRGLLVKRMPFSRRSRSRPRSRAASSKDGLIVLGNGKKKRRPTRPVAESGAPPPPPMGPRAKKKTGLPA

SEQ ID NO: 76218 - DNA, 879 bp, Zea mays
  misc_feature: Ceres CLONE 1560883
  misc_feature: Encodes the peptide sequence at SEQ ID NO. 76219
ctggagctccccgcggtggcggccgctctagaactagtggatcccccgggctgcaggaattcgtctcacccctagaaaaagccccctcaatccctcatagtcagtcatagagcgagaggaagaggcgcgcgtgggtgcagtgcagacgtgcggggcagagcacaacagcaggggatccggggagggagggaagccatgggcgagggggcggccaagaaggaggaggtggagaagcccaaggaggccgccgcggcagaggagaagaagaaggacgacaagcccaaggaagtaggcggcggcggcgagaagcccaaggacggggaggaggacgagaagaagaaggaggacgcgccgccgcctccgccgcccccgccgccggaggaggtcgagatgcgggtctacatgcactgcgaagggtgcgcccgcaaggtcaagaagatcctcaggcgcttcgacggagtggaggatgtgatcgccgactccaaggcgcacaaggtgctggtgaaggggaagaaggcggccgccgaccccatgaaggtggtggagcgcgtgcagaagaagactggccgcaaggtcgagctgctgtcgccgatgccgcccccgccggagggggaggagaagaaggaagatgaggcggaaaaaaaaaaggacgatgagaagaaggcagatcccgagcccccctaagccggaggaaaaaaaaggagccccccgggaatcccctggtggtgcttaaaggggcacatgcacctgcgaggggtggccgcccaaggggatcaagaaagaggatcccttcaggatgaaaaaggggggccagtcccggtataaaccgggaccctccagggcggctcggaaggttaaccggtggaaaagggccgctgt

SEQ ID NO: 76219 - protein, 162 aa, Zea mays
  misc_feature: Ceres CLONE 1560883
  misc_feature (65)..(129): Pfam Name: HMA Pfam Description: Heavy-metal-associated domain
MGEGAAKKEEVEKPKEAAAAEEKKKDDKPKEVGGGGEKPKDGEEDEKKKEDAPPPPPPPPPEEVEMRVYMHCEGCARKVKKILRRFDGVEDVIADSKAHKVLVKGKKAAADPMKVVERVQKKTGRKVELLSPMPPPPEGEEKKEDEAEKKKDDEKKADPEPP

SEQ ID NO: 76220 - DNA, 812 bp, Zea mays
  misc_feature: Ceres CLONE 1560887
  misc_feature: Encodes the peptide sequence at SEQ ID NO. 76221
  misc_feature (130)..(130): n is a, c, t, g, unknown, or other
  misc_feature (160)..(160): n is a, c, t, g, unknown, or other
  misc_feature (164)..(164): n is a, c, t, g, unknown, or other
  misc_feature (165)..(165): n is a, c, t, g, unknown, or other
  misc_feature (181)..(181): n is a, c, t, g, unknown, or other
ggagctccccgcggtggcggccgctctagaactagtggatcccccgggctgcaggaattcgtctcacccctagaaaaaaagcctgagcactccatccactactttactcaaagtctagagctagcttttntgctttgctcaccagaacaaaccgcagcangatnnggcgtcgacgatcatnggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccgggaccgcgtcaagtacctggggccccttctcgcccagacgccctcgtacctgaccgggcgagtcccccggcgactaccgctggggacaccgcccggcctgtccgcggaaccccggaggccgttcgcgccgaaaccaggccgctggaaggtgatcccaacgggccgggggggaaaagcctgggttgcccttgggcctggcatcccccccggaaggggccctgaaaaaatggggggggcccgcgtggactttcaagggacccccgttttgggtttaaggggccgggcccccaaaaatttttcccgaaaggggggggggtggagaaatccggggggaaaccccccacccgtggggggccccccccaaaaaaaaatcctggggcgcggggctgggggttttccaggttattccccctggggggcccccccccaaagggggtttcccccataaaagaggctctaaagggggggggggggaga

SEQ ID NO: 76221 - protein, 175 aa, Zea mays
  misc_feature: Ceres CLONE 1560887
MPAPSATSPPPLLAAGSPWATTCGTARDRVKYLGPLLAQTPSYLTGRVPRRLPLGTPPGLSAEPRRPFAPKPGRWKVIPTGRGGKAWVALGPGIPPGRGPEKMGGARVDFQGTPVLGLRGRAPKNFSRKGGGWRNPGGNPPPVGGPPQKKILGRGAGGFPGYSPWGAPPQRGFPP

SEQ ID NO: 76222 - DNA, 854 bp, Zea mays
  misc_feature: Ceres CLONE 1560889
  misc_feature: Encodes the peptide sequence at SEQ ID NO. 76223
  misc_feature (710)..(710): n is a, c, t, g, unknown, or other
ctggagctccccgcggtggcggccgctctagaactagtggatcccccgggctgcaggaattcgtctcacccctagaaaaaagcgagccatctacacgatcgcgagcgcaaggacggacgttgtcagaagctcaagttacaagaagcaccactgcctgatcgatggcggaccatgctttcctctccggccggcaactgctgggccgccccgctgcactcggacgtctctagatctcccgccaggaacgcgcccttcgccgtgagggccagctccggccctccggccaagcaacgagcccacaagcagctgtggttagcgtgcaagcagtccctcctcactacctagatggcacactgcccggcgactatggattcgaccccctgggcctctacggacccggagggcaccgggggcttcatcgagccctagtggctgggctatggctaggtgatcaacggccgctacgccatgctgggcgacgtgggcgccatctcccctgagatcttccggaatatggggatcatccccccggacagctcgctgtcctggttcaagacgggcgtcatccctggcgggggcaactgcgaatactgggccgactcctagacgctcttcgactgcgaatgggcgctcatgggcttcgccgagcaccgccgcctccgtgactggtacaacccgggctccatgggcaagcactacttcctcgggcntccacaagttcctcgacggctccgggcgacccgtactagacctgcgggaccctcttctacccgctctgccttctgccagagcgagaacgagatgactgagctccagctcatgacatccatgaacggcaagctcgtcatgctccg

SEQ ID NO: 76223 - protein, 73 aa, Zea mays
  misc_feature: Ceres CLONE 1560889
  misc_feature (26)..(26): Xaa is any aa, unknown, or other
MGFAEHRRLRDWYNPGSMGKHYFLGXPQVPRRLRATRTRPAGPSSTRSAFCQSENEMTELQLMTSMNGKLVML

SEQ ID NO: 76224 - DNA, 1133 bp, Zea mays
  misc_feature: Ceres CLONE 1560891
  misc_feature: Encodes the peptide sequence at SEQ ID NO. 76225
aaagtccccgctcccaacccgcgcgccagcccaactgcccaacgaagctagcctcatgcaatgcatggagggcaccatacctgactcctcgagcacaaggatcgccgtggtgaccggcgggaataaagggatcgggctggaggtctgccggcagctagccgcctcctccaccagcggcgtcgccgtcgtcgtcgtcttgactgccagggacgaggcgaggggagcagctgccgtcgggaagctcagaggcctggggctctccaacgtcttcttccaccagctggacatcacggacgccccgagcatcgctcggctggccgatttcttgaagtcccggtttgggaagctggatatcctggtgaataacgccgggtttgttggccttgagtacatccaagatcgtatagatggcacttcaacgacgagcgaggagttttgtggcatggacatggacaagaggctggagctgctgctgaaatggtgcctccgggagacttgcgatgctgggaaggaatgcatgaggataaactaccacggcacgaagcaagtcacccgagcactcctgcctctgctgctggcctccgacagcggaaggatcgtcaatgtctcctcggtgcttgggcagctcaggtttttcggcagcgaggcgctgaagcgggagctggacgacgtggcgagcctgaccgaggagaggctggacgaggtggcgggcgcgttcgtggcggacctggaggccggcgccgtggaggcgcgggggtggtggcccgccgggttctcggcggcgtacatggtgtccaaggcggcgctgaacgcctactcgcgcgtcctggcgcggaggcaccccgcgctgcgcgtcaactgcgtgcacccgggcttcgtcaggaccgacatgaccgtcaacttcggcatgctcacgcccgaggaaggcggcagcagggtggtggccgtcgctctgctccccgacggcgggcccaccggcgcctacttccaggagcgccagcaggcgccgttcgtgtgacgcgctctgcctctgctctgcttccttcaccacccgatgcttgatagctatgtatctcttgaagttttcgcttgataatagttgatacacatccaaacaaaaaaaaaaaaaaaaa

SEQ ID NO: 76225 - protein, 320 aa, Zea mays
  misc_feature: Ceres CLONE 1560891
  misc_feature (15)..(204): Pfam Name: adh_short Pfam Description: short chain dehydrogenase
  misc_feature (155)..(319): SWISSPROT Homolog: EC 1.1.1.184 Carbonyl reductase (NADPH)
  misc_feature (15)..(106): SWISSPROT Homolog: EC 1.1.1.100 3-oxoacyl-[acyl-carrier-protein] reductase
MQCMEGTIPDSSSTRIAVVTGGNKGIGLEVCRQLAASSTSGVAVVVVLTARDEARGAAAVGKLRGLGLSNVFFHQLDITDAPSIARLADFLKSRFGKLDILVNNAGFVGLEYIQDRIDGTSTTSEEFCGMDMDKRLELLLKWCLRETCDAGKECMRINYHGTKQVTRALLPLLLASDSGRIVNVSSVLGQLRFFGSEALKRELDDVASLTEERLDEVAGAFVADLEAGAVEARGWWPAGFSAAYMVSKAALNAYSRVLARRHPALRVNCVHPGFVRTDMTVNFGMLTPEEGGSRVVAVALLPDGGPTGAYFQERQQAPFV

SEQ ID NO: 76226 - DNA, 829 bp, Zea mays
  misc_feature: Ceres CLONE 1560894
  misc_feature: Encodes the peptide sequence at SEQ ID NO. 76227
ctccccgcggtggcggccgctctagaactagtggatcccccgggctgcaggaattcgtctcacccctagaaaaaacaatacttccctgttggcctggtcatatctggaatgctgaagatatttcaggatctatttgcactacgattcgacgaaattaaggatgttgatgtttggcatgatacagttcgtgtgttttctgtttgggatgcaagttcaagtgatcttttgggttacttttttcttgatatcttttccagggaaggaaagtatgcccacacttgtgttgtgacccttcagaatggatgtttatgttctaatggtacacgtaaggttccggctgctgtgatattatctcagtgtccaaaagagtttgatggtaattcagcattgatgcggttccctgaagttgtgaggctattccatgaatttagccatgtggtccatcacgtatccaacagagccaccttttcaagattttcaggccttcgactggagggtgactttgctgaaattccaagcctgctactcgagaattggtgctatgagagtatttctctgaaaatgatgtccggcttccatcaggacattacgaaatccataagtagcgaagcttgccaatctctgaaaagaaggcgtgatttgtttgctggcctgaaaagaaacaagagatacttttgtgccttgttgatcagataatacattcaagtgagaatgtgggacattgatgacttagtcaaggatcttcaccccaaggtattgttggggtataccctttattgggaagggaccagtcccagctttcaagtttttccctcgtaatgccttttgg

SEQ ID NO: 76227 - protein, 195 aa, Zea mays
  misc_feature: Ceres CLONE 1560894
  misc_feature: SWISSPROT Homolog: EC 3.4.24.16 Neurolysin
MLKIFQDLFALRFDEIKDVDVWHDTVRVFSVWDASSSDLLGYFFLDIFSREGKYAHTCVVTLQNGCLCSNGTRKVPAAVILSQCPKEFDGNSALMRFPEVVRLFHEFSHVVHHVSNRATFSRFSGLRLEGDFAEIPSLLLENWCYESISLKMMSGFHQDITKSISSEACQSLKRRRDLFAGLKRNKRYFCALLIR

SEQ ID NO: 76228 - DNA, 858 bp, Zea mays
  misc_feature: Ceres CLONE 1560896
  misc_feature: Encodes the peptide sequence at SEQ ID NO. 76229
  misc_feature (754)..(754): n is a, c, t, g, unknown, or other
ctggagctcaccgcggtggcggccgctctagaactagtggatcccccgggctgcaggaattcgtctcacccctagaaaaaatgacaaggggctcggttagtccacagccctagaggctgcagctgcacacttctcttctctgttttcgccggttaaactttccccacttgttgctggccttcgaatctgtggtttgtttgagcttagcagggaagcgaagaacagggaagcaaggacatggatgctttcagtgcagtgatggacaaggtaaagagccacccagaaatgatggagaaggtcagtgcagtgatggacaaggtgaagaagagccacccagaagcggtggaaaaggtcaaggacgaggtgatgagccttgctgatgctctccatctgcgtagacatggatccaaagataaagaacctgagtctgaagagaaggccgaagaaggcgaggcagcgcagagcgtcgaagaggaggagggtacctctgctgacaagactgcagaacctaatgtgttggagcaggccgtacaggagattcaggctgtcgccgcagctttgcagcagacagcacctgaaactgaaactgaaattccagttgagactgctgctgctgctcctgaaacttcggctgaaaggagacagcctgaagacacaaacgggaggtgggagaagatgacccaaagagcggctcgttttcgccgggtttctccccatgcctgttgaaaggttcttgctccccgcccacaagaanaaaaactgattgattgccggtcaactggggaattcccgttttgggaatctggacggggaattacattttacttaagtttttttgggggggggggggacaccctc

SEQ ID NO: 76229 - protein, 162 aa, Zea mays
  misc_feature: Ceres CLONE 1560896
MDAFSAVMDKVKSHPEMMEKVSAVMDKVKKSHPEAVEKVKDEVMSLADALHLRRHGSKDKEPESEEKAEEGEAAQSVEEEEGTSADKTAEPNVLEQAVQEIQAVAAALQQTAPETETEIPVETAAAAPETSAERRQPEDTNGRWEKMTQRAARFRRVSPHAC

SEQ ID NO: 76230 - DNA, 847 bp, Zea mays
  misc_feature: Ceres CLONE 1560897
  misc_feature: Encodes the peptide sequence at SEQ ID NO. 76231
  misc_feature (418)..(418): n is a, c, t, g, unknown, or other
  misc_feature (844)..(844): n is a, c, t, g, unknown, or other
ctccccgcggtggcggccgctctagaactagtggatcccccgggctgcaggaattcgtctcacccctagaaaaatgacaaggggctcggttagtccacagccctagaggctgcagctgcacacttctcttctctgttttcgccggttaaactttccccacttgttgctggccttcgaatctgtggtttgtttgagcttagcagggaagcgaagaacagggaagcaaggacatggatgctttcagtgcagtgatggacaaggtaaagagccacccaaaaatgatggagaaggtcagtgcagtgatggacaaggtgaagaagagccacccagaagcggtggaaaaggtcaaggacgaggtgatgagcctagctgatggtactaatatgttttttcccccccccccaagataaagaacctngagtctgaagagaaagcctaagaaggccaaccagcgcagagcttagaagaggaggagggtaactctggctaacaacactgcaaaacctaatgcgataggagacaggacgttcaggaagattcaagccgaccaccaaaacctatatatttaaacagaagcctgaaaaaaagaaattaaaaactacaagctggagactagcccaccggcgtcgtccttgaaaaccgacaagcaaaaggcaaaaccaagcccggaactatcacaaagagaggccttgtgagtaataagtactaagactcacaggtcaagtaggttatgcaaagaggggaggaggtgatccaacgcgcagggagatgcgtttgaagaaaagagtccctagccgacccggatattatgaatagaacaaataatgcaaccgccccaaccaanctg

SEQ ID NO: 76231 - protein, 59 aa, Zea mays
  misc_feature: Ceres CLONE 1560897
MDAFSAVMDKVKSHPKMMEKVSAVMDKVKKSHPEAVEKVKDEVMSLADGTNMFFPPPPR

SEQ ID NO: 76232 - DNA, 810 bp, Zea mays
  misc_feature: Ceres CLONE 1560898
  misc_feature: Encodes the peptide sequence at SEQ ID NO. 76233
ctggagctccccgcggtggcggccgctctagaactagtggatcccccgggctgcaggaattcgtctcacccctagaaaaagcctacttccaaacggacaaaccccatcgaaaaccgtctctcaaattcacaagggcccgccgccgccgcctcgtcccccattcatcttcgccgaaaccctaaccctagtcgccccgcggccacccttcccggcgacgccatgtcgaacccgaagggctccaagatgctccagttcatcaactaccgcaagcgggtgacgatccaagaagggcgccaacttgtgggcaagttcatggcgttcgaccgccacatgaacctcgtcctcggcgattgcgaggagtttcgccgcctcccgcactccaagtcctccaagaataccggtgaacgcgaggagcgccgcacgctcggcctcctcctcctccgcggcgaggaggtagtatccatgaccgtcgagggcccaccaccgcccgacgagtacagcgccaaggccgcagcggctggcggagccctcgccggccctggcatcgggcgcgccgctgggcgcggtgtgcccaccggcccgatgatccaggcagctcctgggctcgctggtcctgtacgtggaggttggtggacctgccaccgagcatgatgcatccccagatctcgcggccggcgatgcacgagctgtattgccatcctgtgtcatatccgcacgacatgcgaccgcctcaggggatgcctgcaccaatgcgtactggtattgccgcctcagaatattaataccgatccaacgcgccgggagatcccc

SEQ ID NO: 76233 - protein, 143 aa, Zea mays
  misc_feature: Ceres CLONE 1560898
  misc_feature (7)..(84): Pfam Name: LSM Pfam Description: LSM domain
MSNPKGSKMLQFINYRKRVTIQEGRQLVGKFMAFDRHMNLVLGDCEEFRRLPHSKSSKNTGEREERRTLGLLLLRGEEVVSMTVEGPPPPDEYSAKAAAAGGALAGPGIGRAAGRGVPTGPMIQAAPGLAGPVRGGWWTCHRA

SEQ ID NO: 76234 - DNA, 817 bp, Zea mays
  misc_feature: Ceres CLONE 1560900
  misc_feature: Encodes the peptide sequence at SEQ ID NO. 76235
ctccccgcggtggcggccgctctagaactagtggatcccccgggctgcaggaattcgtctcacccctagaaaaaatttccattcctcgctcaccaagccaacagccaaatcgaattcgccgacgactctctttattcctcccgctcgccgctgccgctgccgccgccgcctgagggcaagaagcgagcgagcgcaccgcggatctccatccctgccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttcgttcggtgcccctcccgtcctggatctgttgcccgagagcgcgagagcgcgcgagattcgcccccttctcttctcataggaagcaggaagcaagccgaccgctcgctgagcgccgccgccgatggccgtcgcggtgccgtccacgctgccgatgaagctctggagggcggaggcccgcggcaaggccgccgccgccgcggggcccgacgaccccctgcgcgtcctggtgacggtgaccgtcctcgggagcgccggcccgttgcggttcatcgtcttcgagggcgacacgggcgccgcgctcatcggcggggcgctgcgctgctacccccgcgaggggcccatggcggctgctcggcaacgaacccggccgggtttcgtcctctccaacggccaaagggg

SEQ ID NO: 76235 - protein, 92 aa, Zea mays
  misc_feature: Ceres CLONE 1560900
MAVAVPSTLPMKLWRAEARGKAAAAAGPDDPLRVLVTVTVLGSAGPLRFIVFEGDTGAALIGGALRCYPREGPMAAARQRTRPGFVLSNGQR

SEQ ID NO: 76236 - DNA, 840 bp, Zea mays
  misc_feature: Ceres CLONE 1560902
  misc_feature: Encodes the peptide sequence at SEQ ID NO. 76237
  misc_feature (69)..(69): n is a, c, t, g, unknown, or other
  misc_feature (70)..(70): n is a, c, t, g, unknown, or other
  misc_feature (313)..(313): n is a, c, t, g, unknown, or other
  misc_feature (314)..(314): n is a, c, t, g, unknown, or other
  misc_feature (410)..(410): n is a, c, t, g, unknown, or other
ctggagctccccgcggtggcggccgctctagaactagtggatcccccgggctgcaggaattcgtctcanncccctagaaaaaagtgctgtgctgtgcacgccaaccacaaccgaaagggagagccgaagagggaagggggagaagcgaccgcgccgccaaaccctagccccgcgcacgcgaccgcgggggagctccactccgccgctccgccccccgtccccgcttcgcgacatggccgattccccgcgcaggaggtactcaaggtccccttcatacagcagggggcacccaaaagggaggtcaagatcacannatctccagctcggtctcagtctaggtcacctgtcccagatcctagatctcaggcgaagtcaaggtctagaagcccagagagggaggaggatgctgntaaaccgtgggaatactctgtatgtgactggggctctccttcgagggttactgaaaagggatgttaaggattaattttttctaaccatggaaagggtgggttggtttcccattgtttgtcttgaaacccccataacccgtgtttccccgggggatttgcccttttgtcaacctgggaaccctggttaaaaaaaaccggaaacggttgcgctaaaaagagatcttaaaggggtcccttaattggaaagggccgaaaaaccccccccattttgaaaaaatcccccccccgggggtgcccccccaggagaaccacacacccccggggaaaggttttctttggtgcccctccccttttatttaaccccccgggggacccgcggggggaaggttccttaaaaaaaagagcttttttgggggggggggggggccct

SEQ ID NO: 76237 - protein, 83 aa, Zea mays
  misc_feature: Ceres CLONE 1560902
  misc_feature (27)..(27): Xaa is any aa, unknown, or other
  misc_feature (28)..(28): Xaa is any aa, unknown, or other
  misc_feature (60)..(60): Xaa is any aa, unknown, or other
MADSPRRRYSRSPSYSRGHPKGRSRSXXLQLGLSLGHLSQILDLRRSQGLEAQRGRRMLXNRGNTLYVTGALLRGLLKRDVKD

SEQ ID NO: 76238 - DNA, 786 bp, Zea mays
  misc_feature: Ceres CLONE 1560906
  misc_feature: Encodes the peptide sequence at SEQ ID NO. 76239
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgcccagtcgggctcatggggtgccgtcgagggctaacgcattgccgggcggggcggctcggcgaaggcttccaccccctgtaccctgggggaagctttcaaccccctcggcctggccgaaaaaccccaagcctttgcccgagcctcaggggaaggaacctaagaacggccgccctcccctgt

SEQ ID NO: 76239 - protein, 220 aa, Zea mays
  misc_feature: Ceres CLONE 1560906
  misc_feature (61)..(218): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACPVGLMGCRRGLTHCRAGRLGEGFHPLYPGGSFQPPRPGRKTPSLCPSLRGRNLRTAALPC

SEQ ID NO: 76240 - DNA, 908 bp, Zea mays
  misc_feature: Ceres CLONE 1560907
  misc_feature: Encodes the peptide sequence at SEQ ID NO. 76241
ctccccgcggtggcggccgctctagaactagtggatcccccgggctgcaggaattcgtctcacccctagaaaaaacctgcggcatctatagcaaccggtccagcactttcacgctcagctccagcaatggctgcctccaccatggcgatctcctccacggcgatggccggcacccccatcaaggtgggctccttcggcgagggccgcatcaccatgcacaagaccgtgggcaagcccaaggtggcggcgtccggcagcccctggtacggccccgaccgcgtcaagtacctcggccccttctccggcgagcccccgagctacctcaccggcaagttccccggcgactacggctgggacaccggcgggctgtcctccgaccccgagaccttcgccaagaacctcgagctggaggtgatccactcccgctgggccatgctctgcgcgctctgctacgtcttccacgagctgctctcccgcaacggcctctagttcggcgaagaacgtctggttccacgccgggctcccaaatctttcagcaaaggccgggctggactacctacggcaaccccagtcctgatccacgcagcaaaagaatccacgtcgacatgggccatgccaagttctggctacaagtgtgccatcaaagggctacccacatttggccgggtgggcagggtcgtgcgaggacacccaaacgcggcggaaacccgggcctggaaactatctaaacctcccttagggtgtgatccgaagaaccccggaaagtcctttcgccggaatctcaaagggttaaaagtaagctccaggaaaagggccccacttaggccttagattttgcaacgtttccggcggtcacttccgtccgaaagccttacaatttgacccggtgcatgggagcccctattatg

SEQ ID NO: 76241 - protein, 120 aa, Zea mays
  misc_feature: Ceres CLONE 1560907
  misc_feature (61)..(121): Pfam Name: Chloroa_b-bind Pfam Description: Chlorophyll A-B binding protein
  misc_feature: SWISSPROT Homolog: EC 1.1.5.2 Quinoprotein glucose dehydrogenase
MAASTMAISSTAMAGTPIKVGSFGEGRITMHKTVGKPKVAASGSPWYGPDRVKYLGPFSGEPPSYLTGKFPGDYGWDTGGLSSDPETFAKNLELEVIHSRWAMLCALCYVFHELLSRNGL

SEQ ID NO: 76242 - DNA, 843 bp, Zea mays
  misc_feature: Ceres CLONE 1560912
  misc_feature: Encodes the peptide sequence at SEQ ID NO. 76243
  misc_feature (685)..(685): n is a, c, t, g, unknown, or other
  misc_feature (693)..(693): n is a, c, t, g, unknown, or other
ctggagctccccgcggtggcggccgctctagaactagtggatcccccgggctgcaggaattcgtctcacccctagaaaaaacatgcgtcggctggggctgctcgtccaccccaacctcctccccgtcatcgcttacctctacaagaaggaggagaagctgctcgtcacggactacatggcgaacggcagcctggctcacgcgctccacggcgggacgaggtcgagcctaccgccgctggactggccgaagcgtctgaagatcatcaagggcgtggcgcgcgggctggcgcacctgtacgaggagctgccgatgctgatggtgccgcacgggcacctcaagtcctccaacgtcctgctggacgcgacatgcgagccgctgctgagcgactacgcgctggcccccgtggtgacgccgcagcacgcggcgcaggtgatggtggcgtacaagtcccccgagtgcgcggcgcagggcgggcggccggggcggaagagcgacgtgtggagcctgggcatcctcatcctggaggtgctgacgggcaagttccccgccaactatctccggcggggccacgcggacaccgacctcgccggctgggtcaactcggtggtgcgggaggagtggaccggcgaggtgttcgacaaggacatgcgtgggacgcgaagggcgaagggggagatgggactnctcccccnggggtcgggctcggctgctgcaacccctacgtgcaccggcgctggggccctcgaggaggcgctcgcgcgcatcgaggagctccgggagcgccgaccctggcgccgacgatgcaagcaccgcctcgtcgttctttaaaccacggaaaaagc

SEQ ID NO: 76243 - protein, 248 aa, Zea mays
  misc_feature: Ceres CLONE 1560912
  misc_feature (1)..(246): Pfam Name: Pkinase Pfam Description: Protein kinase domain
  misc_feature: SWISSPROT Homolog: EC 2.7.11.1 Non-specific serine/threonine protein kinase
  misc_feature (204)..(204): Xaa is any aa, unknown, or other
MRRLGLLVHPNLLPVIAYLYKKEEKLLVTDYMANGSLAHALHGGTRSSLPPLDWPKRLKIIKGVARGLAHLYEELPMLMVPHGHLKSSNVLLDATCEPLLSDYALAPVVTPQHAAQVMVAYKSPECAAQGGRPGRKSDVWSLGILILEVLTGKFPANYLRRGHADTDLAGWVNSVVREEWTGEVFDKDMRGTRRAKGEMGLLPXGSGSAAATPTCTGAGALEEALARIEELRERRPWRRRCKHRLVVL

SEQ ID NO: 76244 - DNA, 874 bp, Zea mays
  misc_feature: Ceres CLONE 1560914
  misc_feature: Encodes the peptide sequence at SEQ ID NO. 76245
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (594)..(594): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (616)..(616): n is a, c, t, g, unknown, or other
  misc_feature (618)..(618): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (636)..(636): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (645)..(645): n is a, c, t, g, unknown, or other
  misc_feature (648)..(648): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (663)..(663): n is a, c, t, g, unknown, or other
  misc_feature (719)..(719): n is a, c, t, g, unknown, or other
ctggagctccccgcggtggcggccgctctagaactagtggatcccccgggctgcaggaattcgtctcacccctagaaaaaaggaccggacaaaaccacacttacaagccacggaccacggaccagtctgcaacagcgcgacgctctcctccttccacgccagcaggagtcaggaggagaacgcgcgggcggccgggcgggtgccgggtgggacaagcacgcgttgatggcatctaccgccatcccgtccccgccgcctccggcggtgccagagcggagagtgccactggtgccgcggctggcggacgatggcggcgggggcggaatgggtgacgcgcgggggagtagtgcgggaggaagcgggagcgggagcgtggcgggcatttcgccgagcatcctcatcatcgcagtcatcgtggtggtgatgctgctcgcatcgctatgcatccactacttcatccgacacctctgccgccacgcgggcccagcggtgtcctcctccccttcgtcccgacaggctccgccgctcccgctggtggcgcaccccgcggcggtggcgtccgtggcgcccgccacgccagggnnnnnaaaaaanaaaaaaaaaannnnnnaaaaancnaaannnaaaaaannnttnannnnnnanccnccccnnnttttcacnttttccctctcccaatagccttaaggatcccaaaatgttctcctcaacttgctccnttagccaaaaagttcttcccgacgcaaagcaacctaaaatcgggcaatctggaccaaccttggcggaccctgcatccaagaacaagctgggaagaaaccggggcggggccccgttccaaagccaataccttgcaggcccggccccccagcgtagt

SEQ ID NO: 76245 - protein, 151 aa, Zea mays
  misc_feature: Ceres CLONE 1560914
  misc_feature (120)..(120): Xaa is any aa, unknown, or other
  misc_feature (121)..(121): Xaa is any aa, unknown, or other
  misc_feature (123)..(123): Xaa is any aa, unknown, or other
  misc_feature (127)..(127): Xaa is any aa, unknown, or other
  misc_feature (128)..(128): Xaa is any aa, unknown, or other
  misc_feature (129)..(129): Xaa is any aa, unknown, or other
  misc_feature (131)..(131): Xaa is any aa, unknown, or other
  misc_feature (133)..(133): Xaa is any aa, unknown, or other
  misc_feature (136)..(136): Xaa is any aa, unknown, or other
  misc_feature (137)..(137): Xaa is any aa, unknown, or other
  misc_feature (138)..(138): Xaa is any aa, unknown, or other
  misc_feature (139)..(139): Xaa is any aa, unknown, or other
  misc_feature (140)..(140): Xaa is any aa, unknown, or other
  misc_feature (143)..(143): Xaa is any aa, unknown, or other
  misc_feature (144)..(144): Xaa is any aa, unknown, or other
MASTAIPSPPPPAVPERRVPLVPRLADDGGGGGMGDARGSSAGGSGSGSVAGISPSILIIAVIVVVMLLASLCIHYFIRHLCRHAGPAVSSSPSSRQAPPLPLVAHPAAVASVAPATPGXXKXKKKXXXKXKXKKXXXXXPPXXFTFSLSQ

SEQ ID NO: 76246 - DNA, 806 bp, Zea mays
  misc_feature: Ceres CLONE 1560915
  misc_feature: Encodes the peptide sequence at SEQ ID NO. 76247
ctggagctccccgcggtggcggccgctctagaactagtggatcccccgggctgcaggaattcgtctcacccctagaaaaaacctgcaagcctcgagtggagctcttccacggccgcggtggagatggcggcgaatctggaggacgtgccgtcactggatctgatgcacgagctgctccgccgcatgaagtgcagctccaagcccgacaagcgcctcatcctcatcggtccacctggctctggaaagggaactcagtctcctattatcaaggatgaatattgcttgtgccatttagccactggtgacatgctgagggctgctgtggcggccaacacacctctaggtatcaaagctaaagaagctatgaataagggagagcttgtttcagatgatttggttgtgggcattattgatgaagctatgaagaaaccctcatgccagaaaggtttcattcttgatggctttcctagaactgtgactcaagcacagaagcttgatgagatgttggcaaagcaaggtgccaatgttgacaaagtcctgaactttgcaattgatgatgctgtattgcaagaacggatactggctgggaaacaccaacttaacccagtggtaaggacttaccactcaaaattttgcactccaaaagtctcaaggaagttgatgatgttacctgggagagccattggattccaaaggagagatgacacccgctgaaaggcttggaagtcaaagccttggaacctttccaccggaaccaaacgggaacccgggggaatgggattattacccccaaagaaagggcttta

SEQ ID NO: 76247 - protein, 196 aa, Zea mays
  misc_feature: Ceres CLONE 1560915
  misc_feature (33)..(171): Pfam Name: ADK Pfam Description: Adenylate kinase
  misc_feature: SWISSPROT Homolog: EC 2.7.4.3 Adenylate kinase
MAANLEDVPSLDLMHELLRRMKCSSKPDKRLILIGPPGSGKGTQSPIIKDEYCLCHLATGDMLRAAVAANTPLGIKAKEAMNKGELVSDDLVVGIIDEAMKKPSCQKGFILDGFPRTVTQAQKLDEMLAKQGANVDKVLNFAIDDAVLQERILAGKHQLNPVVRTYHSKFCTPKVSRKLMMLPGRAIGFQRRDDTR

SEQ ID NO: 76248 - DNA, 841 bp, Zea mays
  misc_feature: Ceres CLONE 1560919
  misc_feature: Encodes the peptide sequence at SEQ ID NO. 76249
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcggagagcatcctcgccatctgggcctgccaggtcgtgctcatgggtgccgtcgagggctaccgcattgccggcgggccgctcggcgaggtcgtcgacccgctgtaccctggcggcagcttcgacccccctcgggctggccgacgaaccccgagggctttcgccaggctcaagggtgaaagaagctcaagaacggcccgcctcgcccaggttttccatggtccggcttctttcgtccagggccatcgttacccggcaaagggca

SEQ ID NO: 76249 - protein, 238 aa, Zea mays
  misc_feature: Ceres CLONE 1560919
  misc_feature (61)..(222): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAESILAIWACQVVLMGAVEGYRIAGGPLGEVVDPLYPGGSFDPPRAGRRTPRAFARLKGERSSRTARLAQVFHGPASFVQGHRYPAKG

SEQ ID NO: 76250 - DNA, 817 bp, Zea mays
  misc_feature: Ceres CLONE 1560920
  misc_feature: Encodes the peptide sequence at SEQ ID NO. 76251
ctggagctccccgcggtggcggccgctctagaactagtggatcccccgggctgcaggaattcgtctcacccctagaaaaaacacccttcctcttccttataaaatacgcaagagtgcagctgcgcagccgccgtcgcgcagccagccatggccatcaaagatgagccgctgcacatcctcttcttcccgttcctcgcgccggggcacctcatcccgatcgccgacatggccgcgctcttcgctgcccgaggcgtcaggtgcaccatcctcaccacaccggtgaacgcccaactcatccgctcggcggtagaccgcgccaacgacacctcccgcagaatcgagggcgccctggacatcaaaatcgcggtcgtgcctttccccaacgtcagcctgccccccggcgtcgagtgcgccccggcgcttaacaccatggacgaccgcgaaaagttcttccacggggcccagttactccgcgagccgttcgaccggttcttggcggagaaccgaccggatgccgccgtgaccgacagcttcttcgactggtccgacgacgccgccgcggagcacggcgtcccgcagatagcgttcctcggcagcagcttgttctcgcgggcctgcaacgagtctacactgctcaacaacctcgtggaggacgcccccgacgacccggacgcgctcgtgctgcttccggggctgccgcaccacgtcgagctgaagcgtcggctgatgatggaacccaagacctggcgggacgctggggcttctgcaggacatgaacgctgctgaccagagtagctactgccaggtgtttcaccct

SEQ ID NO: 76251 - protein, 212 aa, Zea mays
  misc_feature: Ceres CLONE 1560920
  misc_feature: SWISSPROT Homolog: EC 2.4.1.238 Anthocyanin 3'-O-beta-glucosyltransferase
MAIKDEPLHILFFPFLAPGHLIPIADMAALFAARGVRCTILTTPVNAQLIRSAVDRANDTSRRIEGALDIKIAVVPFPNVSLPPGVECAPALNTMDDREKFFHGAQLLREPFDRFLAENRPDAAVTDSFFDWSDDAAAEHGVPQIAFLGSSLFSRACNESTLLNNLVEDAPDDPDALVLLPGLPHHVELKRRLMMEPKTWRDAGASAGHERC

SEQ ID NO: 76252 - DNA, 913 bp, Zea mays
  misc_feature: Ceres CLONE 1560926
  misc_feature (291)..(291): n is a, c, t, g, unknown, or other
  misc_feature (293)..(293): n is a, c, t, g, unknown, or other
  misc_feature (294)..(294): n is a, c, t, g, unknown, or other
  misc_feature (864)..(864): n is a, c, t, g, unknown, or other
ctccccgcggtggcggccgctctagaactagtggatcccccgggctgcaggaattcgtctcacccctagaaaaaggccggcccaattctcacgcgctcgccgcctacgagcattcacgttggtggcgggcggaggctcggttcctctcctccaccgcacctccaagaatcaacctccacgactaaactgaccgctcggcggcgacatggcagatcaccggctccaaccttccctctctggactacagtgctccaacgaccagtagccagtgctcctccatgggccatgggncnntgaagagcgcacgcacccgaaggagagattgatttggtggacccatatatacatgttcaaagaggggacatgtaggtggcttagaatcttcaagggatgggacaatgcgggtaaaaacacaggtgggccctccccggagaatcccggggcctccttttttccaatggtgccaaggatcggaacccctttttagccccccctttgttaataaagaaaacaatttaaaattcccaaaaaccccgccaattttgggggtttttttttggaaaaaatttttttgcccaaaatgttttgaccccccccttgtgtatacacacaaaaaattgtgtggttataaaaaaaaaattccggcggggggggggggagaagggatttttttttcctcccacggcgaaaaaaccccccttaaataaaaattggccagggaggaaaaaatttcttcctccccccctttaaaggggggggaaaattttttttttctcgccccaacaaaaaaaaaaaaggaggttttttattttttttttttaaaaaaaaaaaaaaaaattttttttttgagaaaaaagatttggnataaaaaataaaacacaatattttttttgggcgcgttgtcggaaaaaaa

SEQ ID NO: 76253 - DNA, 785 bp, Zea mays
  misc_feature: Ceres CLONE 1560927
  misc_feature: Encodes the peptide sequence at SEQ ID NO. 76254
ggagctccccgcggtggcggccgctctagaactagtggatcccccgggctgcaggaattcgtctcacccctagaaaaaaacagacccccgcccacgaccacacgcagcaagcagcagccgcgcgctcgcctaggactaccgactacgagtagtgctcagctagcctccatcctcagcgggcggccggcacatatggcagcgcagtccatgctcatgtcgaccagcgtcaacggcggccgcgcgctgccgtctcttcaggccgtccggccggctccatacccgcggctaccgctgccgtcgtcgtcatcctcgtcaggctacaggcactccaaggccgtctccgtgaagacgctcgccctgttcggcaaatccaaggtcaagaccgcgccggcgaagaaggcatcgctacttggagaggccattaccgggaagggcatccttgcccagctgaacctggagacgggcatccccatctacgaggcggagcccctcctcctgttcttcatcctcttcaccctccttggcgccatcggcgctctcggggaccgcggccgcttcgtcgacgaggaggtcaccggcctcgacaaggccgtcatccaacccggcaagggcttccgcggcgccctcggcctcagcgagggagggccgctgttcgggttcaccaagtcgaacgagctgttcgtggggcggatggcgcagctgggcgtggccttctccatcatcggcgagatcatcacggggaagggcgcgctggcgcagctcacatcgagacgggggtgccatca

SEQ ID NO: 76254 - protein, 197 aa, Zea mays
  misc_feature: Ceres CLONE 1560927
  misc_feature (53)..(180): Pfam Name: Chloroa_b-bind Pfam Description: Chlorophyll A-B binding protein
MAAQSMLMSTSVNGGRALPSLQAVRPAPYPRLPLPSSSSSSGYRHSKAVSVKTLALFGKSKVKTAPAKKASLLGEAITGKGILAQLNLETGIPIYEAEPLLLFFILFTLLGAIGALGDRGRFVDEEVTGLDKAVIQPGKGFRGALGLSEGGPLFGFTKSNELFVGRMAQLGVAFSIIGEIITGKGALAQLTSRRGCH

SEQ ID NO: 76255 - DNA, 829 bp, Zea mays
  misc_feature: Ceres CLONE 1560930
  misc_feature (716)..(716): n is a, c, t, g, unknown, or other
  misc_feature (717)..(717): n is a, c, t, g, unknown, or other
ctccccgcggtggcggccgctctagaactagtggatcccccgggctgcaggaattcgtctcacccctagaaaaaagactcgacggtcgattgcgccatagaatagagataaaagcattaccataggctcattcatcgaaacgcaaatcagagagacaggaaaagaaaaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttatttaatagtctctgactatcattaaataaagggtagagcaattcttttttctagagattctagagaaagtgagacaaagtgaagcgaaagagttttctttgtataagaattaggtctatatcatatctaaatagaagggaaatcaannagggggaagtggggattacaattggatgaatccttaagggagacatatcacaaaagaaataaaggctaaagtaagcgctcccttgcctttggtttgagcaaaaacgaattct

SEQ ID NO: 76256 - DNA, 846 bp, Zea mays
  misc_feature: Ceres CLONE 1560931
  misc_feature: Encodes the peptide sequence at SEQ ID NO. 76257
ctggagctcaccgcggtggcggccgctctagaactagtggatcccccgggctgcaggaattcgtctcacccctagaaaaagatcgatccttggagaacttcaaagggaagagatgcgatttattcagactttggaaagaggagaaaagttattagctgaacttctggatgaagctttattaaatgctggtaataatggaaataaatcttccttatctggaaaagatgttttccttttgtacgatacatatggtttcccagtagagattacagctgaaatagccagtgaacaaggcgttactgttgatattgagggatttgatattgaaatggaaaaccagaggaaacaatctcaagctgctcataatgtagtcaaactttctgtaggaaatgaaaccgagatagtaaagagcatccctgatactgaatttttgggatatgattatctctctgcttctgctgtcattaaaggtctcctagttaatggaaacccagttaatgaagtttctgaaggttctgaagtagaaatattattagaccggacaccgttctatgctgaatcgggtggtcaagtaggagataatggtttcttatatgtgaatgggagggggaaaatagaagacaaacaacagttatagaaatcaatgacgtccaaaagtctctgggaaatatatttgtgcacaaaggcatgattaagcaggggtcctgtagaggttggcaagaaagtagatgcttctgttgatgcaaaattgaggcacggggctaaggctcatcacactgcacacatctactacatctgcctcttaaaagtgtagtaggttcagtacttccccaggctggttcccca

SEQ ID NO: 76257 - protein, 174 aa, Zea mays
  misc_feature: Ceres CLONE 1560931
  misc_feature (2)..(173): Pfam Name: tRNA-synt_2c Pfam Description: tRNA synthetases class II (A)
  misc_feature: SWISSPROT Homolog: EC 6.1.1.7 Alanine--tRNA ligase
MRFIQTLERGEKLLAELLDEALLNAGNNGNKSSLSGKDVFLLYDTYGFPVEITAEIASEQGVTVDIEGFDIEMENQRKQSQAAHNVVKLSVGNETEIVKSIPDTEFLGYDYLSASAVIKGLLVNGNPVNEVSEGSEVEILLDRTPFYAESGGQVGDNGFLYVNGRGKIEDKQQL

SEQ ID NO: 76258 - DNA, 826 bp, Zea mays
  misc_feature: Ceres CLONE 1560932
  misc_feature: Encodes the peptide sequence at SEQ ID NO. 76259
  misc_feature (344)..(344): n is a, c, t, g, unknown, or other
  misc_feature (345)..(345): n is a, c, t, g, unknown, or other
  misc_feature (349)..(349): n is a, c, t, g, unknown, or other
  misc_feature (350)..(350): n is a, c, t, g, unknown, or other
  misc_feature (360)..(360): n is a, c, t, g, unknown, or other
  misc_feature (506)..(506): n is a, c, t, g, unknown, or other
  misc_feature (789)..(789): n is a, c, t, g, unknown, or other
  misc_feature (808)..(808): n is a, c, t, g, unknown, or other
ggagctccccgcggtggcggccgctctagaactagtggatcccccgggctgcaggaattcgtctcacccctagaaaaaagatccgcgtcctcggctcctcctcctcctcccttccttcgttccttccagatctccctcccagtcgagagtcgagatccaccgcctccgcgccccctcaccggagcagcgcgaggaagcggggggccagaggccagccatgggcaaggaaggggccagcgacggcggcatgtcggagtcggtgatccgcaaggtcctggtctcgtacatgtacgtggcggtgtggatcttcctctccttctccgtgatcgtctacaacaagtacnnatcnnctcgaccccnaagatgtacaactgggcccttccccatctccctcaccatggtgcacatggcccttctgctcctccctcgccgtggcgctcgtccgcgtcctccgcgtcgtcgaacctcccgtccctcgcccgccatggacggtcgcagctctacgntctcctccgtggctccccaatcgggggcggcttctaacttggggttttcggccctggggttttccaaattccggcctaatttaaacctttttccgttttccttttaatcaaaaaaggtttccaggggggggtaatttggcgccggggggcggttttaattcccaaagggggggcccccctttaaaaaagggagaaaactttttaaggcctcccccccccggggggccaaaaagggggggcgctccccatcaccgggggggggggggggtccccacactctcgncgccccccccctttttttntgaaagagacccgcgccc

SEQ ID NO: 76259 - protein, 131 aa, Zea mays
  misc_feature: Ceres CLONE 1560932
  misc_feature (43)..(43): Xaa is any aa, unknown, or other
  misc_feature (45)..(45): Xaa is any aa, unknown, or other
  misc_feature (48)..(48): Xaa is any aa, unknown, or other
  misc_feature (97)..(97): Xaa is any aa, unknown, or other
MGKEGASDGGMSESVIRKVLVSYMYVAVWIFLSFSVIVYNKYXSXRPXRCTTGPFPISLTMVHMALLLLPRRGARPRPPRRRTSRPSPAMDGRSSTXSSVAPQSGAASNLGFSALGFSKFRPNLNLFPFSF

SEQ ID NO: 76260 - DNA, 939 bp, Zea mays
  misc_feature: Ceres CLONE 1560934
  misc_feature: Encodes the peptide sequence at SEQ ID NO. 76261
  misc_feature (530)..(530): n is a, c, t, g, unknown, or other
  misc_feature (643)..(643): n is a, c, t, g, unknown, or other
  misc_feature (780)..(780): n is a, c, t, g, unknown, or other
  misc_feature (798)..(798): n is a, c, t, g, unknown, or other
  misc_feature (829)..(829): n is a, c, t, g, unknown, or other
  misc_feature (880)..(880): n is a, c, t, g, unknown, or other
  misc_feature (883)..(883): n is a, c, t, g, unknown, or other
  misc_feature (893)..(893): n is a, c, t, g, unknown, or other
  misc_feature (908)..(908): n is a, c, t, g, unknown, or other
  misc_feature (918)..(918): n is a, c, t, g, unknown, or other
  misc_feature (919)..(919): n is a, c, t, g, unknown, or other
ggagctccccgcggtggcggccgctctagaactagtggatcccccgggctgcaggaattcgtctcacccctagaaaaaaaccctacactgagaaccgcagagacaggcgtcttcgtactcgcctatctccgcgactcaaagatgtccccaattcccccccttctcccatttctcaccaccgccgccggtccccccgttcaacaacaccatgagggagtgcatctcgatccacatcggccaagctggtatccaggtcggaaacgcgggctgggagctgtactgcctcgagcatggcgttcaagatgatggccagatgcccggggacaagaccactgggggaggtgatgatgctttcaacaccttcttgagggagactggcgctaggaaaaacgtcccccccccccgcttgtgatgaccttgagcccactggtcaacgatgaggggaggacggggccctacctgccagcttcttcaataatgggcacgctcaaaaaagggcaagggaggatgcaacccaacaaactttctcntggaggggggagaaccaacacttgggcaagggagaaatggtctgaccccggtggcctataaacggaaataaaggaagagggggcacagaaacttatgcgcctggagacgccanaggggcggttccgcggtgtcttcagaaaaccaggtgaggggggagagagaaaaaggccccccggggaaagagatcttctcccaccgcccgcgggcggcaaggacgcagttagcccaaggagcaaaaaggcgcccagncttgcttgtcccccgggngcgcgcacgaccaccccgcggtctgcacatnaggcgagaagaaaaacctagaaaaagggggcgccgctcccactcgcggagnacncagagcgggnaactggaggctttgngggcgcagcnnccgaaaaaagagccagcgcg

SEQ ID NO: 76261 - protein, 67 aa, Zea mays
  misc_feature: Ceres CLONE 1560934
  misc_feature: SWISSPROT Homolog: EC 5.4.2.8 Phosphomannomutase
MRECISIHIGQAGIQVGNAGWELYCLEHGVQDDGQMPGDKTTGGGDDAFNTFLRETGARKNVPPPRL

SEQ ID NO: 76262 - DNA, 876 bp, Zea mays
  misc_feature: Ceres CLONE 1560935
  misc_feature: Encodes the peptide sequence at SEQ ID NO. 76263
  misc_feature (387)..(387): n is a, c, t, g, unknown, or other
  misc_feature (876)..(876): n is a, c, t, g, unknown, or other
gagctcaccgcggtggcggccgctctagaactagtggatcccccgggctgcaggaattcgtctcacccctagaaaaagctctgctctccttgcatagggtttatcttatcccctcctctgcccccatctcgcttctcgcacacgggagccggattccgaagcgcgccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaagtgtggggggggccaaagtacacttcantgaagcctcccgccaaatagggtgctttgtgaagcttggtgccgcaaaaggagaagacagttggggggatttttgcttccctctaaggccccaaactaaaacaacaaggagggggaggctggttgctgcttggaacaaggaaggaaccattcggggggacaagaaaaatttgctggtggaaattcccgaggaaggggaggcaccaagtaagtataacctccaaagtaatgcttgggggaatgaaaggttagaaattcccctgaaaggcaaaagcactctttagttctttaagaaaaaaaagaaaataaaatgggggattcaccggaagacaaaaagtatggggaaaggggacattaagacgcccccttatacgccacggggttttccattaaggggtggggcccaaaaccgcggagaccaaaagcttctctgggggggagcggaaagtcgccacggagagaggtccatagagaaaaccccccccgcccn

SEQ ID NO: 76263 - protein, 148 aa, Zea mays
  misc_feature: Ceres CLONE 1560935
  misc_feature (55)..(55): Xaa is any aa, unknown, or other
MSFVQLSGAGVAAVAFTNKSLVSRHAALRVCSSRRSIRSLVVKAASVGGAKVHFXEASRQIGCFVKLGAAKGEDSWGDFCFPLRPQTKTTRRGRLVAAWNKEGTIRGDKKNLLVEIPEEGEAPSKYNLQSNAWGNERLEIPLKGKSTL

SEQ ID NO: 76264 - DNA, 843 bp, Zea mays
  misc_feature: Ceres CLONE 1560936
  misc_feature: Encodes the peptide sequence at SEQ ID NO. 76265
  misc_feature (573)..(573): n is a, c, t, g, unknown, or other
  misc_feature (604)..(604): n is a, c, t, g, unknown, or other
ctggagctccccgcggtggcggccgctctagaactagtggatcccccgggctgcaggaattcgtctcacccctagaaaaaatttgcagattgcaacaccagcaactcattgcagctttcaggagctgaaacaacgagtggcagtgtgggagagcgcacggtagcaacttgagaaagggaagcaggagggaaatgggtgctgcgacgacgctgcccggcaacgccgggcccgtgcgctgctctcgcacgttcctcgcgctgctgctctgcttccagctactgcacacgtcgttggccctcaagctgcacggcgtcggcggctacgaggagaagaaggtcccgctggccgtcatcgtgccggacccctcaccggagctgtcgggcctgtccccggcgccgctcgccgcgccggcgccggtccacggtggtggcgacgtgcggccgaggctgccgacagagcggtggcgccgggacaggggagaggtccggcgcgccgcgcacccgccggccgcgcccgcggccgcacccgagcccacggcggcgccgtcggctggccccgccagagccccacgtnccggggcgccgggcgccgggctctggcgacngccggcgcggcgttcatcaagagcagcccggcccgtgccggtcccgcgcggcgtcacggacaccgacaccgtcctgcccatgcccgcgcccggagaaacgcggcaaggaagttggaggcgccaattcagttggagccgcctgtgtaatgccgctgctggtggggctcatggctatgctggagcttgtcttttgggatctaagcagcatgcagtttaaaactagcagtcgcaagagaaat

SEQ ID NO: 76265 - protein, 209 aa, Zea mays
  misc_feature: Ceres CLONE 1560936
  misc_feature (128)..(128): Xaa is any aa, unknown, or other
  misc_feature (138)..(138): Xaa is any aa, unknown, or other
MGAATTLPGNAGPVRCSRTFLALLLCFQLLHTSLALKLHGVGGYEEKKVPLAVIVPDPSPELSGLSPAPLAAPAPVHGGGDVRPRLPTERWRRDRGEVRRAAHPPAAPAAAPEPTAAPSAGPARAPRXGAPGAGLWRXPARRSSRAARPVPVPRGVTDTDTVLPMPAPGETRQGSWRRQFSWSRLCNAAAGGAHGYAGACLLGSKQHAV

SEQ ID NO: 76266 - DNA, 1257 bp, Zea mays
  misc_feature: Ceres CLONE 1560938
  misc_feature: Encodes the peptide sequence at SEQ ID NO. 76267
  misc_feature (12)..(12): n is a, c, t, g, unknown, or other
  misc_feature (59)..(59): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (1096)..(1096): n is a, c, t, g, unknown, or other
  misc_feature (1214)..(1214): n is a, c, t, g, unknown, or other
  misc_feature (1257)..(1257): n is a, c, t, g, unknown, or other
ttttttttaatngtggggtattattaaattttaaaaggaggggaaaaaatactctctcnccgcgcagggagagagggggggggctccccccggtggcggcccctctagagactagaggatcccccggggtgcaggaggtcgtctcacccctggaaaaaaggaccggtacaaagccacacttgcgagccacggaggactgaccagtctgcaagagcgcgacgctctcctgcttgcacgccagcatgagtcaggaggagaacgcgcgggcggccgggcgggtgccgggtgggacaagcacgcgtggatggcatctaccgacatcccgtccccgccgcctccggcggtgccacagcggaaagtgctactggtgccgcggctggcggactatggcggcgggggcggaatgggtgacgcgcgggggagtagtgcgggaggaagcgggagcgggagnnnnncgggcatttcaccaagcatcctcatcatcccacccatcggggatggcgatgccgctcggtgtggctatgcataccactacttgagtcgcgacaccatctggccggctacgctggggctcagggggtgatccatcggtcgccctaatggggggcggagcgaggtctccaggcagcatcacttgcatggtgggcaacaagcctcggggtgttaatgtaggtcgttcctatgaacaccactccaatcggttgaggagtgttaaaaattatcttacttgttaagttattgatgttgggtgatcatgtgctcttttgcctctggtttggatggtacattatctttaacattatattagggagcatgtgctgggtacatctttgggtctgcatgcagacggaagatggtggtttattctcatcacgctagtgtcgatactgttgttatcctatgagtgataatgacggtgcgtgtacaattcgagtgtatcgtcctgggtgtatggacaatgatgacaacgttgtggagcgaatatagagttatgtacggtaccatctagtgccatagatgtcgagaggccgagagtggatgggcttgggtataacggtgtagcgcactgtgtggagatgtgcgagtggcttgtcgnagaagagcgtctatgtagatatatctccacgctcacctgtcataaaccagatagagattggagagttcctgttatactactaatgtcccccataacagtaggttaacgttccatgacnaggtacggttggaataaattatgcgcagcgagatgcggtaaan

SEQ ID NO: 76267 - protein, 92 aa, Zea mays
  misc_feature: Ceres CLONE 1560938
  misc_feature (49)..(49): Xaa is any aa, unknown, or other
  misc_feature (50)..(50): Xaa is any aa, unknown, or other
  misc_feature (51)..(51): Xaa is any aa, unknown, or other
MASTDIPSPPPPAVPQRKVLLVPRLADYGGGGGMGDARGSSAGGSGSGXXXGISPSILIIPPIGDGDAARCGYAYHYLSRDTIWPATLGLRG

SEQ ID NO: 76268 - DNA, 798 bp, Zea mays
  misc_feature: Ceres CLONE 1560945
  misc_feature: Encodes the peptide sequence at SEQ ID NO. 76269
  misc_feature (360)..(360): n is a, c, t, g, unknown, or other
ggagctccccgcggtggcggccgctctagaactagtggatcccccgggctgcaggaattcgtctcacccctagaaaaagcacactcgcttgagcatcgtgtgctcttctcttcctcttccagttggtattctttatctgaaagactgaaacatagtacagaggaggagaggagagcgagagctaagaagatgaccggcaaggtcctgcttgtggccgtcctcttggtgggcgtggcctctcgatgctcgggcagtaggggcctgcagggcgatcacgttgctgaacagaagttcggtggcggtggctatggaggtggcggtgggtacggaggctacggtggcggtggaggaggaggggcngtggggtatatgcctgttgacttccacggccgctggcatcgatgctgtcgcagctacgatgcgcgttacgatggcgccaggaactctgacttctgcaagagcaactttggtcctgctcagtatgagcgtgtcatttctcgcatggccgagatatttcgaggactcgggcttgagtatgacatgtcggggctgacaggggatacgatggatagccataggctcatagcacttgctggacaccaaggctatgacaagcaaaatgctcttgttggagaattattcctttattacttttgtgaaggaaagtatattggtgacaagcaggttttgctggacgctgcaagaaaggtgggcatagaaggggccgaagaactgtttcaagaccctaccaaaggagtcgatgagggtcaggaagaactcaagaagtattcatctggc

SEQ ID NO: 76269 - protein, 203 aa, Zea mays
  misc_feature: Ceres CLONE 1560945
  misc_feature (1)..(72): Pfam Name: GRP Pfam Description: Glycine rich protein family
MTGKVLLVAVLLVGVASRCSGSRGLQGDHVAEQKFGGGGYGGGGGYGGYGGGGGGGAVGYMPVDFHGRWHRCCRSYDARYDGARNSDFCKSNFGPAQYERVISRMAEIFRGLGLEYDMSGLTGDTMDSHRLIALAGHQGYDKQNALVGELFLYYFCEGKYIGDKQVLLDAARKVGIEGAEELFQDPTKGVDEGQEELKKYSSG

SEQ ID NO: 76270 - DNA, 815 bp, Zea mays
  misc_feature: Ceres CLONE 1560948
  misc_feature: Encodes the peptide sequence at SEQ ID NO. 76271
ctccccgcggtggcggccgctctagaactagtggatcccccgggctgcaggaattcgtctcacccctagaaaaaatccctccgctacccacacgaacaatagcctttcctctcactcgcccctctgcatttaccactttgccctcgtcggcggcgctgaccacccgccgccgagtccggcgaaacaaccgcctgtagttccagagtagtacctcatggcggccatatcgtcgcttcccttcgcggcgctgcgcggagccgccgagtggaggccgtcgtcgacggcggcggccgtctccggcgccgtcgtgctcagcgcgaggtctcgccggggctcgcgctcggtggtgcgatgtgtcgccacgacgggtgatgtcccacccactgtcgcagaaacaaaactgaacttccttaagtcatacaaacgcccaatcccaagcatttacagtgcagtcttacaagaacttttggtgcagcaacacctgatgagatacaaaaaaacctatcagtatgatgctgtgtttgctcttggcttcgtcactgtctatgatcagctcatggaagggtaccccagcaatgaggacaaggattccatcttcaaggcatatataacagcattaaatgaagatcctgatcaatacagagctgatgcactaaagatggaagagtgggcacgttcccagaacggtagttccttagttgatttttcttccagagatggagaaatcgaggctattctgaaagaatatcagaaaaggccagggtaagggaaacttcgctacagccgaatctttgcagttgggcttgtccgtttgc

SEQ ID NO: 76271 - protein, 183 aa, Zea mays
  misc_feature: Ceres CLONE 1560948
MAAISSLPFAALRGAAEWRPSSTAAAVSGAVVLSARSRRGSRSVVRCVATTGDVPPTVAETKLNFLKSYKRPIPSIYSAVLQELLVQQHLMRYKKTYQYDAVFALGFVTVYDQLMEGYPSNEDKDSIFKAYITALNEDPDQYRADALKMEEWARSQNGSSLVDFSSRDGEIEAILKEYQKRPG

SEQ ID NO: 76272 - DNA, 840 bp, Zea mays
  misc_feature: Ceres CLONE 1560954
  misc_feature: Encodes the peptide sequence at SEQ ID NO. 76273
  misc_feature (793)..(793): n is a, c, t, g, unknown, or other
  misc_feature (834)..(834): n is a, c, t, g, unknown, or other
ctccccgcggtggcggccgctctagaactagtggatcccccgggctgcaggaattcgtctcacccctagaaaaactccgccctagcgccactgagccactcaacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacgatacgaggaaatggttgagtacatggagaaggtggctaagactgtagatgtggaagagctcaccgttgaggagcggaacctcttatctgttgcctacaagaacgtaattggggcccgccgtgcctcatggcgcattatctcctccatcgagcataaggaggagtcccgtaagaatgaggaacatgttattcagatcaaggagtaccgtggcaagattgaggctgaattgagcaacatttgtgatggtatcctgaagttgatcgactctcaccttgtgccttcctccactgctgcagagtcgaatgtgttttacctcaagatgaagggagattatcacaggtaccttgctgagtttaagactggtgctgagaggaaggaagctgcagagagtacaatgatagcttataaggcagctcagggatattgcgttggcgggaactggcatctactcatcccataaagacttggacttgcacttaaaacttctcaggttttctatttacgaagattctgaactctcccagacaaaagcttggcaaccttgncccaaggcagggcgttttgatgaaggcctattttctacagnttggaa

SEQ ID NO: 76273 - protein, 170 aa, Zea mays
  misc_feature: Ceres CLONE 1560954
  misc_feature (3)..(165): Pfam Name: 14-3-3 Pfam Description: 14-3-3 protein
MSREDNVYMAKLAEQAERYEEMVEYMEKVAKTVDVEELTVEERNLLSVAYKNVIGARRASWRIISSIEHKEESRKNEEHVIQIKEYRGKIEAELSNICDGILKLIDSHLVPSSTAAESNVFYLKMKGDYHRYLAEFKTGAERKEAAESTMIAYKAAQGYCVGGNWHLLIP

SEQ ID NO: 76274 - DNA, 789 bp, Zea mays
  misc_feature: Ceres CLONE 1560957
  misc_feature: Encodes the peptide sequence at SEQ ID NO. 76275
ggagctccccgcggtggcggccgctctagaactagtggatcccccgggctgcaggaattcgtctcacccctagaaaaaaagaaaggaaagcggtgcgagcggaggaggcgacagaagcgccacttgcttgagtagcgaagcgcgagagcaatggcgtcgctgtcgtgcgcctccacgctgccctggacccccgcctcctacccgcggccctcggcggggcgctgcctcacggcctctcgccgggctccgtcgctggtcatcgtcgcccaggggaaggtcaagaagtaccgccaggtcatattgacagatgacatagaagaggtggggaagaaaggggatacaatgaaggtgcgagctggattctaccgcaactccttgcttcccaagggcaaggctgcgcttctaaccccagcagtccacaagcaaaatacaatagtggcatctgagaatgaaaatccacctttaatgccggcaatcatgactcctggtggtgcgcttgatctcgcaactgtactactgggaaatcgtataatcttcattggccaatatattaactcccaggtggcccaacgtgtgatatcacagcttgtaacacttgctgccatcgatgaagaggctgatattctgatatatcttaactgccctgggtggaagtctctattcgatcttagcgatttatgattgcatgtccctggataaagcccaaaagttgggacagtgtgccttttgggtgttgtttgcctagtcaaggcagcaattttttcctttgaagggtgggcaaaaaaggaa

SEQ ID NO: 76275 - protein, 176 aa, Zea mays
  misc_feature: Ceres CLONE 1560957
  misc_feature (47)..(94): Pfam Name: Ribosomal_L9_N Pfam Description: Ribosomal protein L9, N-terminal domain
  misc_feature: SWISSPROT Homolog: EC 3.4.21.92 Endopeptidase Clp
MASLSCASTLPWTPASYPRPSAGRCLTASRRAPSLVIVAQGKVKKYRQVILTDDIEEVGKKGDTMKVRAGFYRNSLLPKGKAALLTPAVHKQNTIVASENENPPLMPAIMTPGGALDLATVLLGNRIIFIGQYINSQVAQRVISQLVTLAAIDEEADILIYLNCPGWKSLFDLSDL

SEQ ID NO: 76276 - DNA, 815 bp, Zea mays
  misc_feature: Ceres CLONE 1560959
  misc_feature (758)..(758): n is a, c, t, g, unknown, or other
  misc_feature (799)..(799): n is a, c, t, g, unknown, or other
ctccccgcggtggcggccgctctagaactagtggatcccccgggctgcaggaattcgtctcacccctagaaaaaatcttcgctgccttcgcttgttgttcagtgcgaaggcgatgcgggggctttagcgttcggggggctggtgaagctgcatgccctggtcccgggcctcatcttatgggggctggccgcagagactctgtcatgcgtgcacgcgctcgtccgcgtccaggagcgcgcgcgcgcctgccgcgcgattcgctcgcagcgtgtctctgcgcatcccgcgaactcttcgaggactccgggcggcgagaggctgggcagggagaggtcggaatcctgctggaggaactggctggaccgctgggtggaggataggtacatggacgacgagaagaacgccaagattctcgaggtggacaacggcaagccagggcgccggtatgcttccaagacgcgcggcggcggcggcggcggcggataccaccaccaccggcaccaccagtcgccgtgctcgacgacgatgggctacgagcagaacagcctgcagctacgccgaccatgccggatgtcggcgtttcaaaggacttcgacgaaccccgccagcaatcccggtggcccaaccccccccctttcggtgtggcaatgggccaagggagaagagccccccgaaaacccccccttggagagggggggcccgggtccccccccgggggatattttgtcgcccaaaaatattttttcttccaaaacaanaccccccccccccctctttttttttttttttttttgttctncaaaaaccccaaccct

SEQ ID NO: 76277 - DNA, 842 bp, Zea mays
  misc_feature: Ceres CLONE 1560960
  misc_feature: Encodes the peptide sequence at SEQ ID NO. 76278
ctggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccatcctagagatggatccgcaccaagagcaccaatgggtgtgttggttgggtggccgccgccgccaccagcttttgtcgattcaggggaaccaaagtatacggtgggggaaccttggcatggggccgtggacaactcgacctctggagaaacctattcagtgaagcaaaagacagggtgctgggatgctaaaggtcatcctacgaacagggatagcggcagggtccaaggggg

SEQ ID NO: 76278 - protein, 157 aa, Zea mays
  misc_feature: Ceres CLONE 1560960
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPS

SEQ ID NO: 76279 - DNA, 860 bp, Zea mays
  misc_feature: Ceres CLONE 1560961
  misc_feature: Encodes the peptide sequence at SEQ ID NO. 76280
  misc_feature (582)..(582): n is a, c, t, g, unknown, or other
  misc_feature (770)..(770): n is a, c, t, g, unknown, or other
  misc_feature (795)..(795): n is a, c, t, g, unknown, or other
  misc_feature (858)..(858): n is a, c, t, g, unknown, or other
ctggagctccccgcggtggcggccgctctagaactagtggatcccccgggctgcaggaattcgtctcacccctagaaaaagctcaaacaaatgatgattcatcgatagtggctgaggcgacagctctccaagtttcgtctgttcgctcgtggtggaaattccgctgagcgagcgagtgaatcctcctcttcctagccccggcgtgaggagcgccggcgatgtcgaccggcggcaggaagatgaggacggcgtgcgtgaccggaggaaacgggtatatcgcctcggcgctcatcaaggtgctgctggagaagggctacgccgtcaagacgacggtcaggaaccctgatgacatggagaagaactcccacctcaaggacctgcaggcgctcgggtccttggaggtcttccgcgccgacctggacgaagacggcagcttcgacgacgccgtcgccggctgcgactacgccttcctggtcgccgctccggtgaacctccacacgaagaatcccgaggaagaaatgatcgagccggccgtcaggggaactctgaacgtgatggggtcgtgcgtgaaggcgcgcacgntgaggcgcgtggtcctgacctcgtcggcggccgcggtcaccaccaggccgcagctacaagggcgacgggcacgtgctgggacgaggaagtcatgtcccgacgtcgagtacctcagagccctacagcctgcaggcccctggggggtacccggggtgtccaaggtgctccctgggagaaggaggcgagcnaggttcgcggaggagcacggcatcngccctcgttaccgttctgcccccggggcttaacgtgggggcgccgcggcccggccccgtacgncc

SEQ ID NO: 76280 - protein, 202 aa, Zea mays
  misc_feature: Ceres CLONE 1560961
  misc_feature (11)..(202): Pfam Name: Epimerase Pfam Description: NAD dependent epimerase/dehydratase family
  misc_feature: SWISSPROT Homolog: EC 1.3.1.77 Anthocyanidin reductase
  misc_feature (122)..(122): Xaa is any aa, unknown, or other
  misc_feature (193)..(193): Xaa is any aa, unknown, or other
MSTGGRKMRTACVTGGNGYIASALIKVLLEKGYAVKTTVRNPDDMEKNSHLKDLQALGSLEVFRADLDEDGSFDDAVAGCDYAFLVAAPVNLHTKNPEEEMIEPAVRGTLNVMGSCVKARTXRRVVLTSSAAAVTTRPQLQGRRARAGTRKSCPDVEYLRALQPAGPWGVPGVSKVLPGRRRRARFAEEHGIXPRYRSAPGA

SEQ ID NO: 76281 - DNA, 841 bp, Zea mays
  misc_feature: Ceres CLONE 1560962
  misc_feature: Encodes the peptide sequence at SEQ ID NO. 76282
  misc_feature (582)..(582): n is a, c, t, g, unknown, or other
  misc_feature (656)..(656): n is a, c, t, g, unknown, or other
ctccccgcggtggcggccgctctagaactagtggatcccccgggctgcaggaattcgtctcacccctagaaaaactccaatccaacgaactgaccacaaccacctaagctaaaagctaaccaccagacccccggccatggcgctcgcgcccacttccgctgccgtgctcaagaccccgttcctcggggccaggcgcgcgctcgccaatgccgccgccaagcccgcgcctcgccgcgcgctggtcgtcgccgccgcggccgccgccaagaagtcgtggatcccggccatcaagagcgacgccgagatcgtgaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggttggggtggagtcnaaaccgtggggtgtacttttctcaaccggactcccagggccgtggagtgggccacgccattgtttccgcaccgncgaagaacttcgctaacttcagccggcgagcaggggctaccggggcgggcaggtccttcgacccgactccggcctcgccgggcaccgtcaatggacggcggtctacatcccccgacgttcgacaaagctcgagccggctcaaggctgggcccaagattcaagcacgccccgcattcgccctggct

SEQ ID NO: 76282 - protein, 235 aa, Zea mays
  misc_feature: Ceres CLONE 1560962
  misc_feature (58)..(201): Pfam Name: Chloroa_b-bind Pfam Description: Chlorophyll A-B binding protein
  misc_feature (149)..(149): Xaa is any aa, unknown, or other
  misc_feature (174)..(174): Xaa is any aa, unknown, or other
MALAPTSAAVLKTPFLGARRALANAAAKPAPRRALVVAAAAAAKKSWIPAIKSDAEIVNPPWLDGSLPGDFGFDPLGLGKDPAFLKWYREAELIHGRWAMAAVLGIFVGQAWSGIPWFEAGADPSAIAPFSFGSLLGTQLLLMGLGWSXNRGVYFSQPDSQGRGVGHAIVSAPXKNFANFSRRAGATGAGRSFDPTPASPGTVNGRRSTSPDVRQSSSRLKAGPKIQARPAFALA

SEQ ID NO: 76283 - DNA, 785 bp, Zea mays
  misc_feature: Ceres CLONE 1560965
  misc_feature: Encodes the peptide sequence at SEQ ID NO. 76284
  misc_feature (613)..(613): n is a, c, t, g, unknown, or other
  misc_feature (636)..(636): n is a, c, t, g, unknown, or other
ctggagctccccgcggtggcggccgctctagaactagtggatcccccgggctgcaggaattcgtctcacccctagaaaaattgaagaaggctggggataatggggtgcgtgcagcttctggaggcttctcatatctatatgagccgttatggtggttgggaatgataactatgattctaggcgaggtagccaattttgcagcatatgcatttgcccctgccgtacttgttactcctctaggagctctaagcatcatatttagtgcagtgctcgcacacttcattctgaaagaaaatttgcacatgtttggcgttgttggttgcatactatgtgttgttggttctgttggtatagttttgcatgccccaaaggagagaaaaattgattctatgaaggaaatatggcatcttgcaacacagccaggttttattgtttattcatgcgtggcagtggcctgcgttctttttttgatatttcgggttgttgagcgctctgggcacagattgatgcttgtttacatagcaatctgttcattaatgggatctcttacggttatcagtgtaaaagcagttgccattgctctaaactatcattttggtggatcaaatcattncatctacgtccagacatgggtcnttcatagtagtagtcactattttgctgcttggtgcaattaaactacttaaacaaaggctctggactcgttcaacacggctggtggttctccctgaatactaacgggatgttcaccattccttaccatttgttgcaaaaatgatcatggt

SEQ ID NO: 76284 - protein, 224 aa, Zea mays
  misc_feature: Ceres CLONE 1560965
  misc_feature (9)..(215): Pfam Name: DUF803 Pfam Description: Protein of unknown function (DUF803)
  misc_feature (204)..(204): Xaa is any aa, unknown, or other
  misc_feature (212)..(212): Xaa is any aa, unknown, or other
GAPRGGGRSRTSGSPGLQEFVSPLEKLKKAGDNGVRAASGGFSYLYEPLWWLGMITMILGEVANFAAYAFAPAVLVTPLGALSIIFSAVLAHFILKENLHMFGVVGCILCVVGSVGIVLHAPKERKIDSMKEIWHLATQPGFIVYSCVAVACVLFLIFRVVERSGHRLMLVYIAICSLMGSLTVISVKAVAIALNYHFGGSNHXIYVQTWVXHSSSHYFAAWCN

SEQ ID NO: 76285 - DNA, 714 bp, Zea mays
  misc_feature: Ceres CLONE 1560968
  misc_feature: Encodes the peptide sequence at SEQ ID NO. 76286
  misc_feature (529)..(529): n is a, c, t, g, unknown, or other
  misc_feature (545)..(545): n is a, c, t, g, unknown, or other
ggagctccccgcggtggcggccgctctagaactagtggatcccccgggctgcaggaattcgtctcacccctagaaaaaacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgcggtccccaagctcggggtcatgcttgtgggggtggggaggcaacaacgggtccacgctgacggctggggtcattgccaacaggggaggggatctcatggggcgaccaagggactagggtgcagcaaagccaaactacntacgggctcccctcancccagggccttccaccaattcagaagtagggcaggctacaaaccgggggagggagaattttatggcgcccggtttcaaggaagccctccctacccccatgggtggaaacccccagaaccaaaccttttggtggtttttgggggagggcctggggggaacaatcccagcc

SEQ ID NO: 76286 - protein, 165 aa, Zea mays
  misc_feature: Ceres CLONE 1560968
  misc_feature: SWISSPROT Homolog: EC 5.5.1.4 Inositol-3-phosphate synthase
  misc_feature (104)..(104): Xaa is any aa, unknown, or other
  misc_feature (109)..(109): Xaa is any aa, unknown, or other
MFIESFRVESPHVRYGPTEIESEYRYDTTELVHEAKDGASRWVVRPKSVKYNFRTSTAVPKLGVMLVGVGRQQRVHADGWGHCQQGRGSHGATKGLGCSKAKLXTGSPXPRAFHQFRSRAGYKPGEGEFYGARFQGSPPYPHGWKPPEPNLLVVFGGGPGGNNPS

SEQ ID NO: 76287 - DNA, 1378 bp, Zea mays
  misc_feature: Ceres CLONE 1560970
  misc_feature: Encodes the peptide sequence at SEQ ID NO. 76288
aaacttgggacttggcactcccctctcctagtcctagccatccatggacgctacagcccaacgagccatggcagtagacacaagcaatgcaccaaccacatcttgctcttcttcgtcttgtacatcctcgtcctcactcgtcaatgaggcgccgcaagaggttccctgcaagaagtccaaaggcacgaacaagcggaagagggcgtcttcgccggactcccaagaagtagaagccaacaacaacggcagcggcaataacagtaatggccagcaaggcgaggagagcagcagctgctgcagcacggaggacaacgaggcgtcggcgagtgtcggcgaaaaggccgaggcggcggcggccgccaccgccaccggcgcggcgtcgagaagccggagcgggtacaagcacccgtcgtaccgcggcgttcggcggcggagctggggcaagtgggtgtcggagatccgggagccccgcaagaagtcgcgcatctggctgggcaccttccccacggccgagatggcggcgcgcgcgcacgacgtggcggcgctggccatcaagggccgcggcgcgcacctcaacttcccggagcgcgcgcacgagctgccgcggccggcgtccacctcccccgcggacgtccaggccgcggcggcccaggcggcagcggccgcggacgtgcagtgcgacgcgccgccgtcgccgtcgccgtcccccgaagcggccgccgcgtcgccggacgacgctgcctgctgcctcgaggcgacgacgacgacgacgacggtgcacagcggcgacggtgggcagggccaggagaacgcgctgttcgacctgccggacctcctcctcgacctgagggacgggctgtggtggccgccggtgtggcccgcggcggcaataatggccgccgaggagtacgacggctgcgacgtcgtcgggatgcacgagccgctcttgtgggccgagtagttagttactcgatcgccttgcgtttctactaccgagtggtgaagtacatgggtcttctccaagaaaaagagtgggaaaaaaaaccaccagacacatactagtatgtttaggccctgttcggtttcaccggaatagaccaggatttattccagctcatcaaaatctatataaattagagaagtaatccggctaggaatcaatccggggcttccatccctaacaaccgaacagggccttactgttcttgaattagcagtacgagtattgcctgtctgtgcttgatttgggcatggagcagctggcccgtcgtcccccgtgtgtgtttttttttctgtaccagtttgtgaggagtagagacgtcgactgatagcagtctgcaaatcgcaattattttctagtgaaaaaaaaaaaaaaaaa

SEQ ID NO: 76288 - protein, 305 aa, Zea mays
  misc_feature: Ceres CLONE 1560970
  misc_feature (122)..(173): Pfam Name: AP2 Pfam Description: AP2 domain
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: The sequence is a functional homolog of SEQ ID NO 164 in the 11/375,241 US patent application
  misc_feature: The sequence is a functional homolog of SEQ ID NO 2233 in the 10/666,642 US patent application
  misc_feature: The sequence is a functional homolog of SEQ ID NO 96 in the 10/714,887 US patent application
  misc_feature: The sequence is a functional homolog of SEQ ID NO 96 in the 11/435,388 US patent application
  misc_feature: The sequence is a functional homolog of SEQ ID NO 32 in US patent 7238860
  misc_feature: The sequence is a functional homolog of SEQ ID NO 166 in the 11/375,241 US patent application
  misc_feature: The sequence is a functional homolog of SEQ ID NO 2231 in the 10/666,642 US patent application
  misc_feature: The sequence is a functional homolog of SEQ ID NO 94 in the 10/714,887 US patent application
  misc_feature: The sequence is a functional homolog of SEQ ID NO 94 in the 11/435,388 US patent application
MDATAQRAMAVDTSNAPTTSCSSSSCTSSSSLVNEAPQEVPCKKSKGTNKRKRASSPDSQEVEANNNGSGNNSNGQQGEESSSCCSTEDNEASASVGEKAEAAAAATATGAASRSRSGYKHPSYRGVRRRSWGKWVSEIREPRKKSRIWLGTFPTAEMAARAHDVAALAIKGRGAHLNFPERAHELPRPASTSPADVQAAAAQAAAAADVQCDAPPSPSPSPEAAAASPDDAACCLEATTTTTTVHSGDGGQGQENALFDLPDLLLDLRDGLWWPPVWPAAAIMAAEEYDGCDVVGMHEPLLWAE

SEQ ID NO: 76289 - DNA, 684 bp, Zea mays
  misc_feature: Ceres CLONE 1560971
  misc_feature: Encodes the peptide sequence at SEQ ID NO. 76290
  misc_feature (321)..(321): n is a, c, t, g, unknown, or other
  misc_feature (385)..(385): n is a, c, t, g, unknown, or other
  misc_feature (480)..(480): n is a, c, t, g, unknown, or other
  misc_feature (481)..(481): n is a, c, t, g, unknown, or other
  misc_feature (483)..(483): n is a, c, t, g, unknown, or other
ggagctcaccgcggtggcggccgctctagaactagtggatcccccgggctgcaggaattcgtctcacccctagaaaaagaagcacccatggccctcgccaccactgccgtctccctccaccttttcctcacccggcccgcctccgtgctccgcgtaggccgcggcctcccatgcctcctcctccgagccacttcgtccacctccgcctccccggacttcaacatcaccttcgcggagcccgcgccgtccaaaaaggccccgtccgcgcagccgactgagtcccgtgggactcgtccagccgggggaaaggacgggcaaggnccccggccttaaagaccctcccccaccgccccggaacttaatcccagggccttccggggttttncccggaaaagggggggggggccaaaaaagggcccccccaaaaaaggggaaaaaccccccaaagggggcccaaaaaaaggggcccaattttgggcnncncccccccccccccggggtgttttttttaaagggccgccgctttaaagggcccaaaaaaaaaagaaaaaaaacccccccccccaaaaatgggggccccccaaaaatttttcccccaaaagagaccccccgaaagagggtttttttcccgggggaggaaaaatttgagggggggggggggggggaccccacacaccctccttt

SEQ ID NO: 76290 - protein, 81 aa, Zea mays
  misc_feature: Ceres CLONE 1560971
MALATTAVSLHLFLTRPASVLRVGRGLPCLLLRATSSTSASPDFNITFAEPAPSKKAPSAQPTESRGTRPAGGKDGQGPRP

SEQ ID NO: 76291 - DNA, 775 bp, Zea mays
  misc_feature: Ceres CLONE 1560973
ctggagctccccgcggtggcggccgctctagaactagtggatcccccgggctgcaggaattcgtctcacccctagaaaaaatagaaaagttgcgtttttccttattttcttcgtcatcttgttctcgacgcggtgccaaccgcgtcacgccgaatcccttcgatccagtatccaaagcctgacgcagcgcgccttcagattgctgaggtcgtcgttccgtaaaccgcggcgggcggccacgtcctcactttggcagcagcgcggagcgcgaaagtgacgacaaaccctggctgtttgactgcagagggcacgccggacgctccattcttaaaacgtgatgcaaagcatccaccatgccggcaaggaggtctgatgcccggggttcaggttcgccctgtaggtccaaacggacctcaaccatggagaccgtaagaaatgcaaggggcctgcttttccggcaagggaaaggtttacccaaattcaatttggttgggggggaaaccccaggaaaaccaaaaaaaccccaaggcgaaaaatcctttttggggggaaatttgggaaaaaccaattcccggggggcttttttaaagggggggcccccatgggggggtggaagaaaattaaaaggagaagagggggggtttaaaaaaaaccgcggggggggggtcccggggggggggggaaaatttgttgtgaggagagaaaaaaaaaaaagaggttttccccaaaggagggggggggggcccccccggggggaaataattttcatttggtg

SEQ ID NO: 76292 - DNA, 867 bp, Zea mays
  misc_feature: Ceres CLONE 1560974
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (178)..(178): n is a, c, t, g, unknown, or other
  misc_feature (759)..(759): n is a, c, t, g, unknown, or other
  misc_feature (816)..(816): n is a, c, t, g, unknown, or other
  misc_feature (817)..(817): n is a, c, t, g, unknown, or other
nnnnnnnnnnnnnnnnnnnnnnnnnnnnnnnnnnnnnggggnnnnnnnnnnnnnnnggggggnnnnggggnnnttttatgctggagctcccgcggtggcggccgctctagaactagtggatcccccgggctgcaggaattcgtctcacccctagaaaaacctggactcgtagttcatnccacgacgcacgcgaccagcaatgggccacgtgtcctgaggaagctcaccgtgcgctcctcgcccgtcccatcgccaagccccacatctcctgcgcgcaaacaccgcgcccgccaagcgcccagtaccagcccgcgtgcagcgagcaaccgcaagcacaaacacagcagcagtccgtgacaagcgcatccacaacaagccggcagcaaaggcccaaacccccccgggcgggcccggaacctccacggaactggggtggggcctcgttcccctttaacccgggggggttccggaaatccggcccccggaggtcttggcctttggggccccccttttttttcggggcccttccggggggccccccgttttcccaaaaacacggttttaaaaaaacaccccccctttttccaaagggttcccccccaaaaaaaaatccggggggggccccaaaaaccccccaaaggaggaacccgtggtgaaaaaaaagagaggaaacccgggggagggggtgtttttttttttggcgccccaaaaaaagggggggggccccgcgcggggtctcccttcaagaaaaaaaaaaancccccccttttttgggcggcgggggggggcggaaaaaaataatctcccccccccccnntggccggggggggggggaaaaacccacatttttttgtggtgttgtttttt

SEQ ID NO: 76293 - DNA, 854 bp, Zea mays
  misc_feature: Ceres CLONE 1560976
  misc_feature: Encodes the peptide sequence at SEQ ID NO. 76294
ctggagctccccgcggtggcggccgctctagaactagtggatcccccgggctgcaggaattcgtctcacccctagaaaaagtcgataaccaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcgatctggagaaatttctaagtcgtcgtcgtcgtcgtcgttcggttcggagcggatctgaggcgacgatggctggaggcggcgggatctcttggtctgcagtcctgcttcacctcgatggatgatgtctctgcgctgataattattggatcaatttcgataattattagtagatctatgagatatgccgcctggaagaggcgaggtaagctgcagcatgtaaaagtctgcgtgcgtcgacagcaaaaaagagaaaaaaagatgtgacatcctagaggaggcctttgccatgatgggtgcgctcgcatggcaggccaggtattaataaaaagatgattattgtgtgcgggggggaggaatcgcacggggggtttgatgtttttgggccccgggggtctcctccctcatcctggttccgtgttccctgtatccgttggtttccgccgcctgttgggtccgctgcgcaacgcccggatttttgcatcgaagccacggagatctacaacaaaaaca

SEQ ID NO: 76294 - protein, 74 aa, Zea mays
  misc_feature: Ceres CLONE 1560976
MLCRLRSDCWIRHLTGLNRARTGRKQQTRVGSCIDLEKFLSRRRRRRSVRSGSEATMAGGGGISWSAVLLHLDG

SEQ ID NO: 76295 - DNA, 727 bp, Zea mays
  misc_feature: Ceres CLONE 1560977
  misc_feature: Encodes the peptide sequence at SEQ ID NO. 76296
  misc_feature (517)..(517): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
ggagctccccgcggtggcggccgctctagaactagtggatcccccgggctgcaggaattcgtctcacccctagaaaaaccctccaacggacttgaccactaaaagctaagcacacccccggccatggcgctcgcgtccacctccgccaccgcgcccgctgccgtgctcaagaccccgttcctcggtgccaggcgcgcgctcgccaatgccgccgcgcccaagcccgcgccgcgccgcgcgctcctcgccgtcgccgcggccgccgccaagaaagtcgtgggaatcccccgcctttcaaggaaaccggaacccccccccaaaagtttttatttaaacccccccccgggctcaaaggggatccccccccggggaaatttggggttttaaaccccggggggggggggaaaagaccccgcgttcccccaatggggtttgggggggggggaaatttccccccccgggggggggggaaaaaaggcccccctcgggggggatttttttggggggggaaggccgntggaaaggaaccccccctggggtgtggggggggggggggaaacaaagggggggggctctccccccccctccttcttttttttnnnggggggggggggaagaacaaaccccccctcccccggggggggggggggggggaaaaaaaaaaaaaggggggggggggtttttttttttttcacacaacaaaagaaaagtcttgctccggggtggg

SEQ ID NO: 76296 - protein, 87 aa, Zea mays
  misc_feature: Ceres CLONE 1560977
MALASTSATAPAAVLKTPFLGARRALANAAAPKPAPRRALLAVAAAAAKKVVGIPRLSRKPEPPPKSFYLNPPPGSKGIPPRGNLGF

SEQ ID NO: 76297 - DNA, 783 bp, Zea mays
  misc_feature: Ceres CLONE 1560979
  misc_feature: Encodes the peptide sequence at SEQ ID NO. 76298
  misc_feature (160)..(160): n is a, c, t, g, unknown, or other
  misc_feature (330)..(330): n is a, c, t, g, unknown, or other
  misc_feature (343)..(343): n is a, c, t, g, unknown, or other
  misc_feature (352)..(352): n is a, c, t, g, unknown, or other
ctggagctccccgcggtggcggccgctctagaactagtggatcccccgggctgcaggaattcgtctcacccctagaaaaaaaacagcatctcaagtcttcacactcctcgccatcacataaaaccagtgcaagcagtaagcagctgcaatgggcgagcangcaccatggccctctcctccacagccttcgccggcaaggcagtgaacgtgccgtcgtctctcttcggcgaggcccgcgtgacgatgcgcaagacggcggcgaaggcaaagccggcggcgagctccggcagccccgtggtacggccccgaacgcgtgctctacctgggccngctgtccggcgcngccccgagnctactgacgggcgaagtcccgggcgactacggctgggaacaccccggggctgtcggcggaaccgggaaactttcgccaagaaccgggagcttgaaggcctcccactcccccttgggccattcctggggcccctttgggcttcccttttttcccgggaaattgcctcccccccaaaaagggggtttaaaattttggggaaaggccccctgggggtttttaaagggggggggggcgccccaaaaaaatttcccccccgaggggggggggggggggagaaaaaacccccggggggaacacccccggggggggcggggtttatcccccccgccaaaaaaaaacacccccccccccccccccttgggggcgccccccccacgaaatgtttgggttcctcttgtgggggcccccccccccataagggggggggcccc

SEQ ID NO: 76298 - protein, 206 aa, Zea mays
  misc_feature: Ceres CLONE 1560979
  misc_feature (60)..(60): Xaa is any aa, unknown, or other
  misc_feature (63)..(63): Xaa is any aa, unknown, or other
MALSSTAFAGKAVNVPSSLFGEARVTMRKTAAKAKPAASSGSPVVRPRTRALPGPAVRRXPEXTDGRSPGRLRLGTPRGCRRNRETFAKNRELEGLPLPLGPFLGPLWASLFSREIASPPKRGFKILGKGPLGVFKGGGGAPKKFPPRGGGGGEKKPPGGTPPGGAGFIPPAKKKHPPPPPLGGAPPTKCLGSSCGGPPPHKGGGP

SEQ ID NO: 76299 - DNA, 743 bp, Zea mays
  misc_feature: Ceres CLONE 1560983
  misc_feature: Encodes the peptide sequence at SEQ ID NO. 76300
  misc_feature (316)..(316): n is a, c, t, g, unknown, or other
  misc_feature (486)..(486): n is a, c, t, g, unknown, or other
  misc_feature (508)..(508): n is a, c, t, g, unknown, or other
ctggagctcaccgcggtggcggccgctctagaactagtggatcccccgggctgcaggaattcgtctcacccctagaaaaactcgtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcncacttcatatgatgaagtttttgaaagttttgatgacatgggccttcaagagaatcttttgagaggcatttatgcatatggttttgagaaaccatctgcaattcagcagagaggaattgttcccttctgcaaggggcttgatgtcattcagcaagcacaatctggtacanggaagacagcaaccttctggtnctgggatcttgcagcagcttgactatgggtctggttgaatgccaggcccctgggttctgctcccaccccgtgagcttgcacagcaattggagaaaggtatgcgcgcaacttggtgactcaccttggtgtttaaggtcactgcaggcgttgggagggaacatctggttccgtgaggaccaaaggattctccccccaggggggtggccaagtttgttgtttgggacacccgggggcc

SEQ ID NO: 76300 - protein, 58 aa, Zea mays
  misc_feature: Ceres CLONE 1560983
  misc_feature (45)..(45): Xaa is any aa, unknown, or other
  misc_feature (52)..(52): Xaa is any aa, unknown, or other
MGLQENLLRGIYAYGFEKPSAIQQRGIVPFCKGLDVIQQAQSGTXKTATFWXWDLAAA

SEQ ID NO: 76301 - DNA, 837 bp, Zea mays
  misc_feature: Ceres CLONE 1560986
  misc_feature: Encodes the peptide sequence at SEQ ID NO. 76302
  misc_feature (635)..(635): n is a, c, t, g, unknown, or other
ctggagctccccgcggtggcggccgctctagaactagtggatcccccgggctgcaggaattcgtctcacccctagaaaaagacgaactcatcactgcactggtggtgcccgtggtgctccacagagtgaagcgatagccaggagaggcgacgatgcgcaagtgggcgctctcctccgcgctcctcctcctctttctcctcaccacactccccgacccagctaagaagctacaagtgaatgccgaggagagcagcgatgacttggctaacccaccgaaggtagaggagaagtttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttctcttactgataaggaagttctaggtgaaggggacactgcaaagcttgagattcagattaagttggacaaagagaagaaaatcctctccattcgggatagggggtattggtatganccaaggaagatcttattaagaaccttggaacgattgctaaatctggcacttcagcttttgtggaaaagaatgcagtctggaggtgacctcaatcttattggaacagtttggtgttggcttctactcttgtgtacttggttgctgaactatgtttgaagtggtcagcaagcacaatgatgataaaaacagtatgtgtggggat

SEQ ID NO: 76302 - protein, 212 aa, Zea mays
  misc_feature: Ceres CLONE 1560986
  misc_feature (161)..(161): Xaa is any aa, unknown, or other
MRKWALSSALLLLFLLTTLPDPAKKLQVNAEESSDDLANPPKVEEKFGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGYWYXPRKILLRTLERLLNLALQLLWKRMQSGGDLNLIGTVWCWLLLLCTWLLNYV

SEQ ID NO: 76303 - DNA, 872 bp, Zea mays
  misc_feature: Ceres CLONE 1560988
  misc_feature: Encodes the peptide sequence at SEQ ID NO. 76304
ctccccgcggtggcggccgctctagaactagtggatcccccgggctgcaggaattcgtctcacccctagaaaaaacctccctcccctcctgcgctccaggtcccctccatcctgcggccaaaaattctgcagcgagctccgatccggtccgactactaacccacgccgccgaagccgcgcgacctgatcgcgcgggggtcgaggagaggggaagcgcggcgccgctgttgcctgccaccgtaccgccgcaggagaaggaagaggagcccgtatccctccgcccctctgcccgccggaccgatggactcgaagcactagatctcgcgcctgggcgccgcgaagcgcttctacccggcgcagctcggccacagcgagcgggccaggatggatgagctggacccccaccacgaggtcaggaccgagttcccctgcacctactgctacgaggacgacgacggcggatccctctgcgcgcacctggcaggaggagcacccgttcgaaccccaagcggcggcctgccctgtctgctctgagatgggttacgaaggatatggttaaacatattactacgggacatggatatttattcaaatcggcgcccgcctgcgcagattcatcatttccaggcgagccgggggcctctctttgctgaggccgacatctaggggaagccttctttgcaggtgcctcctcgggaggaggcgggaccagaaatcccacgaacaacggtggcggcaggcccctccaaatatttgcggatgaagaccctggcgggcccttaagtcggcgcaattggggattcccttacactccacacgcgggagatgaaacttatcccaacgcggagcgggtgtcccattacgcggaaggg

SEQ ID NO: 76304 - protein, 49 aa, Zea mays
  misc_feature: Ceres CLONE 1560988
MDELDPHHEVRTEFPCTYCYEDDDGGSLCAHLAGGAPVRTPSGGLPCLL

SEQ ID NO: 76305 - DNA, 846 bp, Zea mays
  misc_feature: Ceres CLONE 1560991
  misc_feature: Encodes the peptide sequence at SEQ ID NO. 76306
ctggagctccccgcggtggcggccgctctagaactagtggatcccccgggctgcaggaattcgtctcacccctagaaaaatttgttcattctatctgctgtctctgcaacctaatttgaatctgataatgaccttgttcttcagatatcatagccaagagagaatatttcaccagacgtttattgttctggcaacttgaaatgatgatgttgtatcacgttgagctttgccttctttttgcagctgaggagtaagattgcttctgcaacatcagctattaaatcagtatttggacaagaggtccaacagcaggatgcagtaggtgttttctgcccagttcctgtgaaatactgtacatcatatgtctttcttcactacggttcaaaccttctaacttatatttctcctcctaaaggcgaacaaattagagcaactcagagaaaggatggtcaaagtaagagagcttttccgcgacacggaatcaacagagtttataatcgtgacaatcccaacggtaactattgtgttcttagctccccacccccctagaatatgtactcccttgaaggtaatattttactgctatcttttgcactggtatttttcaggtgatggcaatcagtgagtcatcaagactgcattcttcgttgcaaaaggaaagtgttcctgtaaggagactcattgtgaaccaagttctgccaccttcaacatcggactgtaaattctgttctataaaaagaaaggatcaaacgcgtgcattggatatgatacggactgaccccagagttaaaaggtttgaacattatccaagcacctcttgtggactggaagattagaggtgttccg

SEQ ID NO: 76306 - protein, 74 aa, Zea mays
  misc_feature: Ceres CLONE 1560991
MAISESSRLHSSLQKESVPVRRLIVNQVLPPSTSDCKFCSIKRKDQTRALDMIRTDPRVKRFEHYPSTSCGLED

SEQ ID NO: 76307 - DNA, 822 bp, Zea mays
  misc_feature: Ceres CLONE 1560992
  misc_feature: Translation starting site: 200
  misc_feature (808)..(808): n is a, c, t, g, unknown, or other
ctggagctccccgcggtggcggccgctctagaactagtggatcccccgggctgcaggaattcgtctcacccctagaaaaaacctcagcctcacctgccttcccaatcaatcgcattctccgtccgcgacccaatccaggtgccgacagaccagataccagagcaaacaagaagccgtctcactccacgtcgcaagggaaatggccaccgcctcgctcgcactgctcgatcagacgctgctgccgtcccctctggcgtacaacggcggctccgaccgcctcagccaggagatcttctccatcctcgagtccaacttcctattcggcgcgtcgccgctggagggcggcgcgtgctccgcgggccgcgtccgcgtgctgtccatcgacgggggtgccgacggcggcgcgctggccgccgcagcgctggtacggctcgagcgccgcctgcaggagctctccggcaaccccgccgcgcgcgtcgcggacttcttcgacctggcggccggctccggcgcgggcgggttcctcgcggcggcgttgttcgcgtgccggatgcccgccgaggcggcgcgcgacgtcgtggccaagaaccggaaggtcctgtccgggcgtggcgggggcctgatgtcgttccggcgccccgaggccgcgttccggaaggtgttcggtgacctgacggtgcgcgacgccgccaagccgctgctgatcccgtgctacgacatggccaccgcggcgcccgttcgtgttctcccgcgccgatgccgtggaggccgacgcgttcgacttcccgctgtggcaggtgtgcgcggnggcttgcggcgtgg

SEQ ID NO: 76308 - DNA, 948 bp, Zea mays
  misc_feature: Ceres CLONE 1561003
  misc_feature: Translation starting site: 222
  misc_feature (466)..(466): n is a, c, t, g, unknown, or other
  misc_feature (467)..(467): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (597)..(597): n is a, c, t, g, unknown, or other
  misc_feature (598)..(598): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (626)..(626): n is a, c, t, g, unknown, or other
  misc_feature (627)..(627): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (646)..(646): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (658)..(658): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (693)..(693): n is a, c, t, g, unknown, or other
  misc_feature (699)..(699): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (726)..(726): n is a, c, t, g, unknown, or other
  misc_feature (727)..(727): n is a, c, t, g, unknown, or other
  misc_feature (729)..(729): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (768)..(768): n is a, c, t, g, unknown, or other
  misc_feature (769)..(769): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (827)..(827): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (853)..(853): n is a, c, t, g, unknown, or other
  misc_feature (854)..(854): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (943)..(943): n is a, c, t, g, unknown, or other
  misc_feature (944)..(944): n is a, c, t, g, unknown, or other
ggagctccccgcggtggcggccgctctagaactagtggatcccccgggctgcaggaattcgtctcacccctagaaaaagccgattaagcttgcttgccctagcagatcgaagccctagccctagccctagccgaggagcgcgcccatggccgtcgcggtcgtgggctgaggggccgcggctctttgcatggggtgaggaagcggcgtcccgaggcgcgggaatggaccctagcctgaaggaggaggtgatgaaggcggtggaggaggcgaggtccgcgactgtgccgcggtgccgggtggtgcggatcatcgtgcacgacgaggacgccaccgactcgtcctccagcgaggacgaggacgaggacgaggcgggggagcgcgccgcggcgcatccgggctcgccgtcggcgtcggcggggagcgtgaagcgcagccgcgtgctgctccagtccgccggggcgggaannaannnnannnaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaannnnnnnnannnannannnannnnnnnnnnnnannnnnnnnannannnaannnnnnnnnnaanaaaaannnnaanaaaaaannnnnnnnnnnnnnnnnnnnnaaaaaaanaaaaanaaaaannnaaannnnnnnnnnnnaaannanaannnnnnnnnnnnnnnnnnnnnnnnnaaannnnnnnannaaaaaaaaannnnnnnnnnnnnnaaannnnaaaaannnnnnnnnnnnaaaannnnnanaannnnnnnaaaaaaannnnnnnnannaannnaaaannnnnaaaaannnnnnnnnnnnnnnnnnnnnnnnnnnnnnaaannnnnnnnnnnnnnnnnnnaaaaaaannnnnnnnaannaaat

SEQ ID NO: 76309 - DNA, 807 bp, Zea mays
  misc_feature: Ceres CLONE 1561005
  misc_feature: Encodes the peptide sequence at SEQ ID NO. 76310
ggagctccccgcggtggcggccgctctagaactagtggatcccccgggctgcaggaattcgtctcacccctagaaaaactagaaaaactagattcccaagccaaggagttaaaatccttgaccgagtcaatcaatcgtaccagggaacccataaacattaccagagacgataggttttctcagcaccgcccactggaagaccatgtccctcctgttacgaggaatggggcaattaacagttcatggagatcttctcagcaaactaacatgtatggtgtgtcacatggtgactttggttccgcaaggtctgcttcattcgtgccagcacctgctgaacctacagctggatcattttcaagatcttatgccgagacgtccaccgctgcacaacgagcggataggtcctctggcggtaagccatgggagatgcagcagtattcgcagcagaggcctggttatggatccaactcccagttgaatgatgatggatcatactctgatgcccaggacagctatgctccttcctattaccagaatggaaaggcccctgattttcaatcagatgaacctaggtctttgacctacaacactgggattgaggagagaccgccgccgcctcagcgccgctgggtgccccctcagcctccaggtgttgtgatgccagaagcagctgctgctatacgtcaaccaaaggtccctccaaagcagccctccagcgatgcctctcgggcagctggagagatgcaagttgatgggtgcttcagtgcatcaccggatgctgtgaactgaggttccctggtaatagtg

SEQ ID NO: 76310 - protein, 262 aa, Zea mays
  misc_feature: Ceres CLONE 1561005
GAPRGGGRSRTSGSPGLQEFVSPLEKLEKLDSQAKELKSLTESINRTREPINITRDDRFSQHRPLEDHVPPVTRNGAINSSWRSSQQTNMYGVSHGDFGSARSASFVPAPAEPTAGSFSRSYAETSTAAQRADRSSGGKPWEMQQYSQQRPGYGSNSQLNDDGSYSDAQDSYAPSYYQNGKAPDFQSDEPRSLTYNTGIEERPPPPQRRWVPPQPPGVVMPEAAAAIRQPKVPPKQPSSDASRAAGEMQVDGCFSASPDAVN

SEQ ID NO: 76311 - DNA, 855 bp, Zea mays
  misc_feature: Ceres CLONE 1561006
  misc_feature: SWISSPROT Homolog: EC 3.5.2.6 Beta-lactamase
ctccccgcggtggcggccgctctagaactagtggatcccccgggctgcaggaattcgtctcaccactattaaagaaggtggactccaacgtcaaatggcgaattatcgtctatcatggcgatggcccactacataaaccatcaccctaatcaagttttttggagtcaaagtaccgtaaagcactaaaacagatccctgttcggatcccactatttaaaccttgaccagccaaagccagtgaacgtaccgataaaggaacggaagaatgcaaaccgagctggcgctagagccctagcaagtgtagcgctcacactcctcgtaaccaccaaacccgccgatcttaatgcgccacttcacgacgcatgagatggcactcttcgagaaaatgtggcccgaacccctatctgattatttttctaaatacaatcacatatgtatccgactcctgacacattaaccgtgattgatgcttcaatacatattgaacaacgaatagtatgaggattcgacatttccctgtcgcacttattccctttatatcggcattttgcacttcctgtttttgctcacccacaaacacctatgagacctcaaaatgctgaacatcaattccgtgcacgactgggttacatcgaactggatctacacaggtgctaaatccttgagacttctcccccctaagaacctactccaatgatcagcactatttaaagatctgcttatctagggcgggtattatgcctgtatggccgcctggcaacaagtactcatctcgacgcataccctattctcagtatgcccattggcttaaatcaccaccagatctcagagaagccatcctacagatcgcatgat

SEQ ID NO: 76312 - DNA, 811 bp, Zea mays
  misc_feature: Ceres CLONE 1561008
  misc_feature: Encodes the peptide sequence at SEQ ID NO. 76313
tggagctccccgcggtggcggccgctctagaactagtggatcccccgggctgcaggaattcgtctcacccctagaaaaagtgatccaaccaaagaccctatccaaaaccagaggcaagccaagacgcaagctgcaagcacgcgctcgtgcccgcgccatgaagtgctggtgcgtgcacgcgccaaggggagcaatggcgacgccgctctccagccccttggctcccaccgccctccgctcccctctccggcaccgcgccctgctgctgctgctgccgctgccgttccctccccgtgcggcctcctccggcgaggacaccgccgcagcagccgaccaggagccggccccggcggccaccaagacggccaccgcggacgacgacttcgaggagcgcgtgctacggatcaagtcccgcgtcgggcccaagaagcgcggcgcgcgcaagaagaaggccgcggcgtccgcgtcagccagcgccgtgacgctcccgcccgtgccgctgcgggagccccggtcggcgctcggcgcgcccgtcgagctcggcttcaccgcgtacagcgagaggctcaacggcgcgctggccgcgctggggctcgccgcggtgctgctcgtggagctgggctccgggcaggccctggtgaagtaccaccagccggccacgctgtgcctgcaggcgtacaccgtcgctgcggccgccgcgctgttcatcaagtacgagaaggagcggatcagcacgtggccggggccgccggcaaagtgagataaatggcgttgtctccggtcgcgatctttacttgtacttttacctctt

SEQ ID NO: 76313 - protein, 200 aa, Zea mays
  misc_feature: Ceres CLONE 1561008
MKCWCVHAPRGAMATPLSSPLAPTALRSPLRHRALLLLLPLPFPPRAASSGEDTAAAADQEPAPAATKTATADDDFEERVLRIKSRVGPKKRGARKKKAAASASASAVTLPPVPLREPRSALGAPVELGFTAYSERLNGALAALGLAAVLLVELGSGQALVKYHQPATLCLQAYTVAAAAALFIKYEKERISTWPGPPAK

SEQ ID NO: 76314 - DNA, 823 bp, Zea mays
  misc_feature: Ceres CLONE 1561009
  misc_feature: Encodes the peptide sequence at SEQ ID NO. 76315
ctcaccgcggtggcggccgctctagaactagtggatcccccgggctgcaggaattcgtctcacccctagaaaaacttgccaatatctggtcttgtgggaaccaatatgaaaaccaggatggataaaagcatttgtagttggtgggatggcccatgtctttttgaagttctggaccgtattgtagttcctttacgtgaccccaaaggttcagtaaggatgccgattattgataaatataaggatatgggcactgttgcaatgggcaaaatagagtctggcactatcagagagggtgacagtttgttggttatgccaaacaagtcccatgtgaaagtcattggtttgaacttggatgagagcaaagtacgtcgtgctggacctgctgagaatgtccgtgttaaattgtctggagttgaagaggaggatgtaatggctggttttgtactttcaagtgttgctaatcctgttggtgccgttagtgaattcattgctcagttgcagattttagagttgcttgacaatgctattttcactgccggctacaaagctgtgttgcatattcactctgttgtcgaagagtgtgagattgttgagctcatagaggaaattggcatgaagaaaaagaaagaagaagatccaaagaagataaagccaaagaggaagcctctttttgtgaagaacggtgcaattgttgtttgccgcattcaggtgaataacttgatatgcatagagaagtgctctgatttccctcagcttggaaggtttacacttagaactgaaagaaagacggtagctgtaggcaaagttgttgatattccgcctg

SEQ ID NO: 76315 - protein, 235 aa, Zea mays
  misc_feature: Ceres CLONE 1561009
  misc_feature (117)..(234): Pfam Name: GTP_EFTU_D3 Pfam Description: Elongation factor Tu C-terminal domain
  misc_feature (44)..(111): Pfam Name: GTP_EFTU_D2 Pfam Description: Elongation factor Tu domain 2
MDKSICSWWDGPCLFEVLDRIVVPLRDPKGSVRMPIIDKYKDMGTVAMGKIESGTIREGDSLLVMPNKSHVKVIGLNLDESKVRRAGPAENVRVKLSGVEEEDVMAGFVLSSVANPVGAVSEFIAQLQILELLDNAIFTAGYKAVLHIHSVVEECEIVELIEEIGMKKKKEEDPKKIKPKRKPLFVKNGAIVVCRIQVNNLICIEKCSDFPQLGRFTLRTERKTVAVGKVVDIPP

SEQ ID NO: 76316 - DNA, 821 bp, Zea mays
  misc_feature: Ceres CLONE 1561014
  misc_feature: Encodes the peptide sequence at SEQ ID NO. 76317
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (785)..(785): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (807)..(807): n is a, c, t, g, unknown, or other
  misc_feature (808)..(808): n is a, c, t, g, unknown, or other
ggagctccccgcggtggcggccgctctagaactagtggatcccccgggctgcaggaattcgtctcacccctagaaaaaaacgcaggccgcagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggatgaagccatgatcaagcagccgacaccggacgaggaccgtgagggcgcatggccctcagtgctgacgatcatcggctttggattcctaaccttcaactcattcatggctgtgtacaggtcaaatggagatgttggatctatctcctttgtggtcttctcttacctggtcctcgttctgctgttctactgactgcgccgattcgagacaactccaccagagtcgcctagccgggagcacataaaaatggccgtgtgggtactcaccacgatgctcactgctgcgttctcatacaatgtggcagcaattatgccactcccggtgcaagtgctggtgtgggcaatggaaggagcaactgtgcttcggtggtttttatgctttcttcatccaccaggaaaaaaccgcccagctggaacccccaaaacgataacgagggtgcccgtcctgctagccggtgtgcttgctgtgagatcatttggcatgtgcgtgttaggtagactgnnnnnnannnnnnnnnnnnnnnnnnnnnnncnnnnnnnnnncnnnnnaancaacacccnnnnacacaccccnnaggggccacatat

SEQ ID NO: 76317 - protein, 74 aa, Zea mays
  misc_feature: Ceres CLONE 1561014
MASKQQQKQFLDEAMIKQPTPDEDREGAWPSVLTIIGFGFLTFNSFMAVYRSNGDVGSISFVVFSYLVLVLLFY

SEQ ID NO: 76318 - DNA, 817 bp, Zea mays
  misc_feature: Ceres CLONE 1561017
  misc_feature: Encodes the peptide sequence at SEQ ID NO. 76319
  misc_feature (655)..(655): n is a, c, t, g, unknown, or other
ctggagctccccgcggtggcggccgctctagaactagtggatcccccgggctgcaggaattcgtctcacccctagaaaaaggcctatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgctcccccgggggaaaactccattgggnaaaggggttccaagggtggcatcaaggaggcacaaacttcaaagcgcggggctgaatgacgcaacggttcccaagagcccacccggcaagctgggttcccatcgggagccggggacgaacgcccgggccccgcgtgtacaagggggaaagaagatgccccgg

SEQ ID NO: 76319 - protein, 182 aa, Zea mays
  misc_feature: Ceres CLONE 1561017
  misc_feature (51)..(181): Pfam Name: Ribosomal_L3 Pfam Description: Ribosomal protein L3
  misc_feature (164)..(164): Xaa is any aa, unknown, or other
MAMAAVGVGGAVAFLLPQRRQGAVPWSGGRRRAPVAVRASYEAGVGVMATKVGMMTYFDPETGKPVPVTVVGFREGGNVVTQVKTAATDGYDAVQVGYHGVREDKLTRPELGHLGKAGAPPLRHLQEFRLTAVDAFEPGQPLDFADLFKEGDLIAPPGENSIGXRGSKGGIKEAQTSKRGAE

SEQ ID NO: 76320 - DNA, 675 bp, Zea mays
  misc_feature: Ceres CLONE 1561019
  misc_feature: Encodes the peptide sequence at SEQ ID NO. 76321
ctccccgcggtggcggccgctctagaactagtggatcccccgggctgcaggaattcgtctcacccctagaaaaaagcaccagccatgactcctccgcttctcctctccctcctgctggtggcggcgaggtgctgccgctgctgccatggctggtcgtcgtttcagaagccggcggtgactgcggtgatcgctttcggagactccattgtggacccggggaacaacaacgggctgcatacggtgatcaaggccaaccatccgccctacggcaaggacttgttcaaccacgaggccaccggacgctactccaacggccctcattcccaccgacctaattgggtacgcccctactaaagttatggttatgtttatggtaccaccaggaccaatatattcatttatggcatgggttgccatgccatggcatggcagccccagggaagctgggggtgtgaaagcttgcctggcctttcccctggccccttaactttgggggccgttggggaatttcttggaaagccccccggggaaggggaaaccctggggcctttccacccccggagggggtgtttccaagggctcttttctccggggggtttccccccgggggggggggggccccccccccccccggggggggggtttttttttcggaaaaaaacccccccgcccgca

SEQ ID NO: 76321 - protein, 89 aa, Zea mays
  misc_feature: Ceres CLONE 1561019
MTPPLLLSLLLVAARCCRCCHGWSSFQKPAVTAVIAFGDSIVDPGNNNGLHTVIKANHPPYGKDLFNHEATGRYSNGPHSHRPNWVRPY

SEQ ID NO: 76322 - DNA, 805 bp, Zea mays
  misc_feature: Ceres CLONE 1561026
  misc_feature: Translation starting site: 120
ctccccgcggtggcggccgctctagaactagtggatcccccgggctgcaggaattcgtctcacccctagaaaaacagccccagatttctccaagcctccgggacgaggcgcatccgtccatgggggccaaggaggcacaccggcgtggggtgctggacctggaggcgcagttcgccttcttccggtcgcagcaccggcaccccgtgaacgcggcggcgcacgtgctgctcacctggcccatcctcttcaccaacctcttgatcctccacttcctgccgctgccgctgcccgtctcccccgcgctggccctcgcgctcacatacgccgccgcctacctcgctgtcaaccgcagagccggcgcagtcgcggggctgctcttcctcgccgcatgggccgccagccgcgccctcgcggaccgcctcggcttcgctctctcctggaagcttgtcctcgtcacgcacgtcattctggctggacctggaattttcctcgggccacggcctcttcgagaagaaggggccgagtgttagtgatcttcctgaggtgttcttgatggagccgttcctcatcttcctgcagatactgaacaaactgttcggctatgagccgtatcctgggttctgcaagaacgtggacaggaagatcgaagccgatctcagggcgagcgagagctcaagcagaggaaggacaacctgattgattgggaattcgggagtgatcctccggagcggtgcgccgaaatgtaccatctatacatgtagcatattgcttgccatttgtgttgttttattcaggtatatgatat

SEQ ID NO: 76323 - DNA, 778 bp, Zea mays
  misc_feature: Ceres CLONE 1561027
  misc_feature: Encodes the peptide sequence at SEQ ID NO. 76324
ggagctccccgcggtggcggccgctctagaactagtggatcccccgggctgcaggaattcgtctcacccctagaaaagcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatccccccggagaccgcgctgccgtggttcaagacgggcgtcatccccgcccgcggcacctacaactactggggccgactcctacacgctcttcgtctttcacatgggcgctcatggggcttcgccgaagcaccgcccgcctccaggaatgggtacaacccggggctcccatggggcaaagcagtactttccccgggcccccaaaaaattccccggccggggtcccggggaaaccccgttttttaacccggg

SEQ ID NO: 76324 - protein, 200 aa, Zea mays
  misc_feature: Ceres CLONE 1561027
  misc_feature (55)..(189): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAVGAIAPEIFGKMGIIPPETALPWFKTGVIPARGTYNYWGRLLHALRLSHGRSWGFAEAPPASRNGYNPGLPWGKAVLSPGPQKIPRPGSRGNPVF

SEQ ID NO: 76325 - DNA, 809 bp, Zea mays
  misc_feature: Ceres CLONE 1561039
  misc_feature: Encodes the peptide sequence at SEQ ID NO. 76326
  misc_feature (736)..(736): n is a, c, t, g, unknown, or other
  misc_feature (758)..(758): n is a, c, t, g, unknown, or other
ctggagctccccgcggtggcggccgctctagaactagtggatcccccgggctgcaggaattcgtctcacccctagaaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaacgcgcctaaggagaagaagccgtccgcggcgaagaagccggcggcgcaccctccctacgctgagatgattgtagaggcgatcgctgccctcaaggagaggaaggggtcgagctcggtggccatcagcaagtacgtcgaggggaagcacggcggcaagctccccacctacttccgcaagctgctcaccgtgcagctgaagaagctcgctgccgccggcaagctgacgagggtgaagaactccttcatgctgccggccaccgacgccaagcccatggccgccaagcccaaggctccctaggccgcgcccaagcccaagccctctccgaatgcgaatgccaagaccgctgcgaagcccatagcggcgtcgcccaagccctaggccaaggtcaaggccaacgtcaagcctgtcgctcttgacgccgcgtctgccaaatgcccctcgggcgccctncccaggtcggccagaccctcgncaaggactcccccgccaggcagcccagaaggcggctgctcctgcccaggat

SEQ ID NO: 76326 - protein, 137 aa, Zea mays
  misc_feature: Ceres CLONE 1561039
  misc_feature (54)..(124): Pfam Name: Linker_histone Pfam Description: linker histone H1 and H5 family
MSTEEAVVAEVPVTEVPAEVPAAQVAEAPKAKKAPKEKNAPKEKKPSAAKKPAAHPPYAEMIVEAIAALKERKGSSSVAISKYVEGKHGGKLPTYFRKLLTVQLKKLAAAGKLTRVKNSFMLPATDAKPMAAKPKAP

SEQ ID NO: 76327 - DNA, 726 bp, Zea mays
  misc_feature: Ceres CLONE 1561042
ggagctccccgcggtggcggccgctctagaactagtggatcccccgggctgcaggaattcgtctcacccctagaaaaaattgtctactcctacgcttgagatgtggacttctcttcctctggcgtctggggccgagactcctagaaattactactagtttgatggtggcatctccaacatgcaagcttatcaagaactgctgttcggacgggcggtcagagcagacagtgggctctgacctggacagaaatctgctcatctccaggagcgcgtgtctcctactagctcctcgtggctctagaaggctgcattgtcctccgcgcctgctctggctgctcatgacccgtgccgttcgtctacgtcacctacgccatctcatcaagtcgctggtcatcatgcaccttgtgtacattctccatggcgggcttaaagtgcccaccattcgagatggtgggggcgctccatgcttcccaggttctaaaacggggaaatttccaccccgaaaatttgagggggttttcccccccttttggggagggggccttaagtttgttacggggcaaacccccaggggggtttatggggtcaaaaaccccttcttccggaggggggctttttttttggggggccccaaaaaaagaggtttttttggggggaaccaaaaaatttttgggagagttttcccccgggggggggaaaccttttatttggcccccccccggggtt

SEQ ID NO: 76328 - DNA, 823 bp, Zea mays
  misc_feature: Ceres CLONE 1561043
  misc_feature: Encodes the peptide sequence at SEQ ID NO. 76329
  misc_feature (814)..(814): n is a, c, t, g, unknown, or other
ctggagctccccgcggtggcggccgctctagaactagtggatcccccgggctgcaggaattcgtctcacccctagaaaaaactcggcccattccaagtcccaccttgcgtacgtgagccaaacgctcctggtcctggcagtctccatctccacctagggttccggcgatggtgcacggcggctacccgcgccgcgacgccgccgtccgccggcccaagtcctcgtcctccgccgtagttgccgaccgcaagcggaagtggaccgccgccgccaagaacacctcacttaaaaaccagatccgttccactgagcgctttctccacaaggtacttaccgacacctgggggctggggtcttctcgactgagctcggaacctctagtttagcgttgttcctacccagtggatgggctttggctgttgcttgtggagcgctgggtgtttctctaggaacctctccattttctagttgattgggaagcttccccgaacgtagctaggaattttagcacgaaagtctttctacaatgatgaattgttcaaccacaaatatttatttacttgttgcttctgtagggggctaggggcaaattgatgcttcaactgaggcctctgtttgttgcattccgctcagtagcctaattcatggtgtagctggattactgcagcttgcataggtgattaggtgctattaagtatcaagtattgattgaaaaactatcagactgaaatgttaactatgttgctcaaacggttagtcagaaatgctgtgaaagggcatttgttcttgtcagaggagaagtgacgaagcctanttgaccctg

SEQ ID NO: 76329 - protein, 72 aa, Zea mays; identical to SEQ ID NO: 75470
  misc_feature: Ceres CLONE 1561043

SEQ ID NO: 76330 - DNA, 848 bp, Zea mays
  misc_feature: Ceres CLONE 1561045
  misc_feature: Encodes the peptide sequence at SEQ ID NO. 76331
  misc_feature (625)..(625): n is a, c, t, g, unknown, or other
  misc_feature (626)..(626): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (661)..(661): n is a, c, t, g, unknown, or other
  misc_feature (668)..(668): n is a, c, t, g, unknown, or other
  misc_feature (669)..(669): n is a, c, t, g, unknown, or other
  misc_feature (688)..(688): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (725)..(725): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (764)..(764): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (788)..(788): n is a, c, t, g, unknown, or other
  misc_feature (814)..(814): n is a, c, t, g, unknown, or other
  misc_feature (825)..(825): n is a, c, t, g, unknown, or other
ggagctccccgcggtggcggccgctctagaactagtggatcccccgggctgcaggaattcgtctcacccctagaaaaaacgagacgaggtcgaggactctagcacgactccaactgccacgcgagctgcgagcggcgagcctcatcaatcgatcacacgcgacgcgagtacgagtacgagtacgagtatacggccacgagcagacgagctcctccgccaccagtgtcatcgcgcagcctcgcgctcgtccatggcgtccgtgtacacggcgccgcgcgccccgctcccgacggtggcgtcctcctcgtcatccgcgcggcaggtggatccgaaccctagtggaagccgcttcctcgccgggcggcgcctccgcgtcgtccgccgcctcgccggcgcggccccgtcgcggcgcgctccgtgggtctgctactccgcgcgtagccccgatgcggacgccggcgatgagcaacgccggcggggttgggacgcgatgctccacgacgccttccagggtgccgtgcgacggtggagcgagtacgtcagcaattactggcccctaccgccctctgtgaaggaggcggtacgggaagaggggggttgggagtctacgatgagaggaggaaannggggggggggtaaagaannnnnnnnnnggggggtngggggannaaaagaggaaaaggggaangggggaagggggggaaagggggnnnngggggnnnaanggggaggagaggggaggggnnnnggttggaaaaaaaaanaaggtgggaaaannngaggggggnggggttaaaaaaagaaaaaaaatggngagaaggtggntaataaaggggggggggggtagt

SEQ ID NO: 76331 - protein, 181 aa, Zea mays
  misc_feature: Ceres CLONE 1561045
  misc_feature (125)..(125): Xaa is any aa, unknown, or other
  misc_feature (126)..(126): Xaa is any aa, unknown, or other
  misc_feature (132)..(132): Xaa is any aa, unknown, or other
  misc_feature (133)..(133): Xaa is any aa, unknown, or other
  misc_feature (134)..(134): Xaa is any aa, unknown, or other
  misc_feature (135)..(135): Xaa is any aa, unknown, or other
  misc_feature (140)..(140): Xaa is any aa, unknown, or other
  misc_feature (146)..(146): Xaa is any aa, unknown, or other
  misc_feature (154)..(154): Xaa is any aa, unknown, or other
  misc_feature (155)..(155): Xaa is any aa, unknown, or other
  misc_feature (157)..(157): Xaa is any aa, unknown, or other
  misc_feature (158)..(158): Xaa is any aa, unknown, or other
  misc_feature (159)..(159): Xaa is any aa, unknown, or other
  misc_feature (166)..(166): Xaa is any aa, unknown, or other
  misc_feature (172)..(172): Xaa is any aa, unknown, or other
  misc_feature (176)..(176): Xaa is any aa, unknown, or other
  misc_feature (177)..(177): Xaa is any aa, unknown, or other
  misc_feature (180)..(180): Xaa is any aa, unknown, or other
MASVYTAPRAPLPTVASSSSSARQVDPNPSGSRFLAGRRLRVVRRLAGAAPSRRAPWVCYSARSPDADAGDEQRRRGWDAMLHDAFQGAVRRWSEYVSNYWPLPPSVKEAVREEGGWESTMRGGXXGGGKEXXXXGVGGXKEEKGXGGRGGKGXXGXXXGGEGRGXGWKKKXGGKXXGGXG

SEQ ID NO: 76332 - DNA, 832 bp, Zea mays
  misc_feature: Ceres CLONE 1561049
  misc_feature: Encodes the peptide sequence at SEQ ID NO. 76333
  misc_feature (490)..(490): n is a, c, t, g, unknown, or other
ctggagctccccgcggtggcggccgctctagaactagtggatcccccgggctgcaggaattcgtctcacccctagaaaaagctcgtgccagcaggccattcttctcgccttactccctcacagaacccagtaaaatattgccagtcccgccgtcgagatggccccacgccgcctgctcgtcctcgccgtcgtcgccctcgcggccaccgccgccgcggccaactccggcttcgcggactcgaacccgatccgccccgtcaccgaccgcgcggcctccgcgctcgagtccacggtcttcgccgcgctcggccgcacccgcgacgcgctccgcttcgcacgcttcgctgtgaggtacggcaagagctacgagagcgcggcggaggtccacaagcggttcaggatcttctccgagagtctccagctcgtccgctccaccaatcggaaaggcctctcctaccgcctcggcatcaaccgcttcgcggacatgagnctgggaggagttccgtgcgacccggctcggcgcagcccagaactgctccgccacgcttaccggcaacccacggatgcgcgccgccgccgttgcgctgccggagacgaagactggagggagattggggattgtgagcccagtgtaaaacaaggccactgtggatcatgctgggacttcagcactactggtgcacttgaggctgcatttacccgggaactgggaagcccatttcttcttcctgaacaaaaccttatggacgggggtttggctttcacaatttccggaggaaacggaggcctttcttcccaggcccttgaaaaaacaaaaacaaagggggggcct

SEQ ID NO: 76333 - protein, 225 aa, Zea mays
  misc_feature: Ceres CLONE 1561049
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
  misc_feature (111)..(111): Xaa is any aa, unknown, or other
MAPRRLLVLAVVALAATAAAANSGFADSNPIRPVTDRAASALESTVFAALGRTRDALRFARFAVRYGKSYESAAEVHKRFRIFSESLQLVRSTNRKGLSYRLGINRFADMXLGGVPCDPARRSPELLRHAYRQPTDARRRRCAAGDEDWREIGDCEPSVKQGHCGSCWDFSTTGALEAAFTRELGSPFLLPEQNLMDGGLAFTISGGNGGLSSQALEKTKTKGGP

SEQ ID NO: 76334 - DNA, 867 bp, Zea mays
  misc_feature: Ceres CLONE 1561050
  misc_feature: Translation starting site: 463
  misc_feature: SWISSPROT Homolog: EC 5.2.1.8 Peptidylprolyl isomerase
ctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaaggtccgttcccgtcccagatccgtccatggcttcgtccagatctgacctgtcctgacacaccctcgcccggatctgtccctccttcccttcacccctgcagatcatcctcgatcgggagacgcagaggtcccgcggcttcggcttcgtcaccttctccacggaggaggcgatgcggaacgccatcgagggcatgaacggcaaggagcgggacggccgcaacatcaccgtcaacgaggcccagtcccgcggcggcctgggatgcggccggcgtgggtacggtggtgggccgtggaggcggcggctacggcggtgggcgggcgccctgatggcggcggcggcttccgcggttggcggcggccggcttacgggggcagccggcggcttacgggtgggggggggcggccggctacggggggtgggaaaccgtggcgggggggctaccgggaaacccccgacggggaacctggagggaaccttgagccgggggggggccccgcgccgggccaaagtttatccggggttccccttacccgaggttttgttttccccccttagttccagggaggggtgttta

SEQ ID NO: 76335 - DNA, 895 bp, Zea mays
  misc_feature: Ceres CLONE 1561052
  misc_feature: Encodes the peptide sequence at SEQ ID NO. 76336
  misc_feature (582)..(582): n is a, c, t, g, unknown, or other
  misc_feature (783)..(783): n is a, c, t, g, unknown, or other
  misc_feature (810)..(810): n is a, c, t, g, unknown, or other
  misc_feature (818)..(818): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
ctccccgcggtggcggccgctctagaactagtggatcccccgggctgcaggaattcgtctcacccctagaaaaaattattcgacctcacctcaccttgccaccagccatggctgccgtgaccgccgcggccatctctctgtcctcctcctccacctcctcccctgcggctgctgccaaggccaaggcggcgtccccgtcgtcgtcgccatgcaggcacctccagttcctgtcggcagcgagcccgcggcggcggtggcgggccggcgcccgcgcggtacgggcgcaggtgtccaccaccgagaccgcggcggcggggccggccaagacgtccaagaagcacgacgaggggctggtcaccaacaagtacaagcccaaggagccgtacgtcgggaggtgcctgtccaacaccaggatcaccggcgacgacgcgccgggggagacgtggcacatggtcttcagcaccaaaggcgagatcccgaatagagaggggcagtcccatcggcatgatcacctgatggcgaaaacaaaaacgggcaacccgccacagcctcaggctgcacctcaatcgccagaatgcggcnttgagaaattttgggcgaacccgaagaacggaagcgctttagcctcgaacaaggtaagtctacaccaaaccaatcacggggggaaaattcccctaaaagaattttgatcaaaacctacggggggagaaacaagaaacccttggccccccaacgtataaaaaatccccggccccccgggtggacaaagcacaaacccacctnggccccaaaaaaaccccctaggtagcntacacagnggggcccccccagnnnaggaacccgcatttttccccaccgagcagacacgtcacccctgggaaaaaaaccacccaaa

SEQ ID NO: 76336 - protein, 193 aa, Zea mays
  misc_feature: Ceres CLONE 1561052
  misc_feature: SWISSPROT Homolog: EC 1.18.1.2 Ferredoxin--NADP(+) reductase
  misc_feature (159)..(159): Xaa is any aa, unknown, or other
MAAVTAAAISLSSSSTSSPAAAAKAKAASPSSSPCRHLQFLSAASPRRRWRAGARAVRAQVSTTETAAAGPAKTSKKHDEGLVTNKYKPKEPYVGRCLSNTRITGDDAPGETWHMVFSTKGEIPNREGQSHRHDHLMAKTKTGNPPQPQAAPQSPECGXEKFWANPKNGSALASNKVSLHQTNHGGKIPLKEF

SEQ ID NO: 76337 - DNA, 854 bp, Zea mays
  misc_feature: Ceres CLONE 1561053
  misc_feature: Translation starting site: 96
  misc_feature: SWISSPROT Homolog: EC 5.2.1.8 Peptidylprolyl isomerase
  misc_feature (393)..(393): n is a, c, t, g, unknown, or other
aaagctggagctccccgcggtggcggccgctctagaactagtggatcccccgggctgcaggaattcgtctcacccctagaaaaactagaaaaacaatggcggcggcggcggctgctgccacctccttcaccaccctcgccgtcgcgcgttcggcggggcagcggtcccttcttgcctccaaggccgcaccttcgccgctcctctccctccgtggcgcccgcatcccctcgcaggccgtctccttctccgggggccttgcggcgtcgccctctcacagccgcgcgcgcttcgctacatccgccagcgccgagcccaaggaagcagatcttcagtctaaaatcaccaataaggtgtattttgacataagcattgggaaccctgtggggaagaatngttgggaggattgtcatcggcttgtatggggatgatgttccacaaacagcagagaactttcgtgctctttgcactggagagaaagggtttggatacaagggatccagtttccaccgtgtcatcagcgactttatgatccaaggcggagattttgacaagggcaatggtaccggtgggaaaagcatatatggacgcactttcaaagatgaacacttcaaattggttcacactgggacatggagtggtcagcatggctaatgctggaccagacacccaacggcagccagttttttcatttgaattgtcaagacaccctgggttggatggaaagcatgttcgggtttggccaggtcgtggaaagggatgggatattggaaaggcctgatcgaagtcaccgggagacggaaagagggggaccggtccgcgaaaaagaaaggaattccttctggggggtgcgggag

SEQ ID NO: 76338 - DNA, 823 bp, Zea mays
  misc_feature: Ceres CLONE 1561055
  misc_feature: Encodes the peptide sequence at SEQ ID NO. 76339
  misc_feature (790)..(790): n is a, c, t, g, unknown, or other
ctccccgcggtggcggccgctctagaactagtggatcccccgggctgcaggaattcgtctcacccctagaaaaaaacctcatcctatccgtctcaccctcatccccgtttaatatataccgttccgccgttcgtcccctctggccctctctccatccccagcccacgaccctccgccaccagccatcgtctgcatcagatctcccgcccgtccgttacatcccagggcgacgcggccgcggccatgacgccatcctcagctctcgccctcgcgcaccacgccgcggtatccccgctcccgtcctccacgccgcggccctcccccaggtccagctctctgagcctgggcccgggctccgccgggctcgggccgcgccggctcgtcgcggcggcgcccccacgggcgttcttctcctcgtccccctaccagccgccccagccggaggggttctcgcagcaccgcgagtacggtctggtccccatggtcatcgagaccacctcccgcggggagcgcgcctacgacatcttctcgcgcctgctcaaggagcgcatcgtctgcatccacgggcccatcgccgacgacacggcctcgcttgtcgtcgcgcagctgctcttcctcgagtccgagaacccgctcaagcccgtccacctctacatcaactccccccgggggcgtcgtcaccgcggggctcgccatctacgacaccatgcagtacatcggctgccccgtcaccaccctctgcatcgggcagggcgccctcatgggctcgctcctcctcgccgctggggcncccgggtgagaggcccgcgcttcccaacgcaag

SEQ ID NO: 76339 - protein, 193 aa, Zea mays
  misc_feature: Ceres CLONE 1561055
  misc_feature (86)..(179): Pfam Name: CLP_protease Pfam Description: Clp protease
  misc_feature: SWISSPROT Homolog: EC 3.4.21.92 Endopeptidase Clp
  misc_feature (183)..(183): Xaa is any aa, unknown, or other
MTPSSALALAHHAAVSPLPSSTPRPSPRSSSLSLGPGSAGLGPRRLVAAAPPRAFFSSSPYQPPQPEGFSQHREYGLVPMVIETTSRGERAYDIFSRLLKERIVCIHGPIADDTASLVVAQLLFLESENPLKPVHLYINSPRGRRHRGARHLRHHAVHRLPRHHPLHRAGRPHGLAPPRRWGXRVRGPRFPTQ

SEQ ID NO: 76340 - DNA, 783 bp, Zea mays
  misc_feature: Ceres CLONE 1561056
  misc_feature: Encodes the peptide sequence at SEQ ID NO. 76341
ctccccgcggtggcggccgctctagaactagtggatcccccgggctgcaggaattcgtctcacccctagaaaaactctctgtgctctgtagggtttttgattttagccgccgccgctgctcttctcacatccctggagatgacgcctgctcctcgtcgatcgatacgatggccgtcttctccgacctcgacaccggctacggcctcaagtccctcgaggctcacctcgcctgcaaaacctatgtgtctggtgactccattgcttacgatgactttaaagtcttcgccagcatgtgccgtccaaccttggtgctgagtttcctaatgccgccacgctgggacgagaccgtctctgctggtgtaggctccagattccctggtaaggctgctggtgtaaatatgccatgcaggatcagctcctgcagcagctgctcctgcggatgatgctgaggatgatgatgaccttgatctttttggtgacgagactgaggaggacaagaaggcatctgatgatcgtgctgccgctgcctatggctcttcaaaaacagagaaagtggtgaatcctctgtccttatggatgtggaaccatgcgacgatgacactgatatcgatgagctggaggaggctgtccgcagtgtccagatggagggtctgacttggggagcatcaaagcttgtgcctgttgggatactgcatcaagaagatgactatcatgttgacatttggacgacggatcttttgtccctccgacaactcaaaatggaagaccagccttacgcaaggg

SEQ ID NO: 76341 - protein, 91 aa, Zea mays
  misc_feature: Ceres CLONE 1561056
MAVFSDLDTGYGLKSLEAHLACKTYVSGDSIAYDDFKVFASMCRPTLVLSFLMPPRWDETVSAGVGSRFPGKAAGVNMPCRISSCSSCSCG

SEQ ID NO: 76342 - DNA, 796 bp, Zea mays
  misc_feature: Ceres CLONE 1561060
  misc_feature: Encodes the peptide sequence at SEQ ID NO. 76343
  misc_feature (713)..(713): n is a, c, t, g, unknown, or other
  misc_feature (731)..(731): n is a, c, t, g, unknown, or other
ggagctccccgcggtggcggccgctctagaactagtggatcccccgggctgcaggaattcgtctcacccctagaaaaaaggacgacccaagcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatgtggaagctgcccatgttcggctgcaccgacgccacgcaggtgtacaaggagctgcaggaggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctggctgnttgatcggatcaccttcnttgcattggttcctctctctctctctccctgcctttttttccccttatctcatcatttcttttct

SEQ ID NO: 76343 - protein, 170 aa, Zea mays
  misc_feature: Ceres CLONE 1561060
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 76344 - DNA, 780 bp, Zea mays
  misc_feature: Ceres CLONE 1561061
  misc_feature: Encodes the peptide sequence at SEQ ID NO. 76345
  misc_feature (697)..(697): n is a, c, t, g, unknown, or other
ggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgcccaggtcgtgctcatgggcgccatccagggggaacccgcgtcgcccgggggcccgcctcgggaaaagtccntcaaacccgcttctaccccggggggggagattttgaacccgcttggggccttgggccaaaaaaacccctgaagggcctttccc

SEQ ID NO: 76345 - protein, 214 aa, Zea mays
  misc_feature: Ceres CLONE 1561061
  misc_feature (64)..(212): Pfam Name: Chloroa_b-bind Pfam Description: Chlorophyll A-B binding protein
  misc_feature (187)..(187): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACPGRAHGRHPGGTRVARGPASGKVXQTRFYPGGGDFEPAWGLGPKKPLKGLS

SEQ ID NO: 76346 - DNA, 737 bp, Zea mays
  misc_feature: Ceres CLONE 1561062
  misc_feature: Encodes the peptide sequence at SEQ ID NO. 76347
ctcaccgcggtggcggccgctctagaactagtggatcccccgggctgcaggaattcgtctcacccctagaaaaagagcctcaccaatcgccggccctccgcaggcagggaagggcggttgggcggccggccggccggagatctgattgctcttatcttctcccctcccgttcatccaatctgctgtcaccatatctgatctccctctccccctgattgcccgcggtggccattgcctcgctcgcgtctccttcgccgcgcttctaggaagattcggcggcgtgcccatttgtcggtcgtagccttaaccagttcttccccaactccgagctccttccttgcttgggagcagctgcacacacatccgcccaggatattagttagcgtggaggatggcgtccagggacttcctccgcgtcttcggcgccgttgagggggcgggccctccgggggacgcctgcgccggccagcccgacgacgacgagctcagcctcggcctctccctgtgcggacgctttcggaccgacggcaagcgcccgcgcctgggagcgcctcctccttcataggcctccggtttggctccgtcttcctctcttcaaaggcggacccgttcccccggccgagccccttttccgtttgttttagaaccaactttttttggccccccggagaccccgggggggggaagcccttgggggcccccaccccggaaaatttcattaaccccccccccccccc

SEQ ID NO: 76347 - protein, 57 aa, Zea mays
  misc_feature: Ceres CLONE 1561062
MASRDFLRVFGAVEGAGPPGDACAGQPDDDELSLGLSLCGRFRTDGKRPRLGAPPPS

SEQ ID NO: 76348 - DNA, 829 bp, Zea mays
  misc_feature: Ceres CLONE 1561065
  misc_feature: Encodes the peptide sequence at SEQ ID NO. 76349
ggagctccccgcggtggcggccgctctagaactagtggatcccccgggctgcaggaattcgtctcacccctagaaagaggttggttaactaggaacgcagccatggcaagcagtgccgtcatcgtccctgcctctccaagaaagtaagaacgcttgcttcttcattgtgtctggtcggccgtgctgattccaccagatccggtctaggttgacctgttatgtatctatgtgctcaggttggagggaaaggtggccgtgatcactggcggggcgagcgggataggggagcgcacggcccggctgttcgtggagcacggcgcccacgtcgtggtggccgacatccaggacgaggccggcgcgcgcgtctgcgccgatctcggcgcgggtgccgccagctacgtccactgcgacgtcaccagcgaggacgacgtcgcggccgcggtggaccacgccgtggcgacgttcggcgcgctggacatcatgttcaacaacgcgggcgtcagcgggccggcgtgctacagcgtccgggagagcggcaaggctgacttcgagcgcgtgctggccgtgaatctggtgggcccgttcctcggcaccaagcacgcggcgcggggtgatggtgcccttcgcgccgcggtggctgcatcatagggacgtcaagcgtggcggcggcagtgaactggcgtgtcgtcgtaacccgtacgcgtgcgcgaaagcgcgcgatggtgactctgacggagaacgcggctgcggagctcggccagcacggcattcgcgtgaactgcgtctccccccgcgggggtccgcacgcgcctgaccatgaggtacatgg

SEQ ID NO: 76349 - protein, 55 aa, Zea mays
  misc_feature: Ceres CLONE 1561065
  misc_feature: SWISSPROT Homolog: EC 1.1.1.288 Xanthoxin dehydrogenase
MFNNAGVSGPACYSVRESGKADFERVLAVNLVGPFLGTKHAARGDGALRAAVAAS

SEQ ID NO: 76350 - DNA, 799 bp, Zea mays
  misc_feature: Ceres CLONE 1561067
ctccccgcggtggcggccgctctagaactagtggatcccccgggctgcaggaattcgtctcacccctggaaaaaacagcgcggctgccggttacctctccttgtccccagcgaagcagatcatgcgcatctcacctgcaccccgcggcggctatggcctctgctgctgcctaccgctactatggggacggggaaggtggtttgcgtctccggcatcatcgaggtacatcgcggtcctggattgtcaggctcctactctgccgctgctacaccgtccgagcctccatacgagacaccgctgacaccgagatcacatggcgcctgactgcatatggatgctgctaaggcatagggctgcatcttattttagagctccgccctggctaaaagactggtttcctttccgatgaccgcaaatttccatagaattgcgcacgctgttaatttacatacctgggcctcccccccttttttttcccctaaggggaaggggattggccaagggcaagaagattttttttggacccccgcgccgccttttaaaggggaaacaacctccaaaaggtctccccccggggtcccacaaggccaaaagaaaaggggcctccccccttttttcaaaaaaagggcgggcctctttggtaaaacccccccccccccccttggggttttggcgccccaaaaccctcttcccaaagaggtgaaagaggggcaaaaagggggccccccccgtgaaaaggggtcccccgcattttttccccccgagaagacccaccaaaagggggttctccccccccccc

SEQ ID NO: 76351 - DNA, 817 bp, Zea mays
  misc_feature: Ceres CLONE 1561069
  misc_feature: Translation starting site: 150
ctccccgcggtggcggccgctctagaactagtggatcccccgggctgcaggaattcgtctcacccctagaaaaaattcccaagcaaacagccaaacacacgcgaagaaaaggagatagagtacaggttacagagaggcagagagcaaagatgtgtggtggtgcgatcctcgccgagctcatcccgactacgccggcccgccgcggcggcgcggcgtggcccgccggcaagtgcaagcggcggaaggcggacgacttcgaggccgcgttccgggagttcgacgaggactcccgaggaggaggaggaggagagagggggggggggggtggataccaagcccgccttagtcgtccgcgcctcgtccgcggcgacgcatcccagggcgcgccacgagtatgctgaccccgcaccgggcgcccgaccagcagtacaggggcgtccagcgcctcccgtggggcaagtgggccgccgagatcctcgaccccgtctagggcgtactcgtctggctcggcaccttcccctccgccgaggccgccgcgctcacctacgacctcgccgggtccgccacatacgggggggcacgggggcccaaactgagaacccccccccccctccccccccccccctttggattaactggggccccccgggggggtgggaaaaagggccccgccccccgcgggggggggaaagcggaagattgagggcccccccggtgggattaaaagaagagaagagcccgcccccccggggtggtgttccgaggggggcgcgcccgcgcaccattttgtacgatagagggatacgggcgtggtgat

SEQ ID NO: 76352 - DNA, 852 bp, Zea mays
  misc_feature: Ceres CLONE 1561070
  misc_feature: Encodes the peptide sequence at SEQ ID NO. 76353
  misc_feature (323)..(323): n is a, c, t, g, unknown, or other
  misc_feature (334)..(334): n is a, c, t, g, unknown, or other
ctccccgcggtggcggccgctctagaactagtggatcccccgggctgcaggaattcgtctcacccctagaaaaagtaaactaaccaccaaagccgaagaaggcggcttgccctgcccgccgccttggtgccgcgcgcgccatggccaagagcaagtcgtccgccaaggccggccccccgctcctcggcaagtacgagctcggccacctcctcggccggggcaacttcgccaaggtataccacgcgcgctgcctcggcggaggcgaccccgtggccgtgaaggtgctggacaaggccgggctggccgccacgggcatggcgtcncggctcctgcncgaggtgtcccgcatgcgcccgctgagccaccccacgtgctccgcctccacaagtgctggcgaccgctcccaggtgtacctcctggatggacctggccccggggcggggaactcccgttcccgcttgggtttcccttgctttccccaaggttcccccaagacacccgggccgggccctggtttcctcccaattgggggttcggggctctatttaaaagccaccggggggggggtggtttccccccccgactttgaaaacccccaaaaaattgtctgcttggggcccccaaaggggcaccccccaaggggggtccaaattttggggcctccgcgggggcccccccgaatattggtccccccaaaaaaaagggggcccccttcaacaaaggggggggggaaccccccgggtttttctggggccccccaagggggttctcccccgccgaagggggctcttaaaaaagcccccaaaggggaggaacccccggggctctcccgggggaaatttcctcctctct

SEQ ID NO: 76353 - protein, 237 aa, Zea mays
  misc_feature: Ceres CLONE 1561070
  misc_feature: SWISSPROT Homolog: EC 2.7.11.1 Non-specific serine/threonine protein kinase
  misc_feature (65)..(65): Xaa is any aa, unknown, or other
MAKSKSSAKAGPPLLGKYELGHLLGRGNFAKVYHARCLGGGDPVAVKVLDKAGLAATGMASRLLXEVSRMRPLSHPTCSASTSAGDRSQVYLLDGPGPGAGNSRSRLGFPCFPQGSPKTPGPGPGFLPIGGSGLYLKATGGGVVSPPDFENPQKIVCLGPPKGHPPRGVQILGPPRGPPRILVPPKKRGPPSTKGGGNPPGFSGAPQGGSPPPKGALKKAPKGEEPPGLSRGKFPPL

SEQ ID NO: 76354 - DNA, 797 bp, Zea mays
  misc_feature: Ceres CLONE 1561071
  misc_feature: Encodes the peptide sequence at SEQ ID NO. 76355
  misc_feature (665)..(665): n is a, c, t, g, unknown, or other
  misc_feature (751)..(751): n is a, c, t, g, unknown, or other
ctggagctccccgcggtggcggccgctctagaactagtggatcccccgggctgcaggaattcgtctcacccctagaaaaacctccacttcacgcccctccgccgccgccgcgtctcctctgcaggtaagaaggtaaggaagagggcgaaatggtgaagcacaacaacgttatccccaacgggcacttcaagaagcactggcagaactatgtcaagacatggttcaaccagcccgcccgcaagcagaggcgccgcatcgctcgtcaaaagaaggctgtgaagatattcccacgcccaactgctggccctcttcgccccattgtgcaatgccagactctcaagtacaacatgaagtcgagggctgggagaggatttacccttgaggagctgaaggctgccggcattccaaagaagcttgccccaaccattggcatttctgtggatcaccgccgcaagaacaaatctctcgagggactgcaggccaatgtccagaggcttaagacgtacaaggccaagctggttatcttcccaaggcgtgctcgcaaggccaatgccggcgactctactccggaggagcttgccacggccacccaggtccagggtgactacatgcctattactcgtggtgagaagcgctcagtcgaggttgtgaaggttactgatgangatgaagtcgtttgcggcctacgggcagctcccgtcttgagcggatgaaccagaaacacctttggtgcccgccaaaaaaaaaggcngctgaaaggcagaaaaaggattgacagaaatgaaagcccgggtttc

SEQ ID NO: 76355 - protein, 187 aa, Zea mays
  misc_feature: Ceres CLONE 1561071
  misc_feature (6)..(182): Pfam Name: Ribosomal_L13e Pfam Description: Ribosomal protein L13e
  misc_feature (172)..(172): Xaa is any aa, unknown, or other
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRLKTYKAKLVIFPRRARKANAGDSTPEELATATQVQGDYMPITRGEKRSVEVVKVTDXDEVVCGLRAAPVLSG

SEQ ID NO: 76356 - DNA, 766 bp, Zea mays
  misc_feature: Ceres CLONE 1561072
  misc_feature: Translation starting site: 246
  misc_feature: SWISSPROT Homolog: EC 1.14.99.33 Delta(12)-fatty acid dehydrogenase
ggagctccccgcggtggcggccgctctagaactagtggatcccccgggctgcaggaattcgtctcacccctagaaaaaaggcggccaggctccctcctcctccctgcaaatcctgcagacaccaccgctcgtttttctctccgggacaggagaaaaggggagagagaggtgaggcgcggtgtccgcccgatctgctctgccccgacgcagctgttacgacctcctcagtctcagtcaggagcaagatgggtgccggcggcaggatgaccgagaaggagcgggagaagcaggagcagctcgcccgagctaccggtggcgccgcgatgcagcggtcgccggtggagaagcctccgttcactctgggtcagatcaagaaggccatcccgccacactgcttcgagcgctcggtgctcaagtccttctcgtacgtggtccacgacctggtgatcgccgcggcgctcctctacttcgcgctggccatcataccggcgctcccaagcccgctcggctacgcggcctggccgctgtactggatcgcgcaggggtgcgtgtgcaccgggcgtgtgggtcatcgcgcacgagtgcggccaccacgccttctcggactactcgctccctggacgacgtggtcgggcctggtgctgcactcgtcgctcatggtgcccctacttcctcgtgaaagtacagcccaccggggccaccactcccaacactggggtccctggagcgccaaccaaggtggttccgtgcccagaagaaaggaggg

SEQ ID NO: 76357 - DNA, 902 bp, Zea mays
  misc_feature: Ceres CLONE 1561076
  misc_feature: Encodes the peptide sequence at SEQ ID NO. 76358
  misc_feature (371)..(371): n is a, c, t, g, unknown, or other
  misc_feature (396)..(396): n is a, c, t, g, unknown, or other
  misc_feature (468)..(468): n is a, c, t, g, unknown, or other
  misc_feature (547)..(547): n is a, c, t, g, unknown, or other
  misc_feature (565)..(565): n is a, c, t, g, unknown, or other
  misc_feature (566)..(566): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (629)..(629): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (731)..(731): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (773)..(773): n is a, c, t, g, unknown, or other
  misc_feature (774)..(774): n is a, c, t, g, unknown, or other
  misc_feature (776)..(776): n is a, c, t, g, unknown, or other
  misc_feature (792)..(792): n is a, c, t, g, unknown, or other
  misc_feature (793)..(793): n is a, c, t, g, unknown, or other
ggagctccccgcggtggcggccgctctagaactagtggatcccccgggctgcaggaattcgtctcacccctagaaaaattgctctcttcccgtcgcgctttctcctcgtgcggctactgggtaaccgccgccgctgccgccctacgccaggttctcaggtcattgtcagtccccttacttcgccggctcattcggcggcgacgagcaccagaaatcctagctgctttgagtatggaggcgctgtttgggtgcaacaaacatggcggggacaaggccgctgatttggcctccgttttaatcgtgcaggctgccttggaggtgccaaggttacttgggctccttgccatgattcttcataatgaaatctttancatctggtggagatcagaatttganttaataggattctgagcaaaaacaaaaatgcaactgatttcgagaacaagggatgatggagagtctgatgantgataatgatgggaggagggagaacccatgagggatgctgaaaaccaagaagatgattggtggtggaattgaagggtcncgatgaacatgggaatgnntggtagnnnnnnnnnnnnnnnnaagatgacgacgacaattgatacgatctgcacccacgtggnaagagagtgcacatgatgatgtgagaagaattaaaannnnnnnnngagatatacacagttttttttttgggggggggagtgnnnnttggggaattttatttngggggggggaaaannnngnnnngggggggggggttttttttnngnttttttttgtcccccnnccccccctccttaaaaaaagaggaaaatagaaaaagggggcggggaatttttgggggggggcgggggggcttaaactgccggggaaatgtccccccggtttcccccccc

SEQ ID NO: 76358 - protein, 59 aa, Zea mays
  misc_feature: Ceres CLONE 1561076
  misc_feature (47)..(47): Xaa is any aa, unknown, or other
  misc_feature (55)..(55): Xaa is any aa, unknown, or other
MEALFGCNKHGGDKAADLASVLIVQAALEVPRLLGLLAMILHNEIFXIWWRSEFXLIGF

SEQ ID NO: 76359 - DNA, 806 bp, Zea mays
  misc_feature: Ceres CLONE 1561077
  misc_feature: Encodes the peptide sequence at SEQ ID NO. 76360
  misc_feature (449)..(449): n is a, c, t, g, unknown, or other
  misc_feature (494)..(494): n is a, c, t, g, unknown, or other
  misc_feature (495)..(495): n is a, c, t, g, unknown, or other
  misc_feature (515)..(515): n is a, c, t, g, unknown, or other
ggagctccccgcggtggcggccgctctagaactagtggatcccccgggctgcaggaattcgtctcacccctagaaaaatcccccaagcaaagccggtcggggcaaacggaagcgaaacagggcccgtctcttccaccactccgcagaggcgcagactaccgtctcatcctactactctagcccagtctcacgatccagcactcagtcactagcgcttgtcgtcgccagtacaacaacggcatgggtgagggtgacgacgaccggcgggacgagttgttgggcgcggggcgggaccatgaaccagagccggcggacgcggaggaggccaagaaacccgcacccggcgaagcggaggccggcaacggcgccggcgcggaggcggcgacctgcgactactgcgggaccgcggcggcggcggtctactgccgcgccgactcccgcaggctctnggctgcgtgcgaccgcctcgtgcacggcgccaacgggggtctgcnntccgcaagccccgcgcccgntctgggccggctgctgcgccgccgggggcggtctttcggcggggccttggactttcggcttttctcggctccaactggcgaattcgggaagggaccggggatgggcgggtgacccgccgggtccaagaaacggttgtggccggggaaaaccccttttcccgggtgggcccctccgggggaaggggaaacttgggcgggggggtcccttgggggggggcccccctctttttgaaaaaaacccggggcccgcccaaaaaaatggggggcccccggggggggaaaaacaacccg

SEQ ID NO: 76360 - protein, 128 aa, Zea mays
  misc_feature: Ceres CLONE 1561077
  misc_feature (70)..(70): Xaa is any aa, unknown, or other
  misc_feature (85)..(85): Xaa is any aa, unknown, or other
  misc_feature (92)..(92): Xaa is any aa, unknown, or other
MGEGDDDRRDELLGAGRDHEPEPADAEEAKKPAPGEAEAGNGAGAEAATCDYCGTAAAAVYCRADSRRLXAACDRLVHGANGGLXSASPAPXLGRLLRRRGRSFGGALDFRLFSAPTGEFGKGPGMGG

SEQ ID NO: 76361 - DNA, 707 bp, Zea mays
  misc_feature: Ceres CLONE 1561079
  misc_feature (217)..(217): n is a, c, t, g, unknown, or other
  misc_feature (278)..(278): n is a, c, t, g, unknown, or other
  misc_feature (290)..(290): n is a, c, t, g, unknown, or other
  misc_feature (291)..(291): n is a, c, t, g, unknown, or other
ctggagctccccgcggtggcggccgctctagaactagtggatcccccgggctgcaggaattcgtctcacccctagaaaaaaaacctcagaaaaaaattcgaacgacggagcacgacgcacgcagagccgcagagatccgtcacactgcaagttttgaaaactgaactgtaagatggcatcagcagagctttcccgtgaggaaaatgtgtacatggcngaagctctgccgagcaggcagagaggtacgaggaaatggttgagttcatggagaaggtagncgaaaactgttnngactcgggaggaggctcacttgtgggagggagcggcaaaccctcccctggtcttggtttgcaatacaaaagaaaacggtcatttgggaggcccccgcccgtgggccttcaaggggggggaattcatttttcccttcccattcgaaggaaaaaaaagggagggaagggcccccaaggggcatttggggggaccccgggttaaacaccccccttccaagggggggaacttccccccccggggggggccaaaaaaatttttaaaaaaaacctgggggggccccccccccccacaaaaaaaaaatcttttgggggggggtgtgtgggggcggcctccccccctcccacaagaaggagttttttttctctcgcgaaaaataaatttccctccccccccccccccttttgtttggggggggt

SEQ ID NO: 76362 - DNA, 826 bp, Zea mays
  misc_feature: Ceres CLONE 1561080
  misc_feature: Encodes the peptide sequence at SEQ ID NO. 76363
ggagctccccgcggtggcggccgctctagaactagtggatcccccgggctgcaggaattcgtctcacccctagaaaaaagacccccgcccacgaccacacgcaggcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccgtccggccggctccatacccgcggctaccgctgccgtcgtcgtcatcctcgtcaggctacaggcactccaagtccgtctccgtgaagacgctcgccctgttcggcaaatccaaggtcaagaccgcgccggcgaagaaggctgctgcgcccaagcccaagccgaaggttgaggatggtatcttcggcacgtccggcgggatcggtttcaccaaggagaacgagctgttcgtcggccgcgttgccatgcttggctttgccgcatcgctacttggagaggccattaccgggaagggcatccttgcccagctgaacctcgagacgggcatccccatctacgatgcggagcctctccctcctgttcttcatcctcttcaccctccttggcgccatcggcgctctccgggaccgcgggccgctttcttcgacgaaggaggtcacccggcctccaacaaggcccgtcttccaacctgggcaagggggcttccgcggcaa

SEQ ID NO: 76363 - protein, 187 aa, Zea mays
  misc_feature: Ceres CLONE 1561080
MAAQSMLMSTSVNGGRALPSLQAVRPAPYPRLPLPSSSSSSGYRHSKSVSVKTLALFGKSKVKTAPAKKAAAPKPKPKVEDGIFGTSGGIGFTKENELFVGRVAMLGFAASLLGEAITGKGILAQLNLETGIPIYDAEPLPPVLHPLHPPWRHRRSPGPRAAFFDEGGHPASNKARLPTWARGLPRQ

SEQ ID NO: 76364 - DNA, 830 bp, Zea mays
  misc_feature: Ceres CLONE 1561082
  misc_feature: Encodes the peptide sequence at SEQ ID NO. 76365
ctccccgcggtggcggccgctctagaactagtggatcccccgggctgcaggaattcgtctcacccctagaaaaaatcctccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacgggccactaccgccccgccaactgggccgccgccgtcgaccccgccgacctccgcgccgctcacctcgcccgcacctacgcccgggcctgagcggccccggctcccttcaccctgctccgcctcgtctcgtatgacatacgcgcaccgtacgtaccagggtgagacgaggtgaggggtcgggggttcgtgtggcgaacggcgtgttgagccacgcgcgcgtgcgcccgcgctctgtgacgcccggaacgttcttgggagagcgcgagcaaggtcttggctcttctcggggccgggcgctgtgccctgggaagagatgtgacgctggatccttttggggccaaccaacgggaaaaaacgggcctgtggcccccctcccccccgggggtgggcgggagggccggcttccttgggcccctccattatacagaggtcaccccccc

SEQ ID NO: 76365 - protein, 95 aa, Zea mays; identical to SEQ ID NO: 58232
  misc_feature: Ceres CLONE 1561082
  misc_feature (1)..(89): Pfam Name: LEA_3 Pfam Description: Late embryogenesis abundant protein

SEQ ID NO: 76366 - DNA, 1041 bp, Zea mays
  misc_feature: Ceres CLONE 1561086
  misc_feature (69)..(69): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (103)..(103): n is a, c, t, g, unknown, or other
  misc_feature (167)..(167): n is a, c, t, g, unknown, or other
  misc_feature (275)..(275): n is a, c, t, g, unknown, or other
ttggtgggaggtgagagggggcagatgggaggccgaggccggtgggttgtggggggggcgaaaaaaggngaagaaggagatccccnnnnnnnggggcgctctnggaaaaaaatgggactccaccggcggttggcgggccggctctagaactagtggatcccccgggnctgcaggaaattcgtctcacccctagaaaaaaacgatcacacaccactccacagcagtagcaagagggatagagcaaggccacacacacacacacaccactagtaggnctagcctagccttttagtcgtcgaggaggagcaagaagggcgcgcacgcaagcaggcaagcaagaagagagccgatcgaccgagagctagcacgcgaagggcaagtcttccaaaaagatggtggcggcagctctgctggccctggacctggcccgggtcgaacgcccaaagcaaagaaacatcaagaccccgaacgaccggagaaaaaaaggactaacgccgggggggggcaaaccccaaaaaattacccccacaccttttaagaaaggcaatacagggaggggaacaaccccttcccccaggggggattaaaaaggtggagctctcccccccgggggggggaaaaaaaattttccctcgggggagaaaccaaaagaatgtttccccggggggaggtgtcccaggaaaaaaggtcacgacaggggagaataggccggagtacggggataaaacatgaaaaaacactggggggtgttaaatcaacgacttttatacatatgtaggggtataattccatcacgccaaggccgaaaatgtgacccacaaaatagtgagttataggtggaaggagggaggaagaaaatctccccacatttgggaagggtgataaaaaggagaaatggagtagtgggagaatgatctaaaagtagaaaatatgaagagaacaagaagccacatatacaaaccagcggtgcctatacaaaggtccaccacccaccttacagagtggaatacaaaaaatgtaatagaaaaccaatgttctaaa

SEQ ID NO: 76367 - DNA, 895 bp, Zea mays
  misc_feature: Ceres CLONE 1561087
  misc_feature (582)..(582): n is a, c, t, g, unknown, or other
  misc_feature (623)..(623): n is a, c, t, g, unknown, or other
  misc_feature (660)..(660): n is a, c, t, g, unknown, or other
  misc_feature (810)..(810): n is a, c, t, g, unknown, or other
tccccgcggtggcggccgctctagactagtggatccccgcggctgcaggaattcgtctcacccctagaaaacctgcgcctgccctcccctcctgcagcgcccgtggcctccctttccccttccctccctccctctccccgcgggccgccagaggcaatttcgccctcgattcgaccccgattcgtccgcccgcgaccgggattccctccgccaagcgcggatctgaacgctgcgctccgggtcgccggtcgtatccgccatgaagggggcccaatccaagggcgccgcggaggtcgatgcctagctggcggtgaagagcaggggggcggagaagcccgccaccggcacgaaggggagggggggcaaggaccccaactagccctaagagggccccccgcgcgtgtctgcgtgttcatgggaggaatttcgcagcggagttccgggagaagaaccctaagaaaaggtccggtcgctggcggtgggggagaactgctgcgggacccggggaaaatcccttgagcgaggccggaaaaaggctcccctgaggtagccccaggggtaagccagccccggggcccggantacaaacacggggcgatcgccgggccgactaaccagggggngagaaacgccgggggccctaaataggccgccggcgcnagggaggaaaaaaggggggaccacggacggatgggacggcggcgcgggttcccagcgtggggaggcccacgggccggtggcgcgggacgggcaggggcggggcgggggcgggcgcatggacgaaggaaccgcgcacttggggggggtgtngttcctcggcgggcacattggtgcccgcaggctttctcacgcgcacatgtggaggacgcgggtagcgcttcgaggtcccgcggga

SEQ ID NO: 76368 - DNA, 839 bp, Zea mays
  misc_feature: Ceres CLONE 1561088
  misc_feature: Encodes the peptide sequence at SEQ ID NO. 76369
ctccccgcggtggcggccgctctagaactagtggatcccccgggctgcaggaattcgtctcacccctagaaaaaaaaaaaacttcctcctcccacctcggcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtgtttcgcatccgtggtatcaatgccatgcaccccaagacccgcaagatcttgcagctcctgcgattgaggcagatcttcaacggtgtcttcctcaaggttaacaaggcaaccattaacatgctgcgcagggtggagccatatgttgcgtacggataccccaacctgaagagcgttaggggagttgatctacaagagaggttacgggaagctgaacaagcagaggattccacttagcaacaacagtgtcatcgaggagggcctcgggaagcacaatatcatctgcattgaggaccttgtccacgagatcatgacggtgggcccgcacttcaaggaggcaacaacttcctctggccgttcaagctgaaggcacccctcggcggcctcaagaagagaggaaccactacgtagagggcggtgaacgcggaaacc

SEQ ID NO: 76369 - protein, 166 aa, Zea mays
  misc_feature: Ceres CLONE 1561088
  misc_feature (14)..(84): Pfam Name: Ribosomal_L30_N Pfam Description: Ribosomal L30 N-terminal domain
  misc_feature (86)..(137): Pfam Name: Ribosomal_L30 Pfam Description: Ribosomal protein L30p/L7e
MSAAEAKAAAVPESVLRKRKREEQWAADKKEKALADRKKALESRKIIFARAKQYAEEYHAQEKELVQLKREARLKGGFYVSPEAKLLFVFRIRGINAMHPKTRKILQLLRLRQIFNGVFLKVNKATINMLRRVEPYVAYGYPNLKSVRGVDLQERLREAEQAEDST

SEQ ID NO: 76370 - DNA, 788 bp, Zea mays
  misc_feature: Ceres CLONE 1561089
  misc_feature: Encodes the peptide sequence at SEQ ID NO. 76371
ctggagctccccgcggtggcggccgctctagaactagtggatcccccgggctgcaggaattcgtctcacccctagaaaaatccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttgcgggtcgaagtgtttaagcagactattgctggaaatatccttgtgggagagttactgcgccttctctaacaggggggagtgttggttcatgccccatacatcccgttgaagagcgtgacgagcttctcagagctccatccaagttcctcgttgtcgcaggaactgtgaa

SEQ ID NO: 76371 - protein, 138 aa, Zea mays
  misc_feature: Ceres CLONE 1561089
  misc_feature (3)..(138): Pfam Name: eIF-6 Pfam Description: eIF-6 family
MATRIQFENNCEIGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACNDHVALTHPDLDKETEEFIADVLAGRSV

SEQ ID NO: 76372 - DNA, 689 bp, Zea mays
  misc_feature: Ceres CLONE 1561090
  misc_feature: Encodes the peptide sequence at SEQ ID NO. 76373
ggagctccccgcggtggcggccgctctagaactagtggatcccccgggctgcaggaattcgtctcacccctagaaaaaagcgaaggcatccatccatccatagatccctcacctccctcactcgtgaagaaccagagaacccacccactgacccaccctcctccacctccaaggccatgggcgacgccgtggagcacctcaagagcgggttccagaagttcaagaccgaggtgtatgacaagaagccggagctgttcgagcctctcaaggccggccaggcccccaagtacatggtgttcgcctgctccgactcccgcgtgtgcccgtcggtgaccctgggcctgcagcccggcgaagccttcaccgtgcggcaacatcgccgccattggttcccggccttccaaaaaagaccaataccccgggatcgggtccccttcaaaacccccgggggccccccaaagggggaggcctctgggggttttggggaaaaattttttgggggggggatcggggggggtgtttccccccccagggaggggggccccccaaaaattttccctttttttaaaaaaaaaggggggaaaaaaaaggggttccccccccccccgggggttgggggggaaaaaaaaaaaaaccccacccccccgggggccctttttataaaaaaaaaggtggccccccccccgggg

SEQ ID NO: 76373 - protein, 171 aa, Zea mays
  misc_feature: Ceres CLONE 1561090
  misc_feature: SWISSPROT Homolog: EC 4.2.1.1 Carbonate dehydratase
MGDAVEHLKSGFQKFKTEVYDKKPELFEPLKAGQAPKYMVFACSDSRVCPSVTLGLQPGEAFTVRQHRRHWFPAFQKRPIPRDRVPFKTPGGPPKGEASGGFGEKFFGGGIGGGVSPPREGGPPKIFPFFKKKGGKKKGFPPPPGVGGEKKKNPTPPGALFIKKKVAPPPG

SEQ ID NO: 76374 - DNA, 861 bp, Zea mays
  misc_feature: Ceres CLONE 1561094
  misc_feature: Encodes the peptide sequence at SEQ ID NO. 76375
  misc_feature (700)..(700): n is a, c, t, g, unknown, or other
  misc_feature (843)..(843): n is a, c, t, g, unknown, or other
ctccccgcggtggcggccgctctagaactagtggatcccccgggctgcaggaattcgtctcacccctagaaaaagacactccacactccaagcgagctagagctagagctatagagatcactctccttctccgcgtgaggtagtgacgcccagccatggcaacaatggcactgcgcgccgtggcaacggcgctgctggtggtggcggcgtccgtgtgcggcgcgtcggcgtcgacgctggtgctgtacaaccggtgcggggagacggtgtggccgggcatccagccgagcgccgggaaggaggtgctggcgcgcggcgggctgcagctggcgccggggcggtcggcgtcggtgcggctccccgcggggtggtcggggcgcgtgtgggggcggcaggggtgctcgttcgacgcggcggggcgcgggcggtgcgccacgggcgaatgcggcggcgcgctctactgcggcggcgccgggggcgcgccgccggccacgctggcggagatcaccctgggcaccgcgtcgtcccaggacttctacgacgtgagccttgtggacgggtacaacatccccatcgcgatgacgccggtgcacgggtcgggcgcccggtgcgcggcggccgggtgcgtgagcgacctggaccgcgtgtgccccgcgggggctcgccgtccgcggcgagggcccccttggtggggtggccncagcgcctggcgccgcctacgggcgcgccgcagtactgcttgcacggggcaagtttcgggaaccccccagcagtgcaagcccacgggcctactcgcggcctcttttcaagtcgggcgtgcccccaaggctttactccctacgncctaccgaacgaacccgt

SEQ ID NO: 76375 - protein, 235 aa, Zea mays
  misc_feature: Ceres CLONE 1561094
  misc_feature (32)..(235): Pfam Name: Thaumatin Pfam Description: Thaumatin family
  misc_feature (182)..(182): Xaa is any aa, unknown, or other
  misc_feature (230)..(230): Xaa is any aa, unknown, or other
MATMALRAVATALLVVAASVCGASASTLVLYNRCGETVWPGIQPSAGKEVLARGGLQLAPGRSASVRLPAGWSGRVWGRQGCSFDAAGRGRCATGECGGALYCGGAGGAPPATLAEITLGTASSQDFYDVSLVDGYNIPIAMTPVHGSGARCAAAGCVSDLDRVCPAGARRPRRGPPWWGGXSAWRRLRARRSTACTGQVSGTPQQCKPTGLLAASFQVGRAPKALLPTXYRTNP

SEQ ID NO: 76376 - DNA, 801 bp, Zea mays
  misc_feature: Ceres CLONE 1561095
  misc_feature: Encodes the peptide sequence at SEQ ID NO. 76377
ctggagctccccgcggtggcggccgctctagaactagtggatcccccgggctgcaggaattcgtctcacccctagaaaaaaacaaatcactcgctacaagcgagcgagggagagatgtctctccagtgcgtggcgcccccggtccgagcactcgccgtgctaccagcgccagccccccctcgccgccggacaaaccatgtgtccctataccttccgagccggcggccagggctcgccgtcgccccggtccgtgcggcggactcgtcctctccgcccaccgtgcccgcctccgcggccggcaaggctgtcgtcccggacgacgagttctccctcgccaaggtctctttcggtgtgatcgggctggggcttgggctctcgctcctgtcgtacggattcgggtcgtatttcaacctgcttcctggttcggagtggtcagctttgctgctaacctacgggtttcctctcacaatcatcggcatggccttgaagtatgcagaactgaaaccagtaccctgcataacctacgctgatgcctttgctctaagagaaaagtgtgctacccctattctgaagcaggtcaggagtgatgttacacgttttagatatggtgatgaacaacacttggatgaagcactgcagaagatctttcaatatggttttgggggtgggggcatttcctagacgtaattgcacctatattacaaaagattccaggaggaaagtaactgacgatggggaaatacaagtttaggaaccccgaatttccaagcccaaagcattttggagcttatctgatttttg

SEQ ID NO: 76377 - protein, 188 aa, Zea mays
  misc_feature: Ceres CLONE 1561095
MSLQCVAPPVRALAVLPAPAPPRRRTNHVSLYLPSRRPGLAVAPVRAADSSSPPTVPASAAGKAVVPDDEFSLAKVSFGVIGLGLGLSLLSYGFGSYFNLLPGSEWSALLLTYGFPLTIIGMALKYAELKPVPCITYADAFALREKCATPILKQVRSDVTRFRYGDEQHLDEALQKIFQYGFGGGGIS

SEQ ID NO: 76378 - DNA, 755 bp, Zea mays
  misc_feature: Ceres CLONE 1561096
  misc_feature: Encodes the peptide sequence at SEQ ID NO. 76379
  misc_feature (419)..(419): n is a, c, t, g, unknown, or other
ggagctcaccgcggtggcggccgctctagaactagtggatcccccgggctgcaggaattcgtctcacccctagaaaaaattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccnttttgtcgatgtcctcaaggagggaggcgtccctccctggcatcaaggtcgacaagggcacccattggagggttgtttggcaccccaacaaggagaaccacccccccaggggccccccaatgaacccccggggaaaaggccttgcccttaaaataattacaaaagaggcgggggggccccccctttttttcaaaaggaggggggggggggggggtttcccccaaaagaaaggggggggcccccccaaaaaagagagcgcccccaaaacaattttggtgcgcctttttttccccccccaaaaaatagtccccccccccgggggggcgttgtggtgcc

SEQ ID NO: 76379 - protein, 128 aa, Zea mays
  misc_feature: Ceres CLONE 1561096
  misc_feature (11)..(128): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYADELIKNAAYIGTPGKGILAADESTGTIGKRLSSINVENVEENRRALRELLFCCPGALQYISGVILFEETLYQKTKDGKPFCRCPQGGRRPSLASRSTRAPIGGLFGTPTRRTTPPGAPQ

SEQ ID NO: 76380 - DNA, 1039 bp, Zea mays
  misc_feature: Ceres CLONE 1561098
  misc_feature: Encodes the peptide sequence at SEQ ID NO. 76381
  misc_feature (794)..(794): n is a, c, t, g, unknown, or other
ggagctccccgcggtggcggccgctctagaactagtggatcccccgggctgcaggaattcgtctcacccctagaaaaatctccagcggcttcttccaaagctccaactacgacgagaaccgccactcctcgaaatctccaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtctgccgcgtcgccgccaagctcgagtccatggagccctgctccagcgtcaaggataggattggctacagcatgatcacggacgcagaggagggggggggggaggactccatggcgtgagtgttcctcattggaccaactagcggcaaacccaggcattggcactggccctttatggggtgctgccagagggctaaaaaactttacgctcgccaatggccgtgccttcccgtgagcaatgggggagggagggatcatcatccggaagcgcttttttggggcggctgaaggtgtgcgccactttcccggacccccacacctccaggggagaatttaaaaaggggggccctgttcgtacgaaaacgcccggcaaagcaaagtattgagtggtggtgggggtgatcgctcgctatgagttcaggtaggaatgtgcctctgcaagagaatggggtggagaagagtcgtgggggggcccactgcagatggaagattgttcgctattatgagtgaggatcttatcggngggagcccggcaagagtccgtgggataaaaccggttgcggaggctgcgaggataagtagtgggccagcatctcataagcgctcatcgggtagccacggggtcgtagctcgaacgcctgactccgctcgcgcgcgggcctggagtgatcgcacgcaatacccctattacaaatggcctactgccctgtttagttggttgagagacgctctggtccgggtggtgcgaggccagctcgtgggacgcat

SEQ ID NO: 76381 - protein, 70 aa, Zea mays
  misc_feature: Ceres CLONE 1561098
  misc_feature: SWISSPROT Homolog: EC 2.5.1.47 Cysteine synthase
MGEASPSIAKDVTELIGNTPLVYLNKVTDGCVCRVAAKLESMEPCSSVKDRIGYSMITDAEEGGGEDSMA

SEQ ID NO: 76382 - DNA, 851 bp, Zea mays
  misc_feature: Ceres CLONE 1561100
  misc_feature: Translation starting site: 201
  misc_feature: SWISSPROT Homolog: EC 2.5.1.18 Glutathione transferase
  misc_feature (607)..(607): n is a, c, t, g, unknown, or other
  misc_feature (787)..(787): n is a, c, t, g, unknown, or other
tggagctccccgcggtggcggccgctctagaactagtggatcccccgggctgcaggaattcgtctcacccctagaaaaacgtaatagaagccagaaaaaactcaccgggaagaaggaaccagaagctaaccggcacgtcgtgaagctaaccgggattccgggaagcagagacgtccgcccgtcgcccgtcgtccgtcgtcatggccgccgtggaggtgtgcgtgaaggccgccacggggaagcccgacacgctcggcgactgcccgttctcgcagagggtgctgctcacgctggaggagaagaaggtcccctacgaggtgaagctcgtcgacctcgacaacaagcccgaatggtttctgaagatcagcccagagggtaaggtgcctgtgttcaacggtggtgatggcgaatgcattgctgattctgatgtaatcacccaaaccattggaggagaagttcccaactccatctctggtcactcctgtagaatatgcatcagtgggatcaaagattttcccagccttcatcacattcttgaagagcaaggatgctagtgatggttccgagaaggcgcttctggatgagctgcaggcactggatgagcatnctcaagctcatggcccctacatcaacgggggagaacgtatcagcagctgatcttagcctggggccaaagctcttccacctccaggtcgcactggagcatttcaaaggctgggagatcccagaaaacctaacaacgtccacgcctacaccaaggctcttttcaagcgtgaatcttttgtcnagactaagcatcccgaggacacgtggattgcgggatgggcgcccaaaggtgacgcgtaagcact

SEQ ID NO: 76383 - DNA, 803 bp, Zea mays
  misc_feature: Ceres CLONE 1561101
  misc_feature: Encodes the peptide sequence at SEQ ID NO. 76384
ctggagctccccgcggtggcggccgctctagaactagtggatcccccgggctgcaggaattcgtctcacccctagaaaaaggaggcataggcactagcacctcctcgcctccacctccgtcctcttcgatcccgtccaatcccccgcgccccggcgcccctctccgccggcggctttgctgggtcccgcgctcctcctcctcctaggctgttctggttggggctgcggcggagggaactaggtaagggggaaggaaaggggaggttttgagggagagcgcagcggcagcggcagcagcgatgccatcgcacgcggatctggaccgccagatctcgcagctgcgggattgcaagttcctgcctgaggcggaggtcaaaacgctatgcgagcaggccaaggcgatcctcatggaggagtggaacgtgcagcccgtgcgttgccacgtcactgtctgcggcgacatccacggccagttctacgacctcatagagctcttttcgatgggtggcgacgcgcccgacaccaactaccttcttatgggcgactacgtcgaccgtggttactactaaggggaaactgtgtccctaatgggggctcctaaaagacgtaaagaaaaagaaccccaattttgggaggaaaactggaaagagacaattaaccccgggggagggggtccttaaagaaagggtggggaaaaagggaaatgcaaagtgggggaaaatactttaaaaacttttgggaattattgcgcccccaaaacccttttaaaaaaaaaaaattttcgcccaaaagggggggctccc

SEQ ID NO: 76384 - protein, 89 aa, Zea mays
  misc_feature: Ceres CLONE 1561101
  misc_feature: SWISSPROT Homolog: EC 3.1.3.16 Phosphoprotein phosphatase
MPSHADLDRQISQLRDCKFLPEAEVKTLCEQAKAILMEEWNVQPVRCHVTVCGDIHGQFYDLIELFSMGGDAPDTNYLLMGDYVDRGYY

SEQ ID NO: 76385 - DNA, 807 bp, Zea mays
  misc_feature: Ceres CLONE 1561104
  misc_feature: Encodes the peptide sequence at SEQ ID NO. 76386
  misc_feature (743)..(743): n is a, c, t, g, unknown, or other
ctccccgcggtggcggccgctctagaactagtggatcccccgggctgcaggaattcgtctcacccctagaaaaacgcacggactcgtggtaaaggatggagaccatgtcggctctcgcgaggacggcgccgccccttgctgggaccattcgccggccgtcctgcgcgctgcggccgacggcgtccctctccttcgccgccgcttcaacgacgccccgcggccggctcgggctggggctgagcacggcgccggcggggagcgggagggcggccagggctcgcgccgtcccgcagcgcatcgtcgcctcctcggaggttgagcgaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaaggataaacctttctttcctaagctgatcgattacataacttctggccctgttgtctgcatggcctgagagggtgctggtgttgttgcatcagctcgcaaattaataggagctactaacccccttcaagctgaaccagggactataaggcgtgatcttgcagttcaaactggaaggaacgttgtccatggaagtgatagtcctgataatggcgagcgtgaaattgaactgtggctcaaagaatgcgagctctgccaatgggaatcagttcangcatcgtgggctatagaataactctagctatcattttcagagttgtattcatgtttctgttttg

SEQ ID NO: 76386 - protein, 147 aa, Zea mays
  misc_feature: Ceres CLONE 1561104
  misc_feature (75)..(147): Pfam Name: NDK Pfam Description: Nucleoside diphosphate kinase
  misc_feature: SWISSPROT Homolog: EC 2.7.4.6 Nucleoside-diphosphate kinase
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPVVCMA

SEQ ID NO: 76387 - DNA, 778 bp, Zea mays
  misc_feature: Ceres CLONE 1561105
  misc_feature (674)..(674): n is a, c, t, g, unknown, or other
  misc_feature (675)..(675): n is a, c, t, g, unknown, or other
agctccccgcggtggcggccgctctagaactagtggatcccccgggctgcaggaattcgtctcacccctagaaaaaattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtggtggaggtgccggcggagctggtggcggcgggcagccggtacgccgtcgccccaaagacggaagggcgtccgcagcctccggggggggcgccttccctgggcccccctcccaagcccggacgggtttcctggaagttcggggaaccacgggccccctttggtttactccccccccaacccagggggcccctcccccccccagggttttttccggggcaaaaggacacaaggggttttccccccttttccaaaagggggggggggggaaaaaaacggggggggggggtgagaccccaccaaaaaaggggggtttgtaaaaaaaaaggggggccccccccaaaagggggggctccccctcttttttaaggaggggctataaaagaagagggtggtgggggaaaacccggggcgccccaaaaaacggggggggggtttttttttttttttttccccccccccctnnacacggggggctctctgaaacgccgcctttttccccccccttttttaaaagaaagggcccacccccccccctcctctcctgtggggggggggggggtaaaaat

SEQ ID NO: 76388 - DNA, 796 bp, Zea mays
  misc_feature: Ceres CLONE 1561107
  misc_feature: Encodes the peptide sequence at SEQ ID NO. 76389
ggagctccccgcggtggcggccgctctagaactagtggatcccccgggctgcaggaattcgtctcacccctagaaaaaaccagcggcatctataggcaaccggtccagcactttcacgctcagctccagcaatggctgcctccaccatggcgatctcctacacggcgatggccggcacccccatcaaggtgggctccttcggcgaggagccgcatcaccatgcgcaagagcgtgggcaagcccaatgtggcggcgtccggcagcccctggtacggcaccgaccgcgtcaagtacatcgggcccttctccggcgagcccccgagctacctgaccacgcgagttccccggcgactaccgctgggacaccgccgggatgtccgccgaccccgataccttcgccaagaaccgcgagctggaggtgatccactcccgctggaccatgatcagtgcgctcggatgcgtcttccccgagatgctctccagcaacggcatcaagttccgccaggccgtctgggacaaggccagctcccagatcttcagcaagggcaggctggactacctcggcaaccccagcctgatccacgcacagagcatcctcgtcatctgggcgtgccacgtcgtgctcatgggtgccgtcgagggctacagcattgccggcgggacgctcggcgaggtcgtctacgcgctgtaccctgagtgcagcttcaatcccgtcaggctggccgactacccgtagccttctccgagctcaaggtgaggagctcaggagcgacgcctaccctggttttcatgttcg

SEQ ID NO: 76389 - protein, 120 aa, Zea mays
  misc_feature: Ceres CLONE 1561107
  misc_feature (1)..(119): Pfam Name: Chloroa_b-bind Pfam Description: Chlorophyll A-B binding protein
MSADPDTFAKNRELEVIHSRWTMISALGCVFPEMLSSNGIKFRQAVWDKASSQIFSKGRLDYLGNPSLIHAQSILVIWACHVVLMGAVEGYSIAGGTLGEVVYALYPECSFNPVRLADYP

SEQ ID NO: 76390 - DNA, 706 bp, Zea mays
  misc_feature: Ceres CLONE 1561108
  misc_feature: Encodes the peptide sequence at SEQ ID NO. 76391
  misc_feature (42)..(42): n is a, c, t, g, unknown, or other
  misc_feature (65)..(65): n is a, c, t, g, unknown, or other
  misc_feature (66)..(66): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (441)..(441): n is a, c, t, g, unknown, or other
  misc_feature (442)..(442): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
ctccccgcggtggcggccgctctagaactagtggatcccccngggctgcaggatattcgtctcanncccctagaaaaaacggctcgccgaccgtcactcacacaaccagcacgacaccatccgttcctggccttcctcccgtgcaactaccactcgcgtcaccgcggaaattaaccccgaaatccagcgccttcggcacgagcacgaccaggcctgcgcaggagatggggcggagaggggagccctactacgtcgaggcggtgccgccggtggacgtgaacaagaacacagagtggttcatgtacccgggcgtctggaccacctacatcctcatgctcttcttcgactggcttctcgtcctctccgtctctggttggctcccgggggcagcctggaccgtcgtcaacctcgcgcaactttgggcccttttnnnnnnnnntnnataaaaaaattttttttttttgggaaaaaaaaagaaaaccctttttttgggggtgggaaacagggggtttccccccaaatataaattgggggggggagaaaaaaataaaaaggggggggggaaatttttttctgtgggaaaaaaaaagagttttttttttttttttttttggggcccccccccgggggggggggggggttatttttaatataatagttttttttttggnnnnnnttgtcccccccccccccccccccccccccc

SEQ ID NO: 76391 - protein, 68 aa, Zea mays
  misc_feature: Ceres CLONE 1561108
MGRRGEPYYVEAVPPVDVNKNTEWFMYPGVWTTYILMLFFDWLLVLSVSGWLPGAAWTVVNLAQLWAL

SEQ ID NO: 76392 - DNA, 829 bp, Zea mays
  misc_feature: Ceres CLONE 1561110
  misc_feature: Encodes the peptide sequence at SEQ ID NO. 76393
ctcaccgcggtggcggccgctctagaactagtggatcccccgggctgcaggaattcgtctcacccctagaaaaatgcgcacatgccatacaatcatgaaaagaccgtaaactcaatttaaccttaaataaaataattcctctcgctcgccaggaaaagcaacctccgttgctgctgccccgtcaacagaatggggggtttcgtgaaaacccataaaaccaatgcgtatttcaaacgtttccaagtgaaattcaaaaaaaggggggttggcaagacaaactacagggccaggataaggctgattacccaagacaaaaacaagtacaacgcccccaaatacagatttgttgtgcgatttaccaacaaggacatcgctgcccaaatcatatctgctagtatagggggtgatatggttcttgcttctgcctactcaaatgatttgccaagataaggccttaaagttggtctgaccaactatgcagctgcctactgcactggccttctgttggctcaccgtgtgctcaaaatccgtggtttggatcaggagtacgagggccatgttgaggccactggtgaggacttctctgttgacccagctgataagaggaggcctttccgtgctctcttggatgttggccttatcgggcatacaaaggggaaccgtgtctttggtgccctcaagggagcattggatggagggctggatattcctcacaacgaagaagaagtttgctggattcaagacggacgaacagcagttggatgctgatccccaccgaagttacatctatgggggccatgtggctgacaacatgaaaaactttgctgaa

SEQ ID NO: 76393 - protein, 86 aa, Zea mays
  misc_feature: Ceres CLONE 1561110
  misc_feature (27)..(87): Pfam Name: Ribosomal_L18p Pfam Description: Ribosomal L18p/L5e family
MGGFVKTHKTNAYFKRFQVKFKKRGVGKTNYRARIRLITQDKNKYNAPKYRFVVRFTNKDIAAQIISASIGGDMVLASAYSNDLPR

SEQ ID NO: 76394 - DNA, 827 bp, Zea mays
  misc_feature: Ceres CLONE 1561111
ctccccgcggtggcggccgctctagaactagtggatcccccgggctgcaggaattcgtctcacccctagaaaaaaattaccataggctcattcatcgaaacgcaaatcagagagacaggaaaagaaaaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttatttaatagtctctgactatcattaaaataaaggtagagcaatttcttttttctagagattctaagagaagtgagacaaagtgaaaggaaaagagttttctttggataaagattaaggtctatatcatatcctaaatagaagggaaatcaaaaagaagggaaagtggggattaacattggaatgaatcctttaggggaggaacctttcccaaaagaaataaaaggctaaagtaaagcgcctcccttgccctttgggtttgaaacaaaaacagaattctttgttttcacccaagaaaaaa

SEQ ID NO: 76395 - DNA, 825 bp, Zea mays
  misc_feature: Ceres CLONE 1561112
  misc_feature: Encodes the peptide sequence at SEQ ID NO. 76396
ctccccgcggtggcggccgctctagaactagtggatcccccgggctgcaggaattcgtctcacccctagaaaaactgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatctccggccccgtggtggcgatggtgtgggaggggaaggacgtcctgttgactggccgcaggatcattggggccaccaggccttgggaggcagcccccggtaccattcgtggggactactccgtggaagtcggcaggaatgtcatccatggaagcgactccgtggagaacgggaagaacgagatcgctctctggttcactgaatgtgtggcacagtggaagagcaaccttcatccgtggatctacgaggcttgagcagttgagcttggatgccttgcctgctccatggaaaccagagtggtgcttgagcataatctgttggcactgggtgaagagttataatttagccctctgtgtgctacagcagaattaactctgcctgaacttatgtgggctttgtttgagtgtctgccttcgtgccccggtttcta

SEQ ID NO: 76396 - protein, 149 aa, Zea mays
  misc_feature: Ceres CLONE 1561112
  misc_feature (2)..(135): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVERSFAQQHYADLSDKPFFPGLVEYIISGPVVAMVWEGKDVLLTGRRIIGATRPWEAAPGTIRGDYSVEVGRNVIHGSDSVENGKNEIALWFTECVAQWKSNLHPWIYEA

SEQ ID NO: 76397 - DNA, 811 bp, Zea mays
  misc_feature: Ceres CLONE 1561117
  misc_feature: Translation starting site: 229
  misc_feature: Pfam Name: bZIP_2 Pfam Description: Basic region leucine zipper
  misc_feature (560)..(560): n is a, c, t, g, unknown, or other
  misc_feature (666)..(666): n is a, c, t, g, unknown, or other
ctccccgcggtggcggccgctctagaactagtggatcccccgggctgcaggaattcgtctcacccctagaaaaagcaattgcaattgcaaccaataaccatatacacacagctagctagcttcacatatcgcaagcacccagatcggcaggaccagcggcagcggcagcggtgccggcaagaagcaggccgcgcgctccactctccgaccccggccgaaacaaaggtgatggcgcagctgccgccgagggcgccggggggcgccgcgccgcaggaccactggtcggcggcgggggagttcctggggttcgccgcggccagacgcggcgcgcaccgccgctcggcgagcgactcggccgcgttcctcgaggccctgcccatggaagacgtcatcggcggcgacggcttcgaccgcctcgacgacgaccagctcatgtccatgttctccgacgtcgacgcgccggccgtctccgccggggacgcggcgcagctcatggacgtggcggacgccgacgcggacgcggacgacgacgggtcggccgccctcgtcgcgcgccgccncggacggcgtcgccgctgaccccaaaagggtcaagaggatattggcaaacaggcagtcagcgcagaggtcacgagtcaggaagctacagtacatctccgagctcgnaacggagtgtcaccggtctccagatggaggtgtcagcgctgtcccctcgcggtgcctttctcgaaccacagcgatcgctgctcaccgtcgggcacagccacctcaagcaacgaatcggcgcgctcgcccaagacaggatcttcaa

SEQ ID NO: 76398 - DNA, 854 bp, Zea mays
  misc_feature: Ceres CLONE 1561120
  misc_feature: Encodes the peptide sequence at SEQ ID NO. 76399
  misc_feature (497)..(497): n is a, c, t, g, unknown, or other
  misc_feature (514)..(514): n is a, c, t, g, unknown, or other
ggagctccccgcggtggcggccgctctagaactagtggatcccccgggctgcaggaattcgtctcacccctagaaaaagcctgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggtttgacagggcaccattgaggttggtggcactgantaggagaccaccacccnagggcatgacgaccttggcaagcgctgcggccagtactacgagggccgtgcccgctttgccaagtgccccgctgttctcagattggccccaaggagccatcaaagttggccttcgacctgaacgctcaggggctgggtccgcttcccatcatctgccaggaaaaagggccggggcccaattgtgaaccctaaaaaccctgttaaggggccccaagaaatttgaacccgcccttttacctaccggaaaccttcttttttggccggtaaagggggcctaaaaaaaaccagggccccctggaggggaaccccccgaaaacccaaaggggggaccccggccccc

SEQ ID NO: 76399 - protein, 104 aa, Zea mays
  misc_feature: Ceres CLONE 1561120
  misc_feature (11)..(105): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKV

SEQ ID NO: 76400 - DNA, 817 bp, Zea mays
  misc_feature: Ceres CLONE 1561127
  misc_feature: Translation starting site: 109
  misc_feature: SWISSPROT Homolog: EC 2.7.1.90 Diphosphate--fructose-6-phosphate 1-phosphotransferase
  misc_feature (632)..(632): n is a, c, t, g, unknown, or other
ctggagctccccgcggtggcggccgctctagaactagtggatcccccgggctgcaggaattcgtctcacccctagaaaaaaccacaccagcacccagcctccccaacgatgacagctgcggcggcaccggcggtcgctagcagggtgtgggagtgggaagggaatgtggcatcgattgttgataacattcaagatcgcgaaatctaccaggctgtatatcattgttaggagatggaactcagaagggagcatatgagatcttcaaggaaatccggatacgtggcctcaaagtttctgttgctggagttccaaagacaatacataatgacattgcgatcatcgacaagtcttttggttttgatacggctgtggaagatgcccagcgtgccattgattcagctcatgtggaagcttgcaatgctgagaatggaataggtttagtaaaactgatgggccgttatagtgggttcattgccatgtatgctactcttgctagtcgagatgtggactgctgtttgattccagagtctccattttatctggatggagagggtggattgcttcaatatgtagagaagaggctgaaagagaacaagcacatggttattgttgttgctgagggagcacggcangatcttatcgcgaaaagtttagccacgtcagatctacaagatgcgtctggaaataagctgcttcttgatattggtctctggctgactcacaagataaaagactacttcaaaagcaaaaagatggagatgacgattaaattcatagatccctactacatggtcccgtgctattccaagcaatgcat

SEQ ID NO: 76401 - DNA, 848 bp, Zea mays
  misc_feature: Ceres CLONE 1561130
  misc_feature: Encodes the peptide sequence at SEQ ID NO. 76402
  misc_feature (745)..(745): n is a, c, t, g, unknown, or other
  misc_feature (767)..(767): n is a, c, t, g, unknown, or other
  misc_feature (795)..(795): n is a, c, t, g, unknown, or other
  misc_feature (796)..(796): n is a, c, t, g, unknown, or other
ctccccgcggtggcggccgctctagaactagtggatcccccgggctgcaggaattcgtctcacccctagaaaaaagtcggccgccgcagaccgggagtagccgacgcgccgtcactgaatcctcagatcacggctagccgtaatcacgacactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctctgtggaagttcgagaccaccaagtactactgcactgtcattgatgcccctggacaccgtgacttcatcaagaatatgattactggcacttcccaagctgactgcgctgttcttatcattgactccaccactggtggttttgaggctggtatctccaaggatggacagacccgtgagcatgctctccttgctttcacgcttggagtgaagcagatgatttgctgttgcaacaagatggatgccaccacacccaagtactccaaggcccgttatgatgagatttgtgaagggagtctcttcctaccctgaagaaggttggatancaaccctgacagatccacttcngtcccatctctgggtttcgaaggtgacnnacatgattgagaggtcaaccaaaccttgactggtacaaggggcccaaccctt

SEQ ID NO: 76402 - protein, 178 aa, Zea mays
  misc_feature: Ceres CLONE 1561130
  misc_feature (5)..(179): Pfam Name: GTP_EFTU Pfam Description: Elongation factor Tu GTP binding domain
  misc_feature: SWISSPROT Homolog: EC 2.7.7.4 Sulfate adenylyltransferase
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEICEGSLFLP

SEQ ID NO: 76403 - DNA, 825 bp, Zea mays
  misc_feature: Ceres CLONE 1561133
  misc_feature: Encodes the peptide sequence at SEQ ID NO. 76404
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (280)..(280): n is a, c, t, g, unknown, or other
  misc_feature (445)..(445): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (670)..(670): n is a, c, t, g, unknown, or other
  misc_feature (671)..(671): n is a, c, t, g, unknown, or other
  misc_feature (673)..(673): n is a, c, t, g, unknown, or other
nnnnnnnnnnnnnnnnnnnnnnnnnnnnnnnnnnnnnnnnnnnnnnnnnnnnnnnnnnnnnnnnnnnaaaagtggggctcccgcggtggcggccgctctagaactagtggatcccccgggctgcaggaattcgtctcacccctagaaaaagctcgcaaccgcatctctctcggcttctggcctcttcctagttcctaactaccaccggccacctctaccactggcctcaatctgcaaaccctagccctcgtcgccggcggtcatggcacgagaccagtcnacgaccatgatcagcgtacttttaagggacgtcaccgggcatcttccaacaagggaacttctgccctggaaaatccctcgccggggaacaattggaaaacctggcagcttcgggggttgttccaccaaaaagccggaaaaaaaccctttttttcgcccccttgtntccgaaattttttcgggggggcggtttttaaaaccctttttttgtttttttgggttgggcaacccccgcccccccctcttggaaaaaaacttttttttgggggggggaaaaaaaacaccccccacaaaaaaaaaaaattggtggggggggggggcccccccccccgcccaacccggggggggggggggggannnttttccccccccccccccttttgtgtttttnncnccccccccccccccctctccttacccaaaaaaaacggggggggggggaaaaaaaacaccccccggggggaggaaaaaaaaattgtgggggtggggggacaggggccccccccccccctcttcctctcttgttgggggggggggggggggggg

SEQ ID NO: 76404 - protein, 42 aa, Zea mays
  misc_feature: Ceres CLONE 1561133
KWGSRGGGRSRTSGSPGLQEFVSPLEKARNRISLGFWPLPSS

SEQ ID NO: 76405 - DNA, 854 bp, Zea mays
  misc_feature: Ceres CLONE 1561136
  misc_feature: Encodes the peptide sequence at SEQ ID NO. 76406
  misc_feature (648)..(648): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (654)..(654): n is a, c, t, g, unknown, or other
  misc_feature (655)..(655): n is a, c, t, g, unknown, or other
  misc_feature (659)..(659): n is a, c, t, g, unknown, or other
  misc_feature (668)..(668): n is a, c, t, g, unknown, or other
  misc_feature (669)..(669): n is a, c, t, g, unknown, or other
agctccccgcggtggcggccgctctagaactagtggatcccccgggctgcaggaattcgtctcacccctagaaaaaaaagagggatagagaagagatacacgcagaccagtagcaagccaagcagcgcccacgcccccacgagggccacgaccaccaccacccccgccgccgccgcggcaaactgctactgcccaaccgcgggatggaggtggacgccactgccttctgcccgccgccccagcccgcgcctgccgcctccccggcttcaaagccgcctgcgccggtgctgggcgccggtggagcggtcgcgccggtggcagggcacggccgcggcggagggaggcagtaccgcggcgtccggatgcgcaagtggggcaagtgggtggcggagatccgcgagtcgaacaagcggtcgcggatctggctcgggtcctactccaccgccgtcgccgccgcgtgcgcctacgacacggcagtcttctgcctccgcggccgctccgcgcggctcaacttccccgaccagctcgacggcgcggcggtggccgacaaccccgaggggcacaaggacggcgcggggctcacagccgccgccatccgcaagaaggcggccgaggtcgtcgcccgcgtcgacgcgctccactgcggcngnnngnngggnggggggggnnggcacctcctccgcagcccgcttgtcgtttccatcgcccgccgcccccaagaacccccgaccctcaaccgggtagcccaacccccgggaaaccctcagacgaacgagtaaaagcgcgcctggattaggggtaggctagcctagcctagggcaggccagggcaaggcaagcaagtaagcaaggtaa

SEQ ID NO: 76406 - protein, 191 aa, Zea mays
  misc_feature: Ceres CLONE 1561136
  misc_feature (47)..(98): Pfam Name: AP2 Pfam Description: AP2 domain
  misc_feature (149)..(149): Xaa is any aa, unknown, or other
  misc_feature (150)..(150): Xaa is any aa, unknown, or other
  misc_feature (151)..(151): Xaa is any aa, unknown, or other
  misc_feature (156)..(156): Xaa is any aa, unknown, or other
MEVDATAFCPPPQPAPAASPASKPPAPVLGAGGAVAPVAGHGRGGGRQYRGVRMRKWGKWVAEIRESNKRSRIWLGSYSTAVAAACAYDTAVFCLRGRSARLNFPDQLDGAAVADNPEGHKDGAGLTAAAIRKKAAEVVARVDALHCGXXXGGGGXHLLRSPLVVSIARRPQEPPTLNRVAQPPGNPQTNE

SEQ ID NO: 76407 - DNA, 810 bp, Zea mays
  misc_feature: Ceres CLONE 1561137
  misc_feature: Encodes the peptide sequence at SEQ ID NO. 76408
ggagctccccgcggtggcggccgctctagaactagtggatcccccgggctgcaggaattcgtctcacccctagaaaaaagagaatcgagcagagccaccgatcgctcctgagcactttccacattccagttccactccgcctccgctgccggtcgccgtctccgagactccgacagtccgaccgcaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcaggagcctgttgttcctggttcgttcctgcgagcaagagcaatcggccttatgcccatgattgaccagggtgaaaaggatgacaagataatagcagtctgtgctgatgatcctgaatatcgtcactacaacgacaatcagtgagctgtctcctcatcgcctgcaagagatcaagcggttctttgaagattataagaagatgagaataaagaggttgctgtcgatgcattcttgcctgcgacacagctcgagagggcattcagtactccatggatctgtatgcgcagt

SEQ ID NO: 76408 - protein, 157 aa, Zea mays
  misc_feature: Ceres CLONE 1561137
  misc_feature (52)..(157): Pfam Name: Pyrophosphatase Pfam Description: Inorganic pyrophosphatase
  misc_feature: SWISSPROT Homolog: EC 3.6.1.1 Inorganic diphosphatase
MSEEDKTAASAEQPKRAPKLNERILSSLSRRSVAAHPWHDLEIGPDAPAVFNVVVEITKGSKVKYELDKKTGLIKVDRVLYSSVVYPHNYGFVPRTLCEDNDPMDVLVLMQEPVVPGSFLRARAIGLMPMIDQGEKDDKIIAVCADDPEYRHYNDNQ

SEQ ID NO: 76409 - DNA, 829 bp, Zea mays
  misc_feature: Ceres CLONE 1561141
  misc_feature: Encodes the peptide sequence at SEQ ID NO. 76410
  misc_feature (727)..(727): n is a, c, t, g, unknown, or other
ctcaccgcggtggcggccgctctagaactagtggatcccccgggctgcaggaattcgtctcacccctagaaaaagaagagcatagagctagcaactagctcacttgatatacatatacacaggccggcatattgcatcggaataaaaactgattttactatggcccacctgatctcttatgcaatcgcaggcgcgggaaacttggccgctgatggaatcactggtgtcaatggcatatcgccgctcgtgtgtataatgcgtagaggacactttaggcagtatcgtagaatcaatcgaccatggagtcaaggatgaggaccaactggacttgaccaattacgtgtgtttcatgggagataacggtctgtaccttagtgctccgaaggttgaaggccatccctacctggaatttgcatctggagatattggcgacccatgtgtgaggttcatcacctacaaccacaaggtgaacggcaaacgggtggtgcgctgaaagtccaaccatctcgtcaagttctggcgacgaagccctaactggatctgggccgactccgacgacaccagcactaacaactgcgacaccttgatcgagctcatatagatcggcgaggatggcgtgtacgactctccagagcctcggcaacaacatacttctgcaagccgatgacctacgacgtcaaggacgactgcctgcaactccatgatcctccacatcgggtacgacgcntacatccagattgaactatgctgtccacctcccggaagatcatccgacgtcgagtactacgtcaagggcagcaaagatcttccacaaagaatgctaacaccc

SEQ ID NO: 76410 - protein, 47 aa, Zea mays
  misc_feature: Ceres CLONE 1561141
MGDNGLYLSAPKVEGHPYLEFASGDIGDPCVRFITYNHKVNGKRVVR

SEQ ID NO: 76411 - DNA, 813 bp, Zea mays
  misc_feature: Ceres CLONE 1561143
  misc_feature: Encodes the peptide sequence at SEQ ID NO. 76412
ctccccgcggtggcggccgctctagaactagtggatcccccgggctgcaggaattcgtctcacccctagaaaaactgctctgctctcctcgcatatagggtttatcttctcccctcctctgcccccatctcgcttctcgcacacggcagccggattccgaagcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagagactggagcaccagtagtatactcaaagtatgctgggactgaggttgaattcaatgactcaaagcatcttattctcaaagaaaacgatatcattggtattcttgaaacagaagatgggaaggacatgaaacctcctcatgaccgtgttctcatcaaggttggaaaaacccgaaaaaaaaactctggggggccttatcctcactggaacaaacaaaaaaaaaaccggcccataaggaaacggtttgaaactgtttggc

SEQ ID NO: 76412 - protein, 196 aa, Zea mays
  misc_feature: Ceres CLONE 1561143
  misc_feature (54)..(145): Pfam Name: Cpn10 Pfam Description: Chaperonin 10 Kd subunit
MSFVQLSGAGVAAVAFTNKSLVSRHAALRVCSSRRSIRSLVVKAATVVTPKYTSLKPLGDRVLVKLGAAEEKTVGGILLPSTAQTKPQGGEVVAVGAGRTIGDKKIAVDIETGAPVVYSKYAGTEVEFNDSKHLILKENDIIGILETEDGKDMKPPHDRVLIKVGKTRKKNSGGPYPHWNKQKKNRPIRKRFETVW

SEQ ID NO: 76413 - DNA, 814 bp, Zea mays
  misc_feature: Ceres CLONE 1561145
  misc_feature: Encodes the peptide sequence at SEQ ID NO. 76414
  misc_feature (514)..(514): n is a, c, t, g, unknown, or other
  misc_feature (581)..(581): n is a, c, t, g, unknown, or other
tggagctccccgcggtggcggccgctctagaactagtggatcccccgggctgcaggaattcgtctcacccctagaaaaaccctagaaaaaatgaatccaaagaccaaaaacatccgattgtatgtcaaaagagtgttcatatcagatgattttgatggcgagctgtttcccagatacttgagctttgtgaaaggtgtagttgactcaaatgatctccctctcaatgtttctcgtgagatccttcaagaaagtagaattgtcagaattatgcgtaagagacttgttaggaagacatttgacatgattcaagagattgccgagaaggatggcaaagaggactacaacaaattctgggagagctttggcaagttcatgaagcttggttgcatcgaggacacaggaaaccacaagcgtcttgcaccattgctgagattctactcttccaaaaacgagacagatttaataagtctggaccagtatgtagaaaacatgcctgaaaaccagaagcgatctnatatatcgctactgatagtctccagagcgcgaagactgctcctttcttggaaaagctggttcagaanggatattgagggtcttttacctcattgaccaattggatgaaggtgccattccgaattttccggactccaaaggagaaaaagtttgtaaattttaccaaaaggattttggatttgggggaatgaaaattagggccccggggaaaaaaaacccggcgggggttttccctttcttttgcactgggaaaaaaaccccttggggaaaaatcccccagggccaaattttaaggctctcc

SEQ ID NO: 76414 - protein, 172 aa, Zea mays
  misc_feature: Ceres CLONE 1561145
  misc_feature (2)..(171): Pfam Name: HSP90 Pfam Description: Hsp90 protein
  misc_feature (142)..(142): Xaa is any aa, unknown, or other
  misc_feature (164)..(164): Xaa is any aa, unknown, or other
MNPKTKNIRLYVKRVFISDDFDGELFPRYLSFVKGVVDSNDLPLNVSREILQESRIVRIMRKRLVRKTFDMIQEIAEKDGKEDYNKFWESFGKFMKLGCIEDTGNHKRLAPLLRFYSSKNETDLISLDQYVENMPENQKRSXISLLIVSRARRLLLSWKSWFRXDIEGLLPH

SEQ ID NO: 76415 - DNA, 819 bp, Zea mays
  misc_feature: Ceres CLONE 1561147
  misc_feature: Encodes the peptide sequence at SEQ ID NO. 76416
tggagctccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcagatcttctcggagggcgggctggactacctggggaacccccacctggtgcacgcgcagagcatcctggccatctgggcgtgccaggtggtgctcatgggcttcgtcgagggctaccgcgtcggcggcggccgctcgggaagggctcgacaagtgtaccccggcggcgctttcgacccgctgggcttcgccgaccacccggacacggcgccgagcctcaggtgaaagagctccagaccggccgctttgcaatgttctcatgttcggg

SEQ ID NO: 76416 - protein, 204 aa, Zea mays
  misc_feature: Ceres CLONE 1561147
  misc_feature (59)..(205): Pfam Name: Chloroa_b-bind Pfam Description: Chlorophyll A-B binding protein
MAASALHQTTSFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPHLVHAQSILAIWACQVVLMGFVEGYRVGGGRSGRARQVYPGGAFDPLGFADHPDTAPSLR

SEQ ID NO: 76417 - DNA, 796 bp, Zea mays
  misc_feature: Ceres CLONE 1561149
  misc_feature: Encodes the peptide sequence at SEQ ID NO. 76418
tggagctccccgcggtggcggccgctctagaactagtggatcccccgggctgcaggaattcgtctcacccctagaaaaaaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccaattgggtgagggctccgctggtcaggtcacaaggaacatgcttgcaaatgagggtgtccgttctttctacaagggtttgtctgccggattgctgaggcaagcgacgtacacgactgctcgtcttggatcctttagggttctaactaacaaagcagttgaaaagaatgaagggaagccattgcctctattgcagaaagcttttattggtctgactgctggaggcattggtgcttgttttggtagtcctgctgatctggcactcattagaatgcaagccgactcgacccctgcagctgcacaacgacgcaactataagaatgctttccatgcactctaccgtatcattgctgatgaggggagtcttgcgctttgggaaggtgcagggtccactgggggggagactttgccccccaaaaggggatgcctggctcccaagaccagaagggccg

SEQ ID NO: 76418 - protein, 202 aa, Zea mays
  misc_feature: Ceres CLONE 1561149
  misc_feature (23)..(108): Pfam Name: Mito_carr Pfam Description: Mitochondrial carrier protein
  misc_feature (114)..(199): Pfam Name: Mito_carr Pfam Description: Mitochondrial carrier protein
MADAKQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLLQKAFIGLTAGGIGACFGSPADLALIRMQADSTPAAAQRRNYKNAFHALYRIIADEGSLALWEGAGSTGGETLPPKRGCLAPKTRRA

SEQ ID NO: 76419 - DNA, 826 bp, Zea mays
  misc_feature: Ceres CLONE 1561151
  misc_feature: Translation starting site: 119
  misc_feature (749)..(749): n is a, c, t, g, unknown, or other
ctccccgcggtggcggccgctctagaactagtggatcccccgggctgcaggaattcgtctcacccctagaaaaaacaccaacctcagcacaccaaggagagtacgtggaggagcagccatggcttcatcggtggccgccgcggcgagcacattcctgggcacccgcctggcggaccctgcgccactgaacgggcgcatcgtggcccggttcgggttcaggttgggcggcataggcgaagcctgctccgaagaaggtggcgaagacatcgacctcctctgaccggccgctgtggttccccggcgccgtggcgcccgactacctggacagctcgctggtcggcgactacgggttcgacacgttctgtctcgggaagcccgtggagtacctgcagttcgagttggactccctggaccagaacctggccaataatgaggcccgcggcatcatcggcacccggttccagtcctccgaagtcaagtccaccccgttgcagccatccagcgaggtgttcggcctccagcggttccgcgagtgcgagctcatccacagccgctgggccatgatcgccacccttggcgccctttccgtcaagtgtctcagcggcatcacctggcaggacgccggctatgtggagctaaggggacgggtccttcctacctgagccggcccgcttgccgtttccccatatcgaacgttcctcctggaacggggggggcttccttaatccggcaaaatccaaagttccaancccaaacccccaatggtttcccccggaaaaaaaaagggtttttcccccccggggggggggcctttttttttaaaaac

SEQ ID NO: 76420 - DNA, 797 bp, Zea mays
  misc_feature: Ceres CLONE 1561152
  misc_feature: Encodes the peptide sequence at SEQ ID NO. 76421
  misc_feature (737)..(737): n is a, c, t, g, unknown, or other
ctccccgcggtggcggccgctctagaactagtggatcccccgggctgcaggaattcgtctcacccctagaaaaactcctcgcaggtgaccttgcgtacgtacgtcgtagcggctcgtccagctcgctcgccaccgccatggacccgtacaagcaccgcccgtcgagcgccttcaacgccccgtactggaccaccaactccggcgcccccgtgtggaacaacgacagctccctcaccgtaggcgcacgaggtcccatcctgctggaggactaccacctggtggagaagctagccaacttcgaccgcgagcgcatcccggagcgcgtggtgcacgcgcgtggcgccagcgccaagggcttcttcgaggtgacccacgacatcacccacctgacgtgcgccgacttcctgcgcgcgcccggggtgcagacgcccgtcatcgtccgcttctccacggtgatccacgagcgcgggagccccgagacgctgcgcgacccgcgcgggttcgccgtcaagttctacacccgggagggcaactgggacctggtgggaaacaacttccccgtcttcttcatccgcgacggcatcaagttcccggacatggtgcacgcgctcaagcccaacccgcggacgcacatccaggacaactggcgcatcctcgacttcttctcgcacagcccggagagcctccacatgttctccttcctcttcgacgacgtcggcatcccccgccgactaccngcacatggaccggatccggggtgcacacgtacacgctcgatcagccgggctggcacgata

SEQ ID NO: 76421 - protein, 220 aa, Zea mays
  misc_feature: Ceres CLONE 1561152
  misc_feature (18)..(220): Pfam Name: Catalase Pfam Description: Catalase
  misc_feature: SWISSPROT Homolog: EC 1.11.1.6 Catalase
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHSPESLHMFSFLFDDVGIPRRLPAHGPDPGCTRTRSISRAGTI

SEQ ID NO: 76422 - DNA, 825 bp, Zea mays
  misc_feature: Ceres CLONE 1561153
  misc_feature: Encodes the peptide sequence at SEQ ID NO. 76423
ctccccgcggtggcggccgctctagaactagtggatcccccgggctgcaggaattcgtctcacccctagaaatccgcctccacgctccccacgtgcaccgtgcaccgtgcacagcaccacacagccaggtccccatggcggcggcggcggcggttgcgtctgcgacgacggcggaagacgaagcgcgcctgctgcgcctggaggagcaggcggagcacggcggcggcggcgcctgggaatacctctgcctcgcccgccggctccgcgcccgccgccccgctcacgtcctccgcgtcggcctcgccctcctcaacaacgcctccgcgcgctccggccttgcctcataacagtggacgctctacgagcaggtggccacggcggccatggattgccagcgtctcgatgtggcaaaggactgtattggagtcctttcaaaacaatttcctgggagcacacaggttgcccggctagaagctcgtctgtttgaagcacaaggtgaatgggctgaagctgaaatagcctacgcgctgatcctggaaaacaatccatttgaccagattgtccacaagaggaaaattgctatcgcagaagcacaaggtggtatgtcgatagtgattgattatctcaataagtatcctggaattgtttatggctgatcatgatgctttggagagcacttgctggagacatacagttcccttacaaatgtacaagcaagcctgccttttgtttatgaggagcctattattaggccaaaccaactatgtcactatatcatatagccctacgcctgaagttctgttacacctatggggtgggcttggc

SEQ ID NO: 76423 - protein, 90 aa, Zea mays
  misc_feature: Ceres CLONE 1561153
MDCQRLDVAKDCIGVLSKQFPGSTQVARLEARLFEAQGEWAEAEIAYALILENNPFDQIVHKRKIAIAEAQGGMSIVIDYLNKYPGIVYG

SEQ ID NO: 76424 - DNA, 817 bp, Zea mays
  misc_feature: Ceres CLONE 1561154
  misc_feature: Translation starting site: 212
ggagctccccgcggtggcggccgctctagaactagtggatcccccgggctgcaggaattcgtctcacccctagaaaaaactttagctcctcccactgctataggcagcccacatgcgcgcgcactcccaagtcccaagtcctaagctagccagctgagctcgctcccagtccaagcgccggcgccaccaccgcagctgctcgctggtcaccatgagcaaggagaagcaccaccgcgactggatcctccggcgctgctgtggctccctcgccgcctgcatcctgacgctggccgccgtcgtcggcttcatcgtgctcgtcatcttcctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtccccgtgtcgatgccggcgatctaccatgccacaaggacgtgtcggtgtggtcgccggtcatgtcgggcgacgcggtccccgtggcgcagtacgtggcggacgccatgaagcatgacatcgaggcgggatacgtgctgctccacgtcagggtggaccgccgcgtcaagtgggaagtcggcagctgggtctcgagcaactaccacctcttcgttaaatgcccggggctgctcgccaccaggggcagcgctgccgtcgccctccgggagaggacgtcttcacggcatcgcccgggtccggggc

SEQ ID NO: 76425 - DNA, 780 bp, Zea mays
  misc_feature: Ceres CLONE 1561157
  misc_feature: Translation starting site: 213
  misc_feature: SWISSPROT Homolog: EC 2.7.11.1 Non-specific serine/threonine protein kinase
  misc_feature (752)..(752): n is a, c, t, g, unknown, or other
ggagctccccgcggtggcggccgctctagaactagtggatcccccgggctgcaggaattcgtctcacccctagaaaaaacaaaaaggactcagcaacgcaaggccagctcgagacaagtcagggccaacagaaacaaccaccaccacagcagcacgcgagaaacaaacaagaagagcaagcaagcaagcagatcgcaacaaccgcgcgcggcatggcgatggccgtgagcgggaggtggacgcgggtgaggacgctgggccgcggcgcgtcgggcgccgaggtgttcctggccgccgaccaggcgtcgggggatctgttcgcggtcaagtcggcggcggcggcggcgggcgcggagctgctgcggcgggagcgcgcgctcatggcgggcctccgctcgccgcacgtcgtcccctgcatcggcggccgcgcggggcgcgacggctcgtaccagctcttcctcgagtacgcgcccggcgggtcgctggccgacgtggccgcggccaggagcggcgggcggctcgaggagcgcgccgtcgcggcgtacgcggccgacgtggccgcggggctcgcgtacgtccacgccgccggcctcgtgcacggcgacgtcaagccgcggaacgtggtcgtcggcgccgacagccgcgccaagctcgccgacttcgggtgcgctaggagggccgcggacgacgacgccgccgctgccgatcggcgggcacgcccgacgtcatgggcccccggaggtggcgcgcgncggaagcgcatggcccgcccccgccgaa

SEQ ID NO: 76426 - DNA, 798 bp, Zea mays
  misc_feature: Ceres CLONE 1561158
  misc_feature: Encodes the peptide sequence at SEQ ID NO. 76427
acccgcggtggcggccgctctagaactagtggatcccccgggctgcaggaattcgtctcacccctagaaaaaaacgtgctcgatctccctccgccactccatccatctcctcgctcccagtccccgggaagctacgaagcatggcgtccgtcaccgcccgcgccccggtcgcggcccttcgcccgtcgtcggcatcgctcaagtcgtcgtcggccttccttggccactctagccgcctcggccgcaccgcgtcgcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgccgcagtggtacgacgccggcaagtcggagtacttcgcgtcgtcgtccacgctgttcgtggtcgagttcatcctgttccactacgtggagatccggcggtggcaggacatcgagaaccccggcagcgtcaaccaggaccccgtgcttcagagctacagcctggcgtcgcacgagtgcggctacccggggcagcgtcttcaacccgatctacttcgcgcccacgctcgagggccagggagaaagagctcgccaaacgggaggcctggcgatgctgggcattcctggggactccgggatcaaa

SEQ ID NO: 76427 - protein, 219 aa, Zea mays
  misc_feature: Ceres CLONE 1561158
  misc_feature (57)..(195): Pfam Name: Chloroa_b-bind Pfam Description: Chlorophyll A-B binding protein
MASVTARAPVAALRPSSASLKSSSAFLGHSSRLGRTASPTRRSLKAEAKGEWLPGLPSPSYLDGSLAGDNGFDPLGLAEDPENLRWFVQAELVNGRWAMLGVAGMLIPEVLTKAGLINAPQWYDAGKSEYFASSSTLFVVEFILFHYVEIRRWQDIENPGSVNQDPVLQSYSLASHECGYPGQRLQPDLLRAHARGPGRKSSPNGRPGDAGHSWGLRDQ

SEQ ID NO: 76428 - DNA, 757 bp, Zea mays
  misc_feature: Ceres CLONE 1561160
  misc_feature: Translation starting site: 142
  misc_feature (403)..(403): n is a, c, t, g, unknown, or other
  misc_feature (430)..(430): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (683)..(683): n is a, c, t, g, unknown, or other
  misc_feature (695)..(695): n is a, c, t, g, unknown, or other
  misc_feature (696)..(696): n is a, c, t, g, unknown, or other
  misc_feature (706)..(706): n is a, c, t, g, unknown, or other
  misc_feature (707)..(707): n is a, c, t, g, unknown, or other
  misc_feature (718)..(718): n is a, c, t, g, unknown, or other
agctccccgcggtggcggccgctctagaactagtggatcccccgggctgcaggaattcgtctcacccctagaaaaagcaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaaccgcactcatcaaggccgccgtgaccccggccttcgtgggccagttcccgggcgtcaacgggcttggcatnctctgcgggccaaggctcgaacattcnaaggtgggccggggttcttggccactgcccaccccaccccggggggggtttaaaaatcccccttttgtaacccaaggggacccccccccgcccggggttttatttaggtcccggggttccaaaaagctttttaaaaaaaaaaaaaccctttttcccccccggggaaaaaatttgggtggttgttccccccccccggggggggcggcggcgctccccccaaacaacaaaaaaaaaaaannnnatcccgcgccgnaaaaaaaaaaanncccccccccnnggcgcgggggntggggggggggggaggggaatctcggcgccctcttaatc

SEQ ID NO: 76429 - DNA, 873 bp, Zea mays
  misc_feature: Ceres CLONE 1561162
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
nnnnnnnnnnnnnnnnnnnnnnnnnnnnnnnnnnnnnnnnnnnnnnnnnnnnnnnnnnnnnnnnnnnnnnnggggnnnnnnnnaaaagctggagctccccgcggtggcggccgctctagaactagtggatcccccgggctgcaggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacgggccccgaaccgcgtggctctacctggggcccccgctgtccggccgccgcccccccaagcttaccctgaaccggggcgaagtttcccccggggccgaactaccggggctgggggaaaaaccccccccgggggggcttgtttcccgggcgggaaaaccccccgggaaaaaaacctttttttccccccccccaaaaaaaaaaaaccccccgggggggaaaaaaacccccttgggggaaaaaagaagggctcttaaatattttcccaccaaatttttcctccccccccccaattctttgtgggggggggggggcccccacaacaaaagggcccctttgggggggggggggcgcccccccccccccttttttttttgtgtgggggggggccccctttcttctcgccccacttttttttttttttttttccccccccccccccccgcgcgggggaaagaaaaaatttttttttttttttttttttcttccccccc

SEQ ID NO: 76430 - DNA, 792 bp, Zea mays
  misc_feature: Ceres CLONE 1561164
  misc_feature: Encodes the peptide sequence at SEQ ID NO. 76431
tccccgcggtggcggccgctctagaactagtggatcccccgggctgcaggaattcgtctcacccctagaaaaagttcttgaggggcaatcgcgaatcgcgctcctcgcggtagcggtcgattacccggctccgcccagatccgccgcggctgcgctccagttccctgtcgcgataccctggatttcgtccgtggcgagtggctaccgcttctgctccttttgtgacagctgaatctttgtggttcgaaggcgattgacttgggttcactgacgcggtgacgcccaatgagctcccacgtctccacatcgcggggtcttcatcccccaggcaagcttgggacgttggactcacccggtgcgtggcagccgccagcacctatggctcagcccgaagcaggccgcggtgatgaccaggaggtcaggctgttgtcggttgcttggaatcaggactgtggatgcttcgctgccggtaccagtaacggattcaggatctttaactgtgagcctttcaaggagactttcaggagggatctcaagagtggcgggtttgcgattgttgagatgctgttccgttgcaacgtccttgctcttgtaggtggcggctccaatgtgctgtacccgccgaacaaggtgatgatctgggacgatctccagagccgttgcattgggggagtttgcctttcgctctgatgtccgagctgtaaattagcaaaggactacatcgtgattgtcctcgagcgcaagatatttgtctacaacttcaccgattttgagctgctctaccagattgac

SEQ ID NO: 76431 - protein, 103 aa, Zea mays
  misc_feature: Ceres CLONE 1561164
MAQPEAGRGDDQEVRLLSVAWNQDCGCFAAGTSNGFRIFNCEPFKETFRRDLKSGGFAIVEMLFRCNVLALVGGGSNVLYPPNKVMIWDDLQSRCIGGVCLSL

SEQ ID NO: 76432 - DNA, 840 bp, Zea mays
  misc_feature: Ceres CLONE 1561165
  misc_feature: Translation starting site: 492
ctccccgcggtggcggccgctctagaactagtggatcccccgggctgcaggaattcgtctcacccctagaaaaagtttcgtgtgtctgaggatctcctgatctcctcctcccccctcccctgctccctccccatcgtcatccacctcctccacgcatcccctcctcgctcgctctctcgcggcttccctctcctcctctgacctgcgcatctgaagcatagatagcaagcaaggaccctgctcagtgctcacctcgccggaggtgctgctgctacggcggcggcggcgtactactactactacgacgagactctgcgcgcgcacaagcccacaggagtgcagaattgaccgcgcgcacgacgacgacgaccaccaacagcaacaggagagaggaggagatcgataagggatggagggcggcgagacgacgctgtccgggttcggcggtgccggggcccccggcgtggacaccaaggtgctgcacgcgttccatgaccagcttcgtgcaggtgcagacgctgctggaccagaaccgcctcctgatcaacgagatcaaccgcaaccacgagtccaaagtgcccggcgacctctcccgcaacgtgggcctcatcagggagctcaacaacaaaatccggcggcgtcgtcgacctatacgccgacctctcctcgcttcttcgccgcggccgacggcctgaggcggccagcgccgcgtccgagggagggtcccgtgggcaaccgtcccccaaccaggaggagcgccgggccacaaaaaggatcaggttccgggcctcgaactgaattttgttggccaggccatgttcttccttcgaaaggagaaaa

SEQ ID NO: 76433 - DNA, 857 bp, Zea mays
  misc_feature: Ceres CLONE 1561166
  misc_feature: Encodes the peptide sequence at SEQ ID NO. 76434
ggagctccccgcggtggcggccgctctagaactagtggatcccccgggctgcaggaattcgtctcacccctagaaaaactgctcatgctctccataaaatatagggaattatctactccccatcctctgaccaaataataggttctcgcacacggcagccggattccgaagcgcaccccctcggccccagccaaaaacatcgcagtttctggtcgtttggagagcacacaagaatgccgttcgtgcagctctctggtgctggagtcgctgcagtggccttcaagaacaagagcctagtctgtcggcacgcagcgctacgggtctgctcgtcgaggcgctcgatccgtagcctggtcattaaggctgcaactgtcgtcacccccaagtacacttcactgaagcctctgggagatagggtgcttgtcaaacttgttgccgccggaggagaagacgttggggggcattttgcttccatctaatggccagactaaacccccggggaggtgaaagtttttgccccttccaagaggaaaggaccatccggggacaaggaaaatccctggggggtttcgaagaggggaggcccaaagtaccttccccccaagaatgcctggcactggagggggaaattcaattgagcccggggggttttttatttcccaaaaaaaaaaacaacccccttggggttccctttaaaaaaggggattgttaaggagagggaaccccccccaaagaaacggggtctcctcccaaggttaaaaaagaccggaaaagaaaagtgccctgggggggatttttcccctccctaaaaacccccaagagaaaaacccctccttagaaaggggaaaaataccttc

SEQ ID NO: 76434 - protein, 81 aa, Zea mays
  misc_feature: Ceres CLONE 1561166
MPFVQLSGAGVAAVAFKNKSLVCRHAALRVCSSRRSIRSLVIKAATVVTPKYTSLKPLGDRVLVKLVAAGGEDVGGHFASI

SEQ ID NO: 76435 - DNA, 1003 bp, Zea mays
  misc_feature: Ceres CLONE 1561168
  misc_feature: Encodes the peptide sequence at SEQ ID NO. 76436
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (23)..(23): n is a, c, t, g, unknown, or other
  misc_feature (24)..(24): n is a, c, t, g, unknown, or other
  misc_feature (53)..(53): n is a, c, t, g, unknown, or other
  misc_feature (55)..(55): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (334)..(334): n is a, c, t, g, unknown, or other
nnnnnnnnncccccgggtataannaatgatctaaagcgatagggtgtggtgtntnaaaatataatttnnnnggtgggggggggtccccggggggggggcccctctgatggagctcaccgcggtggcggccgctctagaatagtggatcccccgggctgcaggaattcgtctcacccctagaaaaactcacactcccatccagccgccaccaggtgcagagtctttcgtcatctcttctccggcgaagaacccccagtcgcccaccagatcacttgttaaactttgttgaggggtgatggcggtttctttcgcaaacatcaactccgaagcaggncttaaaaagcttgatgagtaccttctcactcgcagctacatcactggctacccagctcccaagatgactgggttgtctacacttcgttttcggctgctccctcggccaagtatttcaccgtagcaaggggggtttaaccccctttgatgccccccgtgggggctgagccgaaataacccccaaagggccccagggggggaaagggttgaaatccctcaaaggtttccttttgggcccccaaattcccaaatgttgtttggaaaaacccaagggcccccaattgtgtgtggggggggggccccccccccccgcgaaaaggtttgacccccttttttttggtgggggggggggaccccccccaaaatttccgaaaaaaaaaagggggcgcccctcttataaaaagaagggggggttttttgttttttctccaagaaagagtgtttcttggggggggaaaaaaaaaaaaaaaaaatctggtggggggaaaaccccaccccccgtgttttcctcccccgcgggggggaaaaaacccccgggggggcgcctataataaaaaactcctaaaaagggccgcgcccccccccccataaagaaaaaaaatctttttaggggggggccccccccaccagaggagagagaggggtgttttcttgggtgggggggcacccc

SEQ ID NO: 76436 - protein, 53 aa, Zea mays
  misc_feature: Ceres CLONE 1561168
MAVSFANINSEAGLKKLDEYLLTRSYITGYPAPKMTGLSTLRFRLLPRPSISP

SEQ ID NO: 76437 - DNA, 819 bp, Zea mays
  misc_feature: Ceres CLONE 1561169
  misc_feature: SWISSPROT Homolog: EC 3.5.2.6 Beta-lactamase
ctggagctccccgcggtggcggccgctctagaactagtggatcccccgggctgcaggaattcgtctcaccgcgagacccacgctcaccggctccagatttatcagcaataaaccagcctgccggaagggcccagcgcagaagtggtcctgcaactttatccgcctccttccagtctattaattgttgccgaagacgctctatgtacccaattcgccctacaatgagtggctttacacgctctctcatgtccttctttgtccagctcgcgtctgggataccaatggcgctaggatgatttgtctgcctacacttcgtccccctttcgccagctcggcgcaatatctaaaacggcccggagcgcgatcgccccttcctaagatgttgctgctggaatgcattggccgaaatggaaaagctgaagggccctagggtcgtggatggggtaaaaatcccccccccaaattttctttgggaacaccccaacctccccaattttttttaagggagacaaagagggccccttttttgcccgtaccccccgggcccccattttccggggggattttttttacccccctttttttttgggggggttaaaaaaatcccctaaccaccggggagaaaaaaaaggggccttccaaaaatgggtaaaaaaaaaaggtggaccccccccccctttttgtgggggggggaaaaaaacccccttttgacaggggcgcccaaggggtccccccccccggggggggaaacccctccccgccccaaaaaaagaaattttttttttggggggcgcagaaaccctcccaaaaaaaaaacaa

SEQ ID NO: 76438 - DNA, 867 bp, Zea mays
  misc_feature: Ceres CLONE 1561170
  misc_feature: Encodes the peptide sequence at SEQ ID NO. 76439
ctccccgcggtggcggccgctctagaactagtggatcccccgggctgcaggaattcgtctcacccctagaaaagacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgcgagcgccggcgcaggggcatgcgccgcggggccacggcgctgcggcgcgcccgcagcgtcacggacgactacctcgacgagctccgcggctgcatcgacctgagcttcggcttctagccggcgcccgccgccgcgtgcgcctgcgcctgcgccgggaggaaccgcatcctggagacgctgcccgcgctcgacctctactacgccttccacgacgtgtgcggctgaaagcgcctcccatgctcgtgccagcccgctctttcttagacgtccctctccccaagaattccccggctcgggcagcccccatgttcctttcttctaccccaggcctactcgcccggaaaacaggggaacaaggcccctctaacgccattgccgccccaggtggcgttgcgccctttccattgccggaaccccccacctgaagcctctccggggcccatgggccgaccggcttccttttttggcttttgccgagggaagaaaaaaaaaaacccctttctggtgtgctcccctcacaaccccaagggaacggattccccccggcccgttcgcgccacgggcgtcaataaaccggcacgccttaacca

SEQ ID NO: 76439 - protein, 77 aa, Zea mays
  misc_feature: Ceres CLONE 1561170
  misc_feature (21)..(78): Pfam Name: DUF1685 Pfam Description: Protein of unknown function (DUF1685)
MEKAGQQRHVIGGGGKKAPALGLQKQNSWSPDIERDEACERRRRGMRRGATALRRARSVTDDYLDELRGCIDLSFGF

SEQ ID NO: 76440 - DNA, 898 bp, Zea mays
  misc_feature: Ceres CLONE 1561171
  misc_feature (260)..(260): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (273)..(273): n is a, c, t, g, unknown, or other
  misc_feature (291)..(291): n is a, c, t, g, unknown, or other
  misc_feature (293)..(293): n is a, c, t, g, unknown, or other
  misc_feature (315)..(315): n is a, c, t, g, unknown, or other
  misc_feature (541)..(541): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (568)..(568): n is a, c, t, g, unknown, or other
  misc_feature (573)..(573): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
ctggagctccccgcggtggcggccgctctagaactagtggatcccccgggctgcaggaattcgtctcacccctagaaaaagtcactcagtccctcgctcccggcctccctcgggtcgaccacacctcaccgccgcgtacctcgctccagtccagtcctacctggacggcctgccaacacaaccaagagggcatttctcagttctcaccatcgtcccatggcgtcgacggagatggagatgggcgtcgtaggcggcggcgntcannnatagcangttgggagggaaggcaancnttgcggcgggctggtggtgacngagctgagcacatcaaggagctggtgagcagctgggagtgcactcggcgggtccccggaactgtgcaagcaccctggccttcgcaaaaactttcttcccttcaaccagaggggcccccattggggggcctttttttttcccttcccgccaaacttgaaagggggcccgggggggggaaaacaaaaccccgggggggaaaaaccggggccctttccctcttgcgccnttttttnnnnnnncagccaggcagagnggagntgtgcccnnnnggaggcgtttttcgaacccccccagaaaaaaaaagggagggggggggggaaaaccccgggggggaaaaggggtgaactccctcccgcggggggaaaaaaccccgggggaaaaaagcgcgatatttgggggagaaaaaaccccccggagaaaaatacctcttgggaaaaaaaacccccgggggggggggttatctcgtgtgggaaccccccccccccctttccagggggggggcccgcgcggaaaaaaaaagaggggggggcccccccccccaagagaaacacccgcgggtgttaacccgggtggcttccccccg

SEQ ID NO: 76441 - DNA, 843 bp, Zea mays
  misc_feature: Ceres CLONE 1561172
  misc_feature: Encodes the peptide sequence at SEQ ID NO. 76442
  misc_feature (21)..(21): n is a, c, t, g, unknown, or other
  misc_feature (59)..(59): n is a, c, t, g, unknown, or other
  misc_feature (71)..(71): n is a, c, t, g, unknown, or other
  misc_feature (81)..(81): n is a, c, t, g, unknown, or other
  misc_feature (186)..(186): n is a, c, t, g, unknown, or other
ctccccgcgggtggcggccgnctctagaactagtggatcccccggggctgcaggaattncgtctcaccccntggaaaaaanaaaaaaaaaaaaaaaaaaaaaccccgcacccgccgccgacagggaacatccgccggccgagatcggctgcacatctgtgctgcttcagggcgccggaagttcgcngtcgtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctcccccaggggcgtatcctcctcctccaggggcatatcctcctccacctggggcatacccaccacaatatgggtaccctcagccaggtggctacccacctcaaggtggatatcctcctgcaggctaccccggctcatctcaccagggttatgggagcagccacggcggggggccacgggggccacatggggacgggggcaatgctagcggggaggtgctgccgcggcccgctgccgcttatgggagcacacaaggctttctcatgggccatagccggacaccggtggaacatggggggcctttgggaggctatggtccccggggggttaccgccccccggggtttggggggcccaccggcaaattttaaagccttgggccccgggcccccccccggggaaaagttaaaaaccccgggggaccgggaaaatttttaaaacatgtgggaaaaccccgggggccccggttttttttttctggcggggcgt

SEQ ID NO: 76442 - protein, 192 aa, Zea mays
  misc_feature: Ceres CLONE 1561172
MGGGKDKHDESDKGLFSNMMHGVAGGHGYPHQGYPPQGYPPQPGAYPPPPGAYPPPPGAYPPPPGAYPPQYGYPQPGGYPPQGGYPPAGYPGSSHQGYGSSHGGGPRGPHGDGGNASGEVLPRPAAAYGSTQGFLMGHSRTPVEHGGPLGGYGPRGVTAPRGLGGPPANFKALGPGPPPGEKLKTPGDRENF

SEQ ID NO: 76443 - DNA, 792 bp, Zea mays
  misc_feature: Ceres CLONE 1561174
  misc_feature: Translation starting site: 132
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (478)..(478): n is a, c, t, g, unknown, or other
  misc_feature (484)..(484): n is a, c, t, g, unknown, or other
acccgcggtggcggccgctctagaacttgtggataccccggggtggaaggattcgtctcacccctagaaaaaacagcagcatctatagcaaccggtccaacacttttacgctcaggcgctcagctctagcaatgggtggctccaccatggcgatctcctccacggcgatgggcggtacccccatcaaggtgggctccttctgcgagggccgcatcaccatgcgcaagaacgtgggcaagcccaaggtggcggcgtccggcagcccctggtaccgccccgaccacgtcaagtacctcgggcccttctccggcgagcccccgagctaactcatcggggagttccccggcgactacagctgggacaacgcccggctgtgccgcccactacgagaccttctcgcagaacacggagctggaggtgatccactcccgctgggccattctcnnngcgctcggctgcgtcttccccgagactcgtnccccgncacggcgtcaagttcggcgaggccgtctggttcaagggcggctcccagatcttcagcgagggcgggctggactaccttggcaaccccagcctgatccacgcgcagagcatcctcgccatctgggcctgccaggtcgtgctcatgtgcgccgtcgagagctaccgtattgccggcggggcgctcggcgaagtcatcaacccgctgtaccctggcgcagcttctaccccctcggcctgggcgacgaccccgagcctttcgcgagctcaaggtgaagagctaagaacggccgcctcgcatgtttccatgtt

SEQ ID NO: 76444 - DNA, 847 bp, Zea mays
  misc_feature: Ceres CLONE 1561175
aaagctggagctccccgcggtggcggccgctctagaactagtggatcccccgggctgcaggaattcgtctcacccctagaaaaaacacgcgccatctctgcagagagattactactatccaacagttctagatcaagacagaggaagactccccgcacagttagcatgctattaacttgcatgagcagcacgaatggcggcgacgcctcctctctcttgccttctcctcgccttgcttctagcatgagtggccgctgcgacgcgcttcgacgaagcggctgctgccggctctaggcttggaaatagctcggcctctttctcggagagtccacgagctagctcatgagatgagtcagccggagactacagctgggactccgccggagcttcatatgcacccactgacctctgccgagaactcgacagctggcatgtgatccactcacgagtcgagagtggtaactgagctaaggtgcaatctctgacaatctgctaatgcccaaacgtcttccattattcccaagcagatctggttgcatggccgaataccagatccttagcccgggccggaatggactacccttggccccacccgcatgatgacacccaaagaaaatccttgaattatagggccaggccagagcctgatcaatgggcctgcagcaaaggctaacccctttaccggaagggccgccctggaccagtaacccaaaccccggttccatggggggagcgcttaccaaaacctggagccttacccaaaaaccccaagccctttcccaaaacctaagggttaaaggagtcccccaacgtgggccctagccttttttttcaagtctaaaacgtt

SEQ ID NO: 76445 - DNA, 833 bp, Zea mays
  misc_feature: Ceres CLONE 1561178
  misc_feature: Encodes the peptide sequence at SEQ ID NO. 76446
  misc_feature (774)..(774): n is a, c, t, g, unknown, or other
ggagctccccgcggtggcggccgctctagaactagtggatcccccgggctgcaggaattcgtctcacccctagaaaaaagttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcagcggcgcgccggagggcagccggttggcggcggcgatggagctgcatcatcaggcgcagaaggaggctatggcgccgcagcaggctcaggctccgcccctcttcttggacttctcgcatggagattacggcggcgggaggaagcggcagcgcgaggcggagcccatgtcgtcgcagttcttctctctgcagcagcaaccgcaggcgcaggggcccaaggtgatcaacctggcgcaacttcagaagcggacggcgatgggcctccggctcgacttcgacgagggctcggagcacgtgtcgtgcacgtccccggcctcggcctcggcctcatgtctcctctctaaagagctcgccgcgcagcgcgatcagcacatgaacgagatggaccgggctgatccaggtacatgcgggacaggctccggggccgcgccggcccgacaatcgggggggggcactaccttttccctggtccggccccggcggaaggcgccgctgcctcaancgggtaaagggaaaagggaggcggaagccttcggaaaggccccccggggcccccccgga

SEQ ID NO: 76446 - protein, 206 aa, Zea mays
  misc_feature: Ceres CLONE 1561178
  misc_feature (187)..(187): Xaa is any aa, unknown, or other
MAVQAHYHHHYHRESPFLVSGAPEGSRLAAAMELHHQAQKEAMAPQQAQAPPLFLDFSHGDYGGGRKRQREAEPMSSQFFSLQQQPQAQGPKVINLAQLQKRTAMGLRLDFDEGSEHVSCTSPASASASCLLSKELAAQRDQHMNEMDRADPGTCGTGSGAAPARQSGGGTTFSLVRPRRKAPLPQXGKGKREAEAFGKAPRGPPG

SEQ ID NO: 76447 - DNA, 826 bp, Zea mays
  misc_feature: Ceres CLONE 1561181
  misc_feature: Encodes the peptide sequence at SEQ ID NO. 76448
ctccccgcggtggcggccgctctagaactagtggatcccccgggctgcaggaattcgtctcacccctagaaaaagcattctcgagccaggcaaatggaggcatgagctccgccggctccccgtctctcggcgatctcccccgaaccctagcctcgacctgaccgccagcgggcccgcaggccggagaaggagtcggagtcgcccccacccaccctctcctctgccgcgggcggggagcgggcggcggactagatgccgtcgcacggggatctggaccggcagatcgcgcaggctgacgcgactgctagtacctgcccgaggcggaggtcaaggcgctctgctagcaagccaaggccatccttatggaggaatggaacgtgcagcccgtgcgctgccccgtcaccgtctgcggcgacatccacggccagttctgtgacctcatcgagctcttccgcatcggcggcgactctcccgacaacaactacctgttcgtgggcgactacgtcgatcgtggctactattcagttgaaacagttgctctgttagtggctttgaaagtccgtgacagagatagagttacgatacttcgaggatatcgtaagagcagactaatcactcaagtgtactgcttctatgatgaatgcttaagacaatatggaaatgccaatgccatggaagtatatcacagacttgttcgattgtttgccgctcacagctactatagaatatgacgtcttctgtcttcatggaggcctctctccgtcgatgggacactttgggatcacatgcggttgtcatgatcgcatagagggaggtacctcatgaa

SEQ ID NO: 76448 - protein, 122 aa, Zea mays
  misc_feature: Ceres CLONE 1561181
  misc_feature (11)..(121): Pfam Name: Metallophos Pfam Description: Calcineurin-like phosphoesterase
  misc_feature: SWISSPROT Homolog: EC 3.1.3.16 Phosphoprotein phosphatase
MEEWNVQPVRCPVTVCGDIHGQFCDLIELFRIGGDSPDNNYLFVGDYVDRGYYSVETVALLVALKVRDRDRVTILRGYRKSRLITQVYCFYDECLRQYGNANAMEVYHRLVRLFAAHSYYRI

SEQ ID NO: 76449 - DNA, 875 bp, Zea mays
  misc_feature: Ceres CLONE 1561182
  misc_feature: Encodes the peptide sequence at SEQ ID NO. 76450
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (54)..(54): n is a, c, t, g, unknown, or other
  misc_feature (55)..(55): n is a, c, t, g, unknown, or other
nnnnnnnnnnccggggggggggggggnnnnnnngngggggggnngnngnngggnnggggggggggtccccgcggggggcgctctgactgtgaactggggctcccgacgggtggcggccgctctagaatagtggatcccccgggctgcaggaattcgtctcaccccctagaaaaaactccatcccggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaagttcctgccttgaaacgaaagatactgtcatccatgtccagaaggtctgttgctgcacacccttgggcatgatctggagatagggtcctgttgctccaaccataattcaactgcgtcaattgaaaatacaaaggggcagcaagggttaaatatgaaaccttgacaaaaaaaaccggggactgaaccaagggggaaaccggggggccggattttcacaaatttggtttaaccccccccaacaatttggggatttttttccccccccaaacacttttttggaaaaaaaaaagggggaccccccttgggggaaggcaccggggggtttaaaaaaaggggggagaaaccccttttttttcccccccggggggtgtttttcccccccggggggggagaagagggcacccccggccccttttttccccccctttattttttttttttcgggggggggggggggggggggaaaaaaaaaaaaaaatattcttttttggtgttcggggggggggcgcgcccctcttttaatatcaccccccccccacaaagaaggggggg

SEQ ID NO: 76450 - protein, 39 aa, Zea mays
  misc_feature: Ceres CLONE 1561182
  misc_feature: SWISSPROT Homolog: EC 3.6.1.1 Inorganic diphosphatase
MAPAVEAVKETGTFQKVPALKRKILSSMSRRSVAAHPWA

SEQ ID NO: 76451 - DNA, 859 bp, Zea mays
  misc_feature: Ceres CLONE 1561188
  misc_feature: Encodes the peptide sequence at SEQ ID NO. 76452
ctccccgcggtggcggccgctctagaactagtggatcccccgggctgcaggaattcgtctcacccctagaaaaaccaatcccctcccgccgcgtctcttcgccgccgttcctcgtgccccgttacctctgaaaccctagcggggagccggggatgaagatccagtgcaacgcgtgcggggccgcggaggcgcgggtgctgtgctgcgcggacgaggccccgctctgcgtcgcctggtacgaggaggtgcacgccgcctacaagctcgccgggaagcaccggcgggtgcctctcctgacggacgccgccttcgctgccgccgcggctgccccggccgtgcccaagtgcgacatctgacacgaggcttctggatacttcttctgcctagaggaccgtgcactactttgtagagactgtgatgttgctatacacacagcgaattcctttgtttcagtacatcagacattcctgctaactggagttcaggtgggtcttgatcctgctgatccagttccacctattgctgaaaagcacgttaatgctgctggtggatcagtgaatcaaccggtgagacatcagccatagagacgcccgacagtgcaattttcagtctgaaaggagtgctgtctgttcctactaaaaacgtagcgaatcggagattgttcaaaggcagaattctgtcgcaacagacatggggagaaatcgcttgattggactatggaatgatagtaccaattcggctcagtacgaatctcccgcctaactacatttgcagacgtaaagcccgacaccttctgcaatctagcccgaccaccaacggtctttctcccaccggacttgtgggcaaccgctgatggggg

SEQ ID NO: 76452 - protein, 67 aa, Zea mays
  misc_feature: Ceres CLONE 1561188
  misc_feature (1)..(47): Pfam Name: zf-B_box Pfam Description: B-box zinc finger
MKIQCNACGAAEARVLCCADEAPLCVAWYEEVHAAYKLAGKHRRVPLLTDAAFAAAAAAPAVPKCDI

SEQ ID NO: 76453 - DNA, 708 bp, Zea mays
  misc_feature: Ceres CLONE 1561189
  misc_feature: Encodes the peptide sequence at SEQ ID NO. 76454
ctccccgcggtggcggccgctctagaactagtggatcccccgggctgcaggaattcgtctcacccctagaaaaagaagagcatagagctagcaactagctcacttgatatacatatacacaggccggcatattgcatcggcataaaaactgaatttaccatggcccacctgatctcttctgcaatcgcaggcgcgggcaacttggtcgctgatggaatcagtggtgtcactggcgtagcgtcgcaggttgtagaaggcgtagaggacactttaggcagtatcgtagaagcaatcgaccaaggagtcaaggatgaggaccaactggacttgcccaagtacgtgtgtttcaagggagataacggtctgtaccttagtgctcggaaggttgaaggccatccctacctgcaatttgcatcggggagatattggcgaacccaagtgtgagggttcatcaccctacaacccacaaaggtgaacgggcaaaaccgggtgggtggcgccttcaaagtccaaacccaatctcggggcaaagttttctggggcgaaccaaaaccccccttaaaccggggaatccttgggggccccgaaaaaccccccgaaaccaaaaacccccccggggccccccttataaaaaaaaaacccttccccgaaaaaaaaccccctttttttgttttttcccgaagaaagcgcccttctcataatttttaa

SEQ ID NO: 76454 - protein, 94 aa, Zea mays
  misc_feature: Ceres CLONE 1561189
MAHLISSAIAGAGNLVADGISGVTGVASQVVEGVEDTLGSIVEAIDQGVKDEDQLDLPKYVCFKGDNGLYLSARKVEGHPYLQFASGRYWRTQV

SEQ ID NO: 76455 - DNA, 863 bp, Zea mays
  misc_feature: Ceres CLONE 1561190
  misc_feature: Translation starting site: 149
  misc_feature (407)..(407): n is a, c, t, g, unknown, or other
  misc_feature (493)..(493): n is a, c, t, g, unknown, or other
ctccccgcggtggcggccgctctagaactagtggatcccccgggctgcaggaattcgtctcacccctagaaaaagcgacgaactcatcactgcactggtggtgtccgtggtgctccacagagtgaagcgatagccaggagaggcgacgatgcgcaagtgggcgctctcctccgcgctcctcctcctctttctcctcaccacactccccgacccagctaagaagctacaagtgaatgccgaggagagcagcgatgacttggctaacccacccaaggtagaggagaagcttggtgctgtccctcatggcctgtccaccgactctgaggttgcccagagggaagccgagtctatctctaggaagactctcaggagctcagccgagaagtttgagttccaagctgaggttnccagactcatggacatcatcatcaactcactctacagcaacaagggatatcttcctgagggagctcatatctaatgcctctgatgncgttggataagattagggttcctttcccttactgataaggaaagtcctgggtggaaggggaccctgccaaagcttgggattccaaattaagttgaacaaaaaaaaaaaaacccccccatttcgggaaaagggggtttgggttgaccaaaggaaattcttttaaaaaccctggaacgatggctaaatcgggcccttccacttttggggaaaaaagccccggggggggcccccccatcctttgggaaccttgggggggggcctccaccgggggaactgggggggcgaccattgggaaaggggccccccccccacaaaaaaaaaaaggtgtgggggagaaaaaaaagggggggggcttcttccccccccgggg

SEQ ID NO: 76456 - DNA, 708 bp, Zea mays
  misc_feature: Ceres CLONE 1561195
  misc_feature: Encodes the peptide sequence at SEQ ID NO. 76457
  misc_feature (506)..(506): n is a, c, t, g, unknown, or other
  misc_feature (691)..(691): n is a, c, t, g, unknown, or other
  misc_feature (694)..(694): n is a, c, t, g, unknown, or other
  misc_feature (695)..(695): n is a, c, t, g, unknown, or other
ctccccgcggtggcggccgctctagaactagtggatcccccgggctgcaggaattcgtctcacccctagaaaaaaaaaaaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctggggcatgcttgccgtccccgggatcctggtgccggaagctctgggccctgggcaactgggtgaaagcccaaggagtgggcnggccgtcccccggcgggcaggccaacgtacctggggcgcccccgggtgccctggggggcaccccttgcccaaacaatcccgggggggatccaaatttccggggggcccatttgccccttttttccccgaaaaacccccaaggcgggcaccccctttggggaaaaaaaggagaccccccccccccngannaaaaaaaaataat

SEQ ID NO: 76457 - protein, 188 aa, Zea mays
  misc_feature: Ceres CLONE 1561195
  misc_feature (54)..(165): Pfam Name: Chloroa_b-bind Pfam Description: Chlorophyll A-B binding protein
  misc_feature (121)..(121): Xaa is any aa, unknown, or other
  misc_feature (183)..(183): Xaa is any aa, unknown, or other
  misc_feature (184)..(184): Xaa is any aa, unknown, or other
MVMASSSGLRSCSAVGVPSLLAPSSRSGRLAPFCANATTSGRVTMSAEWMPGQPRPAHLDGSSPGDFGFDPLGLATVPENFERFKESEVYHCRWGMLAVPGILVPEALGPGQLGESPRSGXAVPRRAGQRTWGAPGCPGGHPLPKQSRGGSKFPGGPFAPFFPEKPPRRAPPLGKKRRPPPPXXKKNN

SEQ ID NO: 76458 - DNA, 809 bp, Zea mays
  misc_feature: Ceres CLONE 1561197
  misc_feature: Encodes the peptide sequence at SEQ ID NO. 76459
ggagctccccgcggtggcggccgctctagaactagtggatcccccgggctgcaggaattcgtctcacccctagaaaaagtgagcctcagcacgacgggattgcgcccacacgcgacgccaaacgaaacagctagccagcccccattcttctccggctccggtgcattccgtgtcctgtcctgtcctgtcctgatggaagcagcaatggctgccacgtcctccctactccttgcctccggctccaggaggtggccagcaaccttgcgtcattccccctggccccagcagcagcgtctggttttctgcctcgctgcaagaacaacgccgctggacagcaagagaggcagctggaggcgctcttccagtgccaccggcggccggtcgaccgccgtctcgtcgtcgtcgtcatcggaaagatgggttctccaccctgcaagagacggtgactggcgacacatcggctacaaagtcgcgcgccctggggcgatcgagatagtctcggaggacacggcagtgaccgtgtgccgtgtcgccgacgaagcggacatcgtgctccccgtcgccacagtttcaggagctcacgctcggctggagaagaagggcaggagcctgctggtgacggacctggacataccaacggcacctacatcaacgagcgccggctgaacgctggcttccccgcgatcgtctaccccaggaggctactaatcttcggactgctgcatgcatgcatatcccaccgtcggtcatcagtaactgttagctcttgcatcaatcgatcgacctgcctctgtgtctactgcacgtga

SEQ ID NO: 76459 - protein, 157 aa, Zea mays
  misc_feature: Ceres CLONE 1561197
MEAAMAATSSLLLASGSRRWPATLRHSPWPQQQRLVFCLAARTTPLDSKRGSWRRSSSATGGRSTAVSSSSSSERWVLHPARDGDWRHIGYKVARPGAIEIVSEDTAVTVCRVADEADIVLPVATVSGAHARLEKKGRSLLVTDLDIPTAPTSTSAG

SEQ ID NO: 76460 - DNA, 783 bp, Zea mays
  misc_feature: Ceres CLONE 1561199
  misc_feature: Encodes the peptide sequence at SEQ ID NO. 76461
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
ctggagctccccgcggtggcggccgctctagaactagtggatcccccgggctgctggaattcgtctcacccctagaaaaaacccggctggagctcagcctcagctagcctggggaccgctgcacgaacagtagtccttcctcctcctataaagtaaccacacgacccgcctcctacccatccaccagcagctgaggtcgtcggccatggcggagcgggagcagcaagagcaggtggctagcgacgacgcggcggagtggaagcaggtggcggagctgagggccgtcacccaggcccaggacccttcctgcaaggatgaggacgactacacgctccggcgcttcctccgcgcgcgggaccacaacatcggcaaggcgtcggcgatgctgctcaagtaccctcaagtgggaagcccgcgggccaagcccccaggggggccttccccnnncccccgtaaggggggccccgggggggggcccggggaaactttccccgggggcccaaccggaggggccccccctttttagggttggggggggcaccccccgggggggggggacccaaaaataaaaggcctttttttccacctttttaaaacaccaggggggggggggcccccccccccccccgagaaagggcccccaaaaaatatccccccccccccccccaacccaccgggggggggggggcccccccccctatttttctgggggggggggggggggggggggccaaaattttgggagaagaagaaaccccgggggggggggcccccccccctttt

SEQ ID NO: 76461 - protein, 106 aa, Zea mays
  misc_feature: Ceres CLONE 1561199
  misc_feature (81)..(81): Xaa is any aa, unknown, or other
MAEREQQEQVASDDAAEWKQVAELRAVTQAQDPSCKDEDDYTLRRFLRARDHNIGKASAMLLKYPQVGSPRAKPPGGPSPXPRKGGPGGGPGETFPGGPTGGAPPF

SEQ ID NO: 76462 - DNA, 825 bp, Zea mays
  misc_feature: Ceres CLONE 1561201
  misc_feature: Encodes the peptide sequence at SEQ ID NO. 76463
  misc_feature (752)..(752): n is a, c, t, g, unknown, or other
ctccccgcggtggcggccgctctagaactagtggatcccccgggctgcaggaattcgtctcacccctagaaaaaagcacgccacacaccaccaccggacgctagctcaccaccaacctcagcacatcgaggagaagaggagtggccatggcttcgtcggtggccaccgcggcgagcacattcctgggcacccgcctggcggacccggcgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaagcccgtggagtacctgcagttcgaactggactcgctggaccagaacctggccaagaacgaggccggcggcatcatcggcacccggttcgagtcctccgacgtcaagtccaccccgctccagccctacagcgaggtgttcggcctccagcggttccgcgagtgcgagctcatccacggccgatgggccatgctcgccaccctcggcgccctcaccgtcgagtggctcaccggcgtcacctggcaggatgctggcaaggtggagctgggtggatgggtcctcctacctgggcccaagccgctgccgttcaccatctcgacgctcatcctggatcgaaagtgctttgtgatcggnctacatcggagttccagcgcaacgcccgagctcgacccgggagaagaggctgtaccccgggcggcttcttact

SEQ ID NO: 76463 - protein, 226 aa, Zea mays
  misc_feature: Ceres CLONE 1561201
  misc_feature (63)..(189): Pfam Name: Chloroa_b-bind Pfam Description: Chlorophyll A-B binding protein
MASSVATAASTFLGTRLADPAPQNGRIVARFGFGGGKPKAAVPKKVAKTSISSDRPLWFPGAVAPDYLDGSLVGDYGFDPFGLGKPVEYLQFELDSLDQNLAKNEAGGIIGTRFESSDVKSTPLQPYSEVFGLQRFRECELIHGRWAMLATLGALTVEWLTGVTWQDAGKVELGGWVLLPGPKPLPFTISTLILDRKCFVIGLHRSSSATPELDPGEEAVPRAASY

SEQ ID NO: 76464 - DNA, 991 bp, Zea mays
  misc_feature: Ceres CLONE 1561202
  misc_feature: Encodes the peptide sequence at SEQ ID NO. 76465
aagccgctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgtccacggcgccctcgctcacgctcaccggcaggaagaaggaggccgacaagctgcagacctccgacggctgggccaagttcaccgggggattcttcttcggcggcatctccggcgtgctctgggcctactttctcctctacgtgctcgacctcccctacttcttcaagtagaaatcatcaaagatgcgtatatatatagctccggccgatcctcctctctagctgcatggtatgtaggtggtgtggtccttgtttcatttcactccagcggtgatcagcgccgtgtataaatgtaattcctctgctttgcacatggatggattgggatgtaacctgttcaacttttttttaccttattggatgcatcattcagagctagtttgtcaaaaaaaaaaaaaaaaa

SEQ ID NO: 76465 - protein, 211 aa, Zea mays
  misc_feature: Ceres CLONE 1561202
  misc_feature (51)..(209): Pfam Name: PsaL Pfam Description: Photosystem I reaction centre subunit XI
MATAYAPMASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSVCLTMYGVASFNEGDPSTAPSLTLTGRKKEADKLQTSDGWAKFTGGFFFGGISGVLWAYFLLYVLDLPYFFK

SEQ ID NO: 76466 - DNA, 803 bp, Zea mays
  misc_feature: Ceres CLONE 1561203
  misc_feature: Encodes the peptide sequence at SEQ ID NO. 76467
ctccccgcggtggcggccgctctagaactagtggatcccccgggctgcaggaattcgtctcacccctagaaaaacgaggagaggttcaagaccggcaagaacaggtggttctttaccaaactccgcttctagacgtcgggcgtccctcatagtgtctgatctagttgtcaatttcttgtacctgaaaccctttaaggtatctctgttttgctatttccatgaaggcttcgtgcttggtatggatcttggagaggattttgttaaaaacatgtcgatgatattaaattatgccaaagcacacatatggttggattttgtggagaatcatccccgagctacaagaaaaagtaagccagacggaagacaacccgtcggcccctctcgtttttcatgcgccttcgcctccaaccgcgtgcgctccacgcctcctcgagaaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagatagagtctgactacagtcccaggtctgaaagaacgagttcagctataacaagatccctcaaggatctggaagaaggaattctgctgcaaggggtactggtagttcaggaaccaggagctaggccaggtcatttcagctgcaaagtgaccagcgccaga

SEQ ID NO: 76467 - protein, 43 aa, Zea mays; identical to SEQ ID NO: 55442
  misc_feature: Ceres CLONE 1561203

SEQ ID NO: 76468 - DNA, 798 bp, Zea mays
  misc_feature: Ceres CLONE 1561204
  misc_feature: Encodes the peptide sequence at SEQ ID NO. 76469
ggagctccccgcggtggcggccgctctagaactagtggatcccccgggctgcaggaattcgtctcacccctagaaaaaagcgccctcggcacgaccgccggattcgcctctcggtggggttggttttgtctccccccccaccctacccacccctctcctctcctccaaggcttggcttgcctcgtgccatgtgtccctccaccgcccgccatgccgactaggcttgccccccaccgccgatcgcacacgatggagaatggaagtggtgcggttgtaccttctaattcttcagataggtccgacaggtctgataaacctttggaccaaaagacaatgcgacggcttgcccaaaatcgtgaggcagcaagaaaaagtcggctgaggaaaaaggcatatgtgcagcagctggagagcagtaagctgaaacttgcacaactggaacaggaactccagacagctcgccagcagggaatcttcatttctagctctggagaccaaacccatgccatgagtggaaatggagctttgacttttgacatagaatatgctagatggctagaggacaaaataagcagaataatgagttgaggactgcagtgaatgctcatgcaagtgatagtgatctacgacttattgtagatgggcttatgggccactttgatgaaatattcaagggccaaagtgtttgctacaaaggctgatgtggttccaatactttcacggatggggaaaaaaccctgccgaaaagggcctcctattggcttggggggttttcccccattcgaaactttttaaaac

SEQ ID NO: 76469 - protein, 125 aa, Zea mays
  misc_feature: Ceres CLONE 1561204
  misc_feature (36)..(86): Pfam Name: bZIP_2 Pfam Description: Basic region leucine zipper
MPTRLAPHRRSHTMENGSGAVVPSNSSDRSDRSDKPLDQKTMRRLAQNREAARKSRLRKKAYVQQLESSKLKLAQLEQELQTARQQGIFISSSGDQTHAMSGNGALTFDIEYARWLEDKISRIMS

SEQ ID NO: 76470 - DNA, 802 bp, Zea mays
  misc_feature: Ceres CLONE 1561209
  misc_feature: Translation starting site: 372
  misc_feature: SWISSPROT Homolog: EC 3.6.3.14 H(+)-transporting two-sector ATPase
  misc_feature (734)..(734): n is a, c, t, g, unknown, or other
  misc_feature (802)..(802): n is a, c, t, g, unknown, or other
ctccccgcggtggcggccgctctagaactagtggatcccccgggctgcaggaattcgtctcacccctagaaaaaacacctccagtcctccactgacaagccgccgccgctcttacacctacctctccccggcctcgcacccatggccacggctttgatggttgcaaccaccacctcctgctccccgggccgcgccgcgccgcgcctgaagccggtggcctcctcctcctccagcagcagcagcaacagctcggagcggccgcggcggcccttggcgcagcaactcccgcgagctgctggcgacggcggcggcggcggcggtagcaaccgcgccgctcccggcgctggcggagcagatggagaaggccgcacatgtttgacttcaacctgacgctcccagcgatcgcgacagagttcctgctgctcatggtggcgctggacaagctctacttcacgccgctaggcaagttcatggatgagcaggacgccaagatccgcgtaatctcggcgatgtcaagggcgcctccgaggaggtgaagcagctggatgaccatgcggcggccatcatgaatgcggcgcgcgccgagatcgcagcagcacttaacaagatgaagaatgagaccacctgctagctggatgccaagctggactagggacgcagccgagtggaggccaatctcgtagagacgctcgccaagctcgaggcgcacaacgaggaagctgtcaaagcgctcnacacacagatcgcctcgctcagtgatgagatcgtcaagtacgtgctaccatccgcatgatgaaacgan

SEQ ID NO: 76471 - DNA, 836 bp, Zea mays
  misc_feature: Ceres CLONE 1561212
  misc_feature: Encodes the peptide sequence at SEQ ID NO. 76472
  misc_feature (575)..(575): n is a, c, t, g, unknown, or other
ctccccgcggtggcggccgctctagaactagtggatcccccgggctgcaggaattcgtctcacccctagaaaaactccttcaaccaggcggtcggcgccaccacgcccttcttcaccgccgtcttcgcctacgtcatgaccgtcaagcgcgagtcctgggtcacctacctcaccctcgtgcccgtcgtcaccggagtcatcatcgccagtggcggcgagcctagctttcatctgtttggattcatcatgtgcataggagcaactgcagcaagggcgttgaagacagtattgcaaggaattcttctgtcttccgatggggagaagcttaattctatgaatctgttattgtacatggctccaatcgctgttatcttcttgcttcctgcaactatctttatggaggataatgttgtcggcgttacaattgagcttgcaaagaaggatttcacgattgtttggttgctgttgttcaattcttgcttgtcgtattttgtcaatttgaccaatttcttggtgaccaagcatactagtgcactaactctacaggttctcggaaatgcaaagggtgccgtggncagttgtcgtctcgattatgatattcagggaatcccgtgtccataacaggaatgcttggttatactctcacagttttttggcgtcattctttacagcgaatccaagaagcgcagcaacaagccatgaacaccctaggagacagtagatatggggaatcattttctttgtccctgtcagcgcctaggagctatatatgatgagaaaatcacatcggtggcaacccacactattcctagtgcatacgtgcctcagcattggga

SEQ ID NO: 76472 - protein, 161 aa, Zea mays
  misc_feature: Ceres CLONE 1561212
  misc_feature (35)..(155): Pfam Name: TPT Pfam Description: Triose-phosphate Transporter family
  misc_feature (147)..(147): Xaa is any aa, unknown, or other
MTVKRESWVTYLTLVPVVTGVIIASGGEPSFHLFGFIMCIGATAARALKTVLQGILLSSDGEKLNSMNLLLYMAPIAVIFLLPATIFMEDNVVGVTIELAKKDFTIVWLLLFNSCLSYFVNLTNFLVTKHTSALTLQVLGNAKGAVXSCRLDYDIQGIPCP

SEQ ID NO: 76473 - DNA, 835 bp, Zea mays
  misc_feature: Ceres CLONE 1561213
  misc_feature: Translation starting site: 140
  misc_feature (579)..(579): n is a, c, t, g, unknown, or other
  misc_feature (605)..(605): n is a, c, t, g, unknown, or other
  misc_feature (606)..(606): n is a, c, t, g, unknown, or other
  misc_feature (739)..(739): n is a, c, t, g, unknown, or other
ctccccgcggtggcggccgctctagaactagtggatcccccgggctgcaggaattcgtctcacccctagaaaaacacagacacacaggtacgcaaggcacagcccaagaccaccgcaccgcacctgcacaccgccagggatggcggcaaccgcgcacctcaccggtgtcctcggcgtgtcgtcgccgcctctcgctccgtcccactgcagctgcagcggcgccaagaagcagagctgctctctgcgtcaggggcggcagcagaggaggcgcctccgcgtcgcccgcgccgtcgaggtggacgcgccttccgccggcgcaccggagccggaggaggcggaggagccgtccgtcgacttcgctttcgtcagcccgcggctgctgccggacgggacgccggacgtgcactaccggacggcgcgcggcgggcagaagctcagggacatcatgctcgacggctacatcgacctctacgggccctacgataaggttcttctcaactgctcaggggggcggcgtgtgcgggacctgcatcgtcgaggtggttgaaggcaaggaaatgctgtccccgaaaactgatngtggaaaaggagttgctcaaaaggannacccaaacgtgggagattggcgtgccaggcaacggtgggcaacgcagattcgactggacagatgatcattcaaaggttgcccggagtggaagatacacgagtgggaccaggtaggggttactggcttactggntcttgaagagtgctctcgtggccatactataaatttacatgcagtggaaatgggaaaaaaggaataagaagcagctgatcagtggaagagctggtg

SEQ ID NO: 76474 - DNA, 833 bp, Zea mays
  misc_feature: Ceres CLONE 1561214
  misc_feature: Encodes the peptide sequence at SEQ ID NO. 76475
  misc_feature (394)..(394): n is a, c, t, g, unknown, or other
  misc_feature (589)..(589): n is a, c, t, g, unknown, or other
ctggagctccccgcggtggcggccgctctagaactagtggatcccccgggctgcaggaattcgtctcacccctagaaaaagttcgtgttcggtcaaaacccaccgcgcgagcgcctccagagtccaaacccgctacaaatctcgcgctgcgcattctccccgtacgatacggcggcacggcccacgagccaggcggtggcggcagctagctagctgcggagtagcaccagccaccggagggaagtgggcggcgcgatgggggacgagccggacggggaggcggaggagtacctcttcaaggtggtgatcatcggcgacagcgcggtggggaagagcaacctgctgtcccgctacgcgcgcaacgagttcaacccccactccaaggccaccatcnggggtggagttccagacgcagagcatggccatcgaaggcaaggaggtcaaggcccagatctgggacaccgccggccaggagcgcttccgcgccgtcacctccgcctactaccgcggcgccttcggcgcgctcctcgtctatgacattacccgccgctccaccttcgacaacgtcggccgctggctccaggagctncacacacattcggacacgacggtggccaagatgctggtggggcaacaagtgtgaacctgggcgacatcccgccagggtgcccgtgggaggaaggctaaggcgcaagcccagggccgagggccctcttcttcatggaagacgtccggccttggacgccaccaacggtggagacgggccttccagatcgtggattccggagatcctacagcaacgtgagcccgcaagggtcctgaaactccgaact

SEQ ID NO: 76475 - protein, 74 aa, Zea mays
  misc_feature: Ceres CLONE 1561214
  misc_feature (1)..(75): Pfam Name: Ras Pfam Description: Ras family
MAIEGKEVKAQIWDTAGQERFRAVTSAYYRGAFGALLVYDITRRSTFDNVGRWLQELHTHSDTTVAKMLVGQQV

SEQ ID NO: 76476 - DNA, 803 bp, Zea mays
  misc_feature: Ceres CLONE 1561220
  misc_feature: Encodes the peptide sequence at SEQ ID NO. 76477
  misc_feature (544)..(544): n is a, c, t, g, unknown, or other
  misc_feature (686)..(686): n is a, c, t, g, unknown, or other
ctcacccgcggtggcggccgctctagaactagtggatcccccgggctgcaggaattcgtctcacccctagaaaaaaaaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagcgtgtcgctcgcatcctccgtgaagacgttctcggccgcgctggctctgtcgtcggtgcttctctcctcggccgccacctcccctccccccgcggccgccgacatcacggggctgaccccgtgcaaggagtccaaggcgttcgccaagcgcgagaagaactcgatcaagaagctcaccgcgtcgctcaagaagtacgcgcccgacagcgccccggtcctcgccatcaacgccaccatcgagaagaccaagcgcggttcgagaactacngcaaggtcggcctgctctgcggtgccgacggcctgcccgcactcatcgtcagcggcgaccagcggcactgggggcgagttcgtcaccccgggcctgctcttcctctaaatcggccgggtggatccggtggggtccgcaaggncttacctcatcggccgtccacggcgaaaaaaaaacccccccttggaggaaatttttcttcggacgtggaagtttgggaaacccggcttccttcccaagggggggttaatttgtgggc

SEQ ID NO: 76477 - protein, 164 aa, Zea mays
  misc_feature: Ceres CLONE 1561220
  misc_feature (49)..(164): Pfam Name: PSI_PsaF Pfam Description: Photosystem I reaction centre subunit III
MAALAASSTAAFAAKPRLPRARLTVACSATGGDGNGSSSSVSLASSVKTFSAALALSSVLLSSAATSPPPAAADITGLTPCKESKAFAKREKNSIKKLTASLKKYAPDSAPVLAINATIEKTKRGSRTTARSACSAVPTACPHSSSAATSGTGGEFVTPGLLFL

SEQ ID NO: 76478 - DNA, 712 bp, Zea mays
  misc_feature: Ceres CLONE 1561222
  misc_feature (285)..(285): n is a, c, t, g, unknown, or other
  misc_feature (296)..(296): n is a, c, t, g, unknown, or other
  misc_feature (353)..(353): n is a, c, t, g, unknown, or other
  misc_feature (358)..(358): n is a, c, t, g, unknown, or other
  misc_feature (466)..(466): n is a, c, t, g, unknown, or other
  misc_feature (468)..(468): n is a, c, t, g, unknown, or other
  misc_feature (469)..(469): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (684)..(684): n is a, c, t, g, unknown, or other
ctccccgcggtggcggccgctctagaactagtggatcccccgggctgcaggaattcgtctcacccctagaaaaaatctgcccagtcgctaattttgcttggctccgcgcccgcgcccggctcgtcgtcaatccacccacccatctactgcgccgaaggaacgcccagccgctccggcggcgtacgcggggagaggagaggagatgagacgaagtgcgacggggtgggcatgaggtgcaagaagcacccgtaccagagtcggcgggcggtaggcgtctgtgccacngtgcctccgcngtaccgcctggatcgccggctcgaaggccccgcgccaagaacgggcgacgcgtccgntcgtngccgccggcccggcggggggggcccgtggtttcccccaagggccggggggccccccttaactgtgtccccccccaagaaaaattttccgaaaaaaacctcttttctcnannaggggggggggcccggggtccccccctctggggggcccccccccccgggggggggggggtttttttttttttttgggggaaaaccccccccgggggggggggggggggcccccccccctccctcaggagagggggggggggggggggggcggtttttttgcgcggnnnnnnnttctnnnnngggtttttttttgtgggggggggagggagggccnccctttgtgggcgcgcccaacacaaaaa

SEQ ID NO: 76479 - DNA, 815 bp, Zea mays
  misc_feature: Ceres CLONE 1561223
  misc_feature: Encodes the peptide sequence at SEQ ID NO. 76480
caaagctggagctccccgcggtggcggccgctctagaactagtggatcccccgggctgcaggaattcgtctcacccctagaaaaacgcggctggttcagcacgcggaatagcctatcttcatgaagattgtcaccccagaataatccacagagatataaagtcctctaatattttgctggataataacttcgaagcactggttgctgattttggtcttgcaaggatagctatggatgcttgcactcatgtaactacacgagtgatgggaacttttgggtaccttgctccggagtatgcctcaagtggcaagttgaccgagagatctgatgtattctcatttggtgttgttctcttggagcttattactggtagaaagcctgtcgacgcgtcgaagccattgggcgatgagagccttgttgagtgggctaggccattgctcacgcaagcgctcgagaccggcaatgctggggagctggtggatgcccggcttaataggaactacaatgaagtcgagatgttccgtatggtcgaagctgctgcagcctgtattcgacattcagcatccaggaggcctcggatgagccaggttgtgcgggtgcttgatagtctcgccgaggtcgatctgactaacggcgttcagccgggcaagagcgagatgttcaatgtcgcgaacacggccgagatcaggatgtttcagcgggatggcgttcggcagcccaggatttcaggaacgatttcagccagtccagctggagcagccagagcagaggccttgacgcatctggttccaggccatttgtaccctcgtcgtcgt

SEQ ID NO: 76480 - protein, 195 aa, Zea mays
  misc_feature: Ceres CLONE 1561223
  misc_feature: SWISSPROT Homolog: EC 2.7.11.1 Non-specific serine/threonine protein kinase
MDACTHVTTRVMGTFGYLAPEYASSGKLTERSDVFSFGVVLLELITGRKPVDASKPLGDESLVEWARPLLTQALETGNAGELVDARLNRNYNEVEMFRMVEAAAACIRHSASRRPRMSQVVRVLDSLAEVDLTNGVQPGKSEMFNVANTAEIRMFQRDGVRQPRISGTISASPAGAARAEALTHLVPGHLYPRRR

SEQ ID NO: 76481 - DNA, 857 bp, Zea mays
  misc_feature: Ceres CLONE 1561225
  misc_feature: Encodes the peptide sequence at SEQ ID NO. 76482
ctccccgcggtggcggccgctctagaactagtggatcccccgggctgcaggaattcgtctcacccctagaaaaaatgacacgctctccatcgccacagaattgcgcctaagatggtactcttctccgcctcctcgtcctcaaccacctctgtcacggtgctctccacaaatgggcagccggcgtcgtactcattcctcggtggcaagacactgctgacacaaggcgatgcggaccggacgtcgttcctcctgcgcgccgcggcagaaccaaaaaggcttatctggttgtctgggaggacctctccgaagtgactcgacggcgaggttcccagcgacttcggctttgatccctgcggcctcggatgtgacccggatagcctgcagagcaacgtaccggcggatctggtgcaatgccggtgtgctatactcggatgcctggcgcatcttgatcccggaattactaaccaagatcggcgtcctaccactgcgattctggtacaccgcaccgcgagctaacagtacttcacttatacagcgaccttctctatgattcgagctcatgctcatctgctgggcctagggacaccgctgggccgacataagtcagccccgtaagcggcaacaccgacgccatgctatccaaggatgttgataaccggcactgtcgtcggtgtacaatgaggggctcttggtttgacccgctagacttgaggggagcggctcgtcggataaagatctaggaacggcgccacctcggagatcaacaacggacgcctctcccatgctcgccgttcatggtcatccttttttccgggccaaaagacaaaaaagcccgggggcctttggtaacaatatta

SEQ ID NO: 76482 - protein, 66 aa, Zea mays
  misc_feature: Ceres CLONE 1561225
MVLFSASSSSTTSVTVLSTNGQPASYSFLGGKTLLTQGDADRTSFLLRAAAEPKRLIWLSGRTSPK

SEQ ID NO: 76483 - DNA, 829 bp, Zea mays
  misc_feature: Ceres CLONE 1561226
  misc_feature: Encodes the peptide sequence at SEQ ID NO. 76484
  misc_feature (1)..(1): n is a, c, t, g, unknown, or other
  misc_feature (13)..(13): n is a, c, t, g, unknown, or other
  misc_feature (20)..(20): n is a, c, t, g, unknown, or other
  misc_feature (21)..(21): n is a, c, t, g, unknown, or other
  misc_feature (30)..(30): n is a, c, t, g, unknown, or other
  misc_feature (679)..(679): n is a, c, t, g, unknown, or other
nactaacggttgncctgganncctcgaccncgctggaagccgctctagatctagaggatcccccgggctgcaggaattcgtctcacccctagaaaaaacatgaggaacttgaagaagctgagattgtattggagcttattgaaaaagagaagtcagttcctaactttgttgagcataccaatgatacgatggtgcttgccatgccatcatatgaccgtgatggtagtgaggttaataaacggctccagcaaatccgggaaaatattcggtccctggaaaggtctaggctgaaagaggaaattacagcgcgcagacaaaagaagctgcttctaagacatgcccgtgaaaagtacctagaagattcttgctccagggaaacggagcttatgcaagagctcgacagggaaagagctctcgagatggaacgtgaagtagaaaggcggcggcgactggatattgagcgtgcaaagtctagggaactgcaattcaacattgatttggaaaaagagaaacaaactcagagagagcttcaacgcgaactggagcaagtcgagttggggcggtcatcaaagcgtgagttctctgccaaatccaacagccgctcccggggagaggtaccccgaaagggatggggggaggcaaaacaccaccaggaggcgggggagcctgaaggccttcnaagcagcccaaggcccgggagggggggctctggccaaaggagcccggaaacggggcgggggcggggcccccaaccgtgcattgctatcgcccggtgcaaaagaaaatttttctcggggggcccaaacctttgccaagggaattctgggct

SEQ ID NO: 76484 - protein, 213 aa, Zea mays
  misc_feature: Ceres CLONE 1561226
  misc_feature (164)..(164): Xaa is any aa, unknown, or other
MVLAMPSYDRDGSEVNKRLQQIRENIRSLERSRLKEEITARRQKKLLLRHAREKYLEDSCSRETELMQELDRERALEMEREVERRRRLDIERAKSRELQFNIDLEKEKQTQRELQRELEQVELGRSSKREFSAKSNSRSRGEVPRKGWGEAKHHQEAGEPEGLXSSPRPGRGGSGQRSPETGRGRGPQPCIAIARCKRKFFSGGPNLCQGNSG

SEQ ID NO: 76485 - DNA, 831 bp, Zea mays
  misc_feature: Ceres CLONE 1561227
  misc_feature: Encodes the peptide sequence at SEQ ID NO. 76486
ggagctccccgcggtggcggccgctctagaactagtggatcccccgggctgcaggaattcgtctcacccctagaaaaaaggaggggacggcgggtgccgaggcccgcatgcacggggaagctacctgcttgcgtagccgggcgggctcgcgctgtgctgtctctccatgtcggtcgccggctagagcggcggggatccggcggcggcacgcctcctgtgggatctctccaactagggccccgactgcactcccatgttgaagcaggctgtggaaatgtctacacatgacgaatcacgatggcagtctgcatctgccacacgaatggtgacactgatggatgtgaccacgctcctagtggccggcacgatgatgatagctcaaaaggccaagagctctcttcattcaacgaccctgatgtaggcagcgacacccgggtagacgagcgtgtaagtctagattcactgaagtcgactgttctttagacgtctgctaccacactgtcaccgagcttactcgcgaactgcgagctctcgacgtgagaagctcatcgaggtgtgagctcactagtagtctccttcgactgctcaaaggtcagctgcagctaaatggagggttgacgcatcccctcacccagtagcgatggaatcctgatgtcataggtaccatctatggcagggagggtggctcatgacctggtcgcccggtccgggcctgggcaagaaccctgccgtcctgggtcaacctgtttcaccgtacgtggtaaaggggctccatgtttctgtaaaaatccccccgaccttccccgatgcctccatatggctggaaggaaa

SEQ ID NO: 76486 - protein, 61 aa, Zea mays
  misc_feature: Ceres CLONE 1561227
MAVCICHTNGDTDGCDHAPSGRHDDDSSKGQELSSFNDPDVGSDTRVDERVSLDSLKSTVL

SEQ ID NO: 76487 - DNA, 765 bp, Zea mays
  misc_feature: Ceres CLONE 1561228
  misc_feature: Encodes the peptide sequence at SEQ ID NO. 76488
aaaagctggagctccaccgcggtggcggccgctctagaactagtggatcccccgggctgcaggaattcgtctcacccctagaaaaaaagatctctctcggccccgtgcccagcgctccgaaaccctagcgccgccgcgggtgccaggccgcgagcgtcgccatgggcatcgtgtttacgcggctcttctcgtcggtcttcggcaaccgcgaggctcgcatcctcgtcctcggcctggacaatgctggcaagaccaccatactctatagactgcaaatgggagaagtcgtctcccacgatccccggacattggatcaacgtcgagacgtgcagtacacaacatcaagtccaaagatggattctggtgtcaaacagcatcagccatactggcggggctacttccaaaactcaggctttaaaatttggtggttgatcaaagcatccaaaaaggcttggaaaccaaaaaaaaaatcccgggcctcccttgaggggagaaaaacttaaagggcgattttccctttgggttgcaaaaaaaaaagggtttttcccgggggccccccagaaagggcgccttttaaaaggctcttttaaacccccccaaattttaaacccccccagtggggggtttttttaaaaaacttcctaaaaaaaaggggaggggggggctccccaaaaggggggggggaggggcggcccaaaaaaccccccttaatttgtgggaagaacccacaagaggggcccccccccccccctcccaatataaaaa

SEQ ID NO: 76488 - protein, 113 aa, Zea mays
  misc_feature: Ceres CLONE 1561228
  misc_feature (5)..(114): Pfam Name: Arf Pfam Description: ADP-ribosylation factor family
MGIVFTRLFSSVFGNREARILVLGLDNAGKTTILYRLQMGEVVSHDPRTLDQRRDVQYTTSSPKMDSGVKQHQPYWRGYFQNSGFKIWWLIKASKKAWKPKKKSRASLEGRKT

SEQ ID NO: 76489 - DNA, 789 bp, Zea mays
  misc_feature: Ceres CLONE 1561229
  misc_feature: Encodes the peptide sequence at SEQ ID NO. 76490
ggagctccccgcggtggcggccgctctagaactagtgggatcccccgggctgcaggaattcgtctcacccctagaaaaacattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaagacttctcgccgcagtggtgggggactcatcaccaccacccgcctggttccgcgaccactggtcccgcgagcacgcccacctggacgagatagccgagcagctcgagttggtcgccctcccttgctacgatgaagatgaagaactccttctagggaaggaaggccccgccggccgccgccctttaaaacgattccggggcccagagggcttaaaacttgggttccccccaaaaaaggggggaaccccccccgggggggggtttcccgggagaaaaacccccgggccctcccggaaagagccgcaaccaaattatgcccgcgggggggccccccaaagaaaaggccccccccccccccgggttttcccaccccacccccccccccttaaggtgttcctgttggggcgggggcccccccta

SEQ ID NO: 76490 - protein, 56 aa, Zea mays
  misc_feature: Ceres CLONE 1561229
MSAVAVSSSLNPNAPLFIPAALLQVEDFSPQWWGTHHHHPPGSATTGPASTPTWTR

SEQ ID NO: 76491 - DNA, 883 bp, Zea mays
  misc_feature: Ceres CLONE 1561231
  misc_feature: Encodes the peptide sequence at SEQ ID NO. 76492
ctccccgcggtggcggccgctctagaactagtggatcccccgggctgcaggaattcgtctcacccctagaaaaactcccagtcccaggagcgtggcctcactctcctcgtcgcatcccctctcctcatcttcaaagcgcgggcggcggcaatggcgatggcctccacctacgcgccgggcggaggcgcgggggcgctcgcgcagggaagatgcagggtccgcggtcccgcggggctgggcttcctcggcccctccaaggccgccggcctcccccgccccctcgccctcgccaggcggacgagcagccccgtcgcggtgggcgccaggctgcgatgcgcggcgtcgtcgtcccccgcggcggcgcggcccgccacggcgccgcgcttcatccagcacaagaaggaggccttctggttctaccgcttcctctccatcgtgtacgaccacgtcatcaacccgggccactggaccgaggacatgcgcgacgacgcgctggaacccgccgacctcttcagccgccacctcacggtcgtcgacgtcggcggcggcacggggttcaccacgctcggcatcgtcaagcacgtcaacccagagaacgtcacgctgctcgaccagtcccctcaccaactcgacaagggccggcaagaaagaggcccctcaaaggggtcacccatcatggaaggggggacgccaaaggaacttccctttccccacccgacctccttcgaacccgatacattctccgcccgggaggcaatcgaaggtactgggccaagacccccccaacggggggggatcaatggaaaagccctttcaggggtccctggaaaatttttggagggggggccatacctcttggtgctgaaatcggggccccggtggt

SEQ ID NO: 76492 - protein, 244 aa, Zea mays
  misc_feature: Ceres CLONE 1561231
MAMASTYAPGGGAGALAQGRCRVRGPAGLGFLGPSKAAGLPRPLALARRTSSPVAVGARLRCAASSSPAAARPATAPRFIQHKKEAFWFYRFLSIVYDHVINPGHWTEDMRDDALEPADLFSRHLTVVDVGGGTGFTTLGIVKHVNPENVTLLDQSPHQLDKGRQERGPSKGSPIMEGGTPKELPFPHPTSFEPDTFSAREAIEGTGPRPPQRGGINGKALSGVPGKFLEGGPYLLVLKSGPRW

SEQ ID NO: 76493 - DNA, 543 bp, Zea mays
  misc_feature: Ceres CLONE 1561233
  misc_feature: Encodes the peptide sequence at SEQ ID NO. 76494
ctccccgcggtggcggccgctctagaatagtggatcccccgggctgcaggaattcgtctccccctagaaaaaacccacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcagcaagacgctgctgaggcaggccgaagcagcccggacgtcgttcgccgtgcgcgccgcgggcggattcccgacaaggcccgatcctggtttcccccgggcagccaccccccttccggcccggggggcttcggaaaggggaaggcccctttcccccggggagaaaactttccggggcttttttgaaattcccactgggggggggcccctcccggaaaattctttgaaaacccccctggaaaaaaaaaccccccgccccggggggggggggaaaaaaaaccccgtggtccccaagggggggggggg

SEQ ID NO: 76494 - protein, 141 aa, Zea mays
  misc_feature: Ceres CLONE 1561233
MALVSASSSSTTAVAALPRNGQQRASSSLFSSSSSSSFLVSKTLLRQAEAARTSFAVRAAGGFPTRPDPGFPRAATPLPARGASERGRPLSPGEKTFRGFFEIPTGGGPLPENSLKTPLEKKTPRPGGGGKKNPVVPKGGG

SEQ ID NO: 76495 - DNA, 768 bp, Zea mays
  misc_feature: Ceres CLONE 1561236
  misc_feature: Encodes the peptide sequence at SEQ ID NO. 76496
  misc_feature (677)..(677): n is a, c, t, g, unknown, or other
  misc_feature (703)..(703): n is a, c, t, g, unknown, or other
  misc_feature (715)..(715): n is a, c, t, g, unknown, or other
ctccccgcggtggcggccgctctagaactagtggatcccccgggctgcaggaattcgtctcacccctagaaaaaattgcactgcaccttcaccaatataatcaccatttctgttcacgcgatcgagaggcaaaattaagcatggtgtcccgaaggttcaagccgatcgagctgtgcgactccgaggggcggtcgcgccagacggtcgccgccgacctcgacggcacgctcctcctgtcccgcagcgcgttcccgtactacctcctcatcgcgctggaggccggtagcctccttcgcgcggtggcgcttctcttgtccgtgcccctcgtgtacctcacctacgtgaccgtgtccgagaccctggccgtgcgcgcgttcatctacgtcgccatggccgggctggaggcgagggacatcgaggccgtcgcccggtccgtgctccccagcttctacgccggcgacgtccacccggagggctggcgcgtgttccgctcgttcggcaggaggtgcgtcgtcaccgccagcccgcgcctcatggtggagccgttcgccaaggcgtttcttggcgcggacgtggtgatcgggaggaaaggttggaggtgggcccagtccgggaaggccaacggggttcgttgccggggcccgggggtgctcgtcggcgagcactataggcgggcngtgggcaagggagttcggcgactcgnctgccggactcnggcatggggggatcgcgagagcgacttcgacttcatgtccatctggcaggaaa

SEQ ID NO: 76496 - protein, 209 aa, Zea mays
  misc_feature: Ceres CLONE 1561236
  misc_feature: SWISSPROT Homolog: EC 2.3.1.15 Glycerol-3-phosphate O-acyltransferase
  misc_feature (188)..(188): Xaa is any aa, unknown, or other
  misc_feature (192)..(192): Xaa is any aa, unknown, or other
MVSRRFKPIELCDSEGRSRQTVAADLDGTLLLSRSAFPYYLLIALEAGSLLRAVALLLSVPLVYLTYVTVSETLAVRAFIYVAMAGLEARDIEAVARSVLPSFYAGDVHPEGWRVFRSFGRRCVVTASPRLMVEPFAKAFLGADVVIGRKGWRWAQSGKANGVRCRGPGVLVGEHYRRAVGKGVRRLXCRTXAWGDRESDFDFMSIWQE

SEQ ID NO: 76497 - DNA, 851 bp, Zea mays
  misc_feature: Ceres CLONE 1561237
  misc_feature: Translation starting site: 115
  misc_feature (605)..(605): n is a, c, t, g, unknown, or other
  misc_feature (809)..(809): n is a, c, t, g, unknown, or other
  misc_feature (816)..(816): n is a, c, t, g, unknown, or other
ctccccgcggtggcggccgctctagaactagtggatcccccgggctgcaggaattcgtctcacccctagaaaaagcacatcctcttgctgttgccgctcgctcgccgtgccgcaatggctacggccgtcgcctcccatacgttgctctcctccgccttcgctccgcgccactaccaccgccgcctgacccggaccgcgtccgtggggccgtgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgagaagacatggtatggttgttgatgtaacagacaagatcctaggcaggctagcatccaccattgcagtacatatcaggggaaagaatgaacccacttacactcccagtgtagacatgggagcttttgttattgtggtcaatgcagataaggttgctgtttctggtaaaaagcggtcacaaaagctttataggaggcactcccggaaggcctggnagggatgaaagaagaaacttttgaccaacttcagaaaagaattccagagagaatcattgaacaatgcggttcgtggcatgctcccccaagggaaggctggggaagaagattatttaccccacctcaaggtatacaaaagggacagaacatccgcacgagggctcaaaaacctggtccaactcccgatcagggattaaagatacnaaaaacnggatagagaattcatcgactggaaaagatgccgga

SEQ ID NO: 76498 - DNA, 1844 bp, Zea mays
  misc_feature: Ceres CLONE 1561240
  misc_feature: Encodes the peptide sequence at SEQ ID NO. 76499
actttttgctcctgtcgccgctttgggtcggggtttaagcgagtgttcagggaggccgggacggaggcgacgacgacggacggtgccggcgtcggaggagaagaaagaagaagtagccagctctcgtatatgccttcttgccccatctccgatctggtcgtcgtagcgctcatcgcccccgtcgtcgccggcctcctcctcctcctcctccgctccctcgcctgctccagccgatctatgcgcaaggggctcaacggatggaacaaatcctcgtcgatgctcagggacgggttcggggtcaagtattccggattcctccacatacggccgtgcggtttctgtagaggagactgacggattcgtcctcaaggccgtgccgtttctgtagaggaggctgacggattcgaccgatttgcgctcgtctccgttatatttttgcacccagagttttttttgttttttttcttcagaagcttttccccgtagttttggctggagttctccccggcagaggagatacaagagacatggccccgttgaaccaccaccagcatgtcctcctcaagaaggccctggcgaagaaacccaaagctaagcggatgtccaggtttggccttaaaccctccgctgaagccctcctgaagtcccgtccgcagcatccggcggcccagccgaggcgccgcgtccgggttctcttcgaggaccctgacgccacggactcggactccgacgacgaggaggccggcgcccctacgagcccggcggaggccaagcgcttctccttcgaggcgttcgtcggcaaggtcccagccaagccggtccttccggcggccgctgtcgccgcgtgcgccagtggcggggccccggagagctaccgcggagtgaggctccgcaagtggggcaagtgggcggcggagatccgcaacccgttcaccggcaagaggcagtggcttggcaccttcgacacggccggcgcggcgtccgcagcctacctatccgcttcccggagcttcgccgacgagaagcgccgccgccgcgggcagcccgtgccctcttcctcaccagttccttcggcaagcgccaccccgacggcctcctcttcgtcgtccacctcgactgccccgttcgcgcacccgtcgccgtcgtccgtgcttggacccgccaccaaggaggcgccgctgaacccgcagtccccggagctggtcgcgacaccaactcccgtcctgccgtccgatgagtctgcggagctgccggacgacccggagttctacaaggaccttctgcgcggcctgcagctgccagacatcagcccgatggacttccgtgccgggcttgacgctctggacgtctccgatgcgcccttctgcctggacgacgagcaggatctgctgcttggggacttcggggacgaggaactggagatcgacctcgacctcgacgatatcaacgacgtcttcccggagatgcctggctgcgacctcggccgcggcatggacgatttcctgcaaaccgttgatttctgcgtgtgaattaagtcagtgccttaatatgttagggttgatggtttgataagcgtgcttggaaggggggattgtcttgggtttttccctcgggcatttcagtctgctcgggcccaagatttctcttcttcccaaacagcacattagcttccggagaggtaattttgataggttacattatgttaagttatagtggtcgtgtttttctgttatttcgtaatgcttgtcaagacattatgaacaagtcattgagctgttactattggtgacgactactgtgcaagagagaagcttcttcgtgaataagaaaaaaaaaaaaaaaaa

SEQ ID NO: 76499 - protein, 333 aa, Zea mays
  misc_feature: Ceres CLONE 1561240
  misc_feature (114)..(165): Pfam Name: AP2 Pfam Description: AP2 domain
MAPLNHHQHVLLKKALAKKPKAKRMSRFGLKPSAEALLKSRPQHPAAQPRRRVRVLFEDPDATDSDSDDEEAGAPTSPAEAKRFSFEAFVGKVPAKPVLPAAAVAACASGGAPESYRGVRLRKWGKWAAEIRNPFTGKRQWLGTFDTAGAASAAYLSASRSFADEKRRRRGQPVPSSSPVPSASATPTASSSSSTSTAPFAHPSPSSVLGPATKEAPLNPQSPELVATPTPVLPSDESAELPDDPEFYKDLLRGLQLPDISPMDFRAGLDALDVSDAPFCLDDEQDLLLGDFGDEELEIDLDLDDINDVFPEMPGCDLGRGMDDFLQTVDFCV

SEQ ID NO: 76500 - DNA, 835 bp, Zea mays
  misc_feature: Ceres CLONE 1561241
  misc_feature: Encodes the peptide sequence at SEQ ID NO. 76501
ggagctccccgcggtggcggccgctctagaactagtggatcccccgggctgcaggaattcgtctcacccctagaaaaaaccagccgcgccgggggcccgagcgccccccgcagccggcggacgggatagccgtcccgcctcctgccgccgttgccccgtcggtggagcacctcgtggcggccgccgccgaggcggaggcgttgagtcgcttgggcgcggaacaacagcagctgctgcaggggcacgagcaggaggttggggaggaagaaggggaggacgaggaggaagacgagatggaggacgacgacgactacgacgatgagcaggaagggcagcacggcggcatcggtgtggagcacgttcccatggacgcagatgctgctgctgccgccgccgtggcggccgctggcgcgctgatggacccgcactcggtgttggtgcctgggaccgtgccacccatggcgaccaaacagctcaccctctcagtccggggcgaggctatgtattcgactctgtctcccctgatagggtcaagccgtgcttctgctgctttgaggcaaggacctgaattagccttaccggaacctcgtcctttgccccttattggtagagggttgactttcccactcggggggcttccctgaggaattttgggaaaaaccggaagggagcggaacttcttaaaaaaaacccggaaccaatccccgaaagaaattttcccttttggagtgccgggattaaggggggcttttttatttttcaaaccaaagggtgttgtaaaaaaacccccccaaaaagggcccggccaggggcttccttaaatgggggcccttct

SEQ ID NO: 76501 - protein, 116 aa, Zea mays
  misc_feature: Ceres CLONE 1561241
MEDDDDYDDEQEGQHGGIGVEHVPMDADAAAAAAVAAAGALMDPHSVLVPGTVPPMATKQLTLSVRGEAMYSTLSPLIGSSRASAALRQGPELALPEPRPLPLIGRGLTFPLGGLP

SEQ ID NO: 76502 - DNA, 1923 bp, Zea mays
  misc_feature: Ceres CLONE 1561243
  misc_feature: Encodes the peptide sequence at SEQ ID NO. 76503
gtttctataacacacaccttcgaattacattggctgctgttttttttttctttcttggaagaggattcaagttaactgctgctcttgtggagtaaggaaaatctaagcataagagacagtataataacaggctataaaagagcataataacggttagctggagcaaagataaaaagagagaaggaaactgtggccgggttgtaaatctactgtcagtttctacacagaattaagaaactttatgaaataaaaaaaatcgatcagtattagtattgaagagctaaccactcaatagatataggctgcgaagacaagctgtatcagtagttttgctataaataaagagagctgagagctacagtccactatccacccaagttcatgtttcagtgccatatatatggccatatctttccgtgattcgatcagcaaataaggctgctcgtttaccagtggacagcagtgggcagatcgatccatccacatgttgctcaccagcaccagcagcagcacgcactgtcatctggatgcgccagcgatctcatttcatgcatgcccaattaacttcccctgcagtagtctcgactgtctggttcaattctgtactatcctgatgatgatccgttattaggtgtcatcatgatcggtggctagcagaataagagatgataagcggcaacctcaacaatgaagagctggggggcggcgggtgcaccaaggccgaggggccggccgcggccgccggcgccggcgccgtcgtcgcaaaaagtcccgtgctgtcgagctcccggcactggccgccgtcgacggagtctaggatcgtgcgcgtgtcgcgggtcttcggcggcaaggaccggcacagcaaggtgaggacggtcaaggggctgcgcgaccggcgcgtgcggctgtccgtgccgacggcgatccagctctacgacctccaggaccggctgggcctcagccagccgagcaaggtggtggactggctgctcgacgccgcgcaggacgagatcgacaagctgcctccgctccagttcccgccgcaagggcaggacctcgtcgcccatctgccgccgtccatggtggcgcccttcgccaacgttgcagccgaccgggccgccgccgccgccgccgccgccgcgaacgcgtcggccgcgatggccgaaggcggcaaacgccactgccacggaggcatcaaagggctcatgggcatgggcctcaacaattctatcggcctcgccaacgccaccatgccgctggctcacggcttgtactacacgcccggtgagtcttggaccaatggcggcaatgccgccgtccatgatcatcaggtgagccacggcggcacttcgcctcagacggtggctcaccactcgccgttctcatctctgctgtctcttgctgctccggggccccagctcgtcttctactcgccggaaggcggcggcttcgccatgaaagaagcaaccgatcatcagttccctgtagatagcctcgatcactcgcaaggccagctctcactgagctcagctagaagcttccttcaccccggcaaccagggatgatattaggtcactgatctctactgctccaagaaggtacgtagaacaataaagcttggtgtagtagtaatcaagtactcgtttgaaggctccgtaaagcttgcaactgcagttttgagatgttattgtttggtatgatcgagtagaggggctctagcgtagagagctgctagcatgcatagtaattaaggttaattttgcaggacatgcaatgcaattcgttgcttcttttttatacaaggaagtaaccggtcatggggtgtgtggtgtgtgtgtgtgttggcaatgtaataacaattttataaagaaaaaaaaaaaaaaaaacgagacsctcgaggtacccaattccccctatagggcg

SEQ ID NO: 76503 - protein, 299 aa, Zea mays
  misc_feature: Ceres CLONE 1561243
  misc_feature (45)..(240): Pfam Name: TCP Pfam Description: TCP family transcription factor
MISGNLNNEELGGGGCTKAEGPAAAAGAGAVVAKSPVLSSSRHWPPSTESRIVRVSRVFGGKDRHSKVRTVKGLRDRRVRLSVPTAIQLYDLQDRLGLSQPSKVVDWLLDAAQDEIDKLPPLQFPPQGQDLVAHLPPSMVAPFANVAADRAAAAAAAAANASAAMAEGGKRHCHGGIKGLMGMGLNNSIGLANATMPLAHGLYYTPGESWTNGGNAAVHDHQVSHGGTSPQTVAHHSPFSSLLSLAAPGPQLVFYSPEGGGFAMKEATDHQFPVDSLDHSQGQLSLSSARSFLHPGNQG

SEQ ID NO: 76504 - DNA, 829 bp, Zea mays
  misc_feature: Ceres CLONE 1561244
  misc_feature: Encodes the peptide sequence at SEQ ID NO. 76505
  misc_feature (590)..(590): n is a, c, t, g, unknown, or other
  misc_feature (678)..(678): n is a, c, t, g, unknown, or other
ggagctccccgcggtggcggccgctctagaactagtggatcccccgggctgcaggaattcgtctcacccctagaaaaaaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtcngtgtgggaagcgctggtgctggaaatcgtgatgaccttcgggctggtgtacacggtgtacgccaccggcggtggaccccgagaagggncagcctgggcaccatcgcccccattgccatcggcttcatcggggggggcaacatccctgggtggggggggcctttgaaagggggcgttcttaaaaccccgccctggtccttttgggcccccgccctcgtaaaggttgggaagtgggggcct

SEQ ID NO: 76505 - protein, 193 aa, Zea mays
  misc_feature: Ceres CLONE 1561244
  misc_feature (13)..(193): Pfam Name: MIP Pfam Description: Major intrinsic protein
  misc_feature (169)..(169): Xaa is any aa, unknown, or other
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTGGQATGTFGLTGVSVWEALVLEIVMTFGLVYTVYATGGGPREGXAWAPSPPLPSASSGGATSLGGGGL

SEQ ID NO: 76506 - DNA, 833 bp, Zea mays
  misc_feature: Ceres CLONE 1561249
  misc_feature: Translation starting site: 176
  misc_feature: Pfam Name: START Pfam Description: START domain
ctccccgcggtggcggccgctctagaactagtggatcccccgggctgcaggaattcgtctcacccctagaaaaagccttcctccatccctcccccctaccctaccccccacacggccacacacacaccgccgcgtccgacccccacgccgtcgactgctcgaccggtcggctccgatggggtacgtgctgtcggcggtgggcagggtgctggagcagcccacggcgtggggggcggcctgggagatggcactcctcgcggggcccctgtgggcggcggccctcctcggcctgctgctcggctgggcctggcgcccgcgctgggcatccggcctcgtcgtcgccaccgcggacgacggcggtagccccgccgccgccgcgcagccgcccttcgccacgctcgacttctggaaggcccagctccccgcccgcctccgcgccccgctcggcaccgccgtgcagcagagggagggtgacacggacgccgtgcaacggaaccgcggaacggtggcgcttggcaggtcctcagagacggagacggcgacggtggctgtggggatggccgacctgatgaacctctggaggctggtggagggcgcgcacggcagcccggcctggaccaagatgatggagaagtcgctgcccaccatgacctacctggcgttggaggacggacgcccatgacgggcctccgcagtaccagagcatcagcatcttcgagaacgccagtccagaggaggtgagggacttcttcggggacgacaagctccggatgtccatcaggtgggacgacatgctcatctacacaagaacctggaggaatgccggacactgg

SEQ ID NO: 76507 - DNA, 773 bp, Zea mays
  misc_feature: Ceres CLONE 1561253
  misc_feature: Encodes the peptide sequence at SEQ ID NO. 76508
  misc_feature (495)..(495): n is a, c, t, g, unknown, or other
  misc_feature (682)..(682): n is a, c, t, g, unknown, or other
tggagctccccgcggtggcggccgctctagaactagtggatcccccgggctgcaggaattcgtctcacccctagaaaaagcactctcctgcgacgccacaaccacacgttcacggtagcgagagcttatcgtcgtcggcggtgaagatggtgtcgctgaagctgcagaagcggctcgccgctagcgtcctcaagtgtgggaaaggcaaagtctggcttgaccccaatgaagtcagcgagatctccatggctaactcccgccagaacatccggaagttggttaaggatgggtttatcatcaggaagcctcagaaggttcactctaggtcccgtgcaagaagggcacatgaggccaagcagaagggaaggcactctggatacggcaagcgcatgggtaccagggaggctaggctccccaccaagattctgtggatgaggaggatgcgtgttctgaggcgcctgctccgcaagtaccgtgaggccaagaagatcgacnagcacatgtatcatgacatgtacatgaaggtcaagggtaatatgtttaagaacaagagggtgcttagtgcagagtatccacaagtgcaacgcctgagaaggccagagtagacgacacttttctgatcagtttgaggccaaagcgtgcaaagagcaaggcaagcccgtgagaagaaacattgctaagnacggaaagaaaaagcttgccccaaggcccccaagagaacccaacagggacttgttggcagccccaggatcctttttaactggggttgccaa

SEQ ID NO: 76508 - protein, 152 aa, Zea mays
  misc_feature: Ceres CLONE 1561253
  misc_feature (2)..(150): Pfam Name: Ribosomal_L19e Pfam Description: Ribosomal protein L19e
  misc_feature (117)..(117): Xaa is any aa, unknown, or other
MVSLKLQKRLAASVLKCGKGKVWLDPNEVSEISMANSRQNIRKLVKDGFIIRKPQKVHSRSRARRAHEAKQKGRHSGYGKRMGTREARLPTKILWMRRMRVLRRLLRKYREAKKIDXHMYHDMYMKVKGNMFKNKRVLSAEYPQVQRLRRPE

SEQ ID NO: 76509 - DNA, 833 bp, Zea mays
  misc_feature: Ceres CLONE 1561255
  misc_feature: Translation starting site: 133
  misc_feature: SWISSPROT Homolog: EC 2.5.1.18 Glutathione transferase
ctccccgcggtggcggccgctctagaactagtggatcccccgggctgcaggaattcgtctcacccctagaaaaagcagctcaccgccacctccagcgctcgaagctcctcccgaaccggccgcatcgtcgccatgggagccgccgcttctgcaagctccgtgaaggaagtgctgccgtctcccctgacctccgcctccgagccccctccccttttcgatggcaccaccaggttgtacgtggcctatctttgcccgttcgcgcagcgcgcttggattgctagaaactacaagggtctgcaggacaagattaagatagttgccatcgatctcgctgacaggccagcgtggtacaaggagaaggtttatccacaaaacaaggtgccttctctagagcacgacaaccaggtgaaaggagagagcttggatttggttaagtacatcgacaacaacttctaaggtccatcgttgctccccgaggatcatgcaaagcagcagttcgctgaggagctgctcggatacactgacgcattcgacaaagcattttactcatgtttagtcgacagggaagatgtgtctgaggaagccgttgctgccttggacacatacaacacgccctgacggaatgcacgacggcccgttcttccttggccagttcaatctgggggacgttgcgtatgtaccgttcatcgagacgtttcagatactctattctaatttcagaactatgacatcccaaagggccgaccccggccttcgaaatttcttcgagaaatgaacaagatcccatgcggtaccgccgacttaacggggacccgcagttttttgcttgacca

SEQ ID NO: 76510 - DNA, 654 bp, Zea mays
  misc_feature: Ceres CLONE 1561258
  misc_feature: Encodes the peptide sequence at SEQ ID NO. 76511
  misc_feature (334)..(334): n is a, c, t, g, unknown, or other
  misc_feature (383)..(383): n is a, c, t, g, unknown, or other
ggagctccccgcggtggcggccgctctagaactagtggatcccccgggctgcaggaattcgtctcacccctagaaaaagttctcgcctcgtcgtccccaatcgtcgccgggagtctcccgatccttcttccaccacctcaccggtggtgtcagggccggctcgcggacggtgcttggactgcccccgtcccgtcatggatcgcgccgagctcaccaccgaacaggttctgaagcgagatattccatgggagcattacatgtcaactaagcttatctccggaacgtgccttcagcttttacggcgatatgaccacaaaccggagagccagcgagnctccttttgcttgaggaggatggggccagcatatatcccgagttttccntgaatatccctgccggagcatctccaaaggaaagagactgttgggaatacgtggcttgcaactcaattgatgaaaaatgcttgcaaacaaaattcctaaagcgtggcaagcacttggtttttatggaaccaaatctttttggtccggggggaaaaaatatttttattgaaaaaccggtttcctttaaaggggtttggtttatttgggaaaaaaggggccaaacctggggtttttttgttaccaaaaaaaaaaaaaaaaaagttgtggttat

SEQ ID NO: 76511 - protein, 63 aa, Zea mays
  misc_feature: Ceres CLONE 1561258
  misc_feature (47)..(47): Xaa is any aa, unknown, or other
MDRAELTTEQVLKRDIPWEHYMSTKLISGTCLQLLRRYDHKPESQRXSFCLRRMGPAYIPSFP

SEQ ID NO: 76512 - DNA, 803 bp, Zea mays
  misc_feature: Ceres CLONE 1561259
  misc_feature: Encodes the peptide sequence at SEQ ID NO. 76513
tggagctccccgcggtggcggccgctctagaactagtggatcccccgggctgcaggaattcgtctcacccctagaaaaaatagggattaccgccatcgtagcctgagtcgcaggtacagtcctgatgattacaagaagcgtgggagagacaggcatatgcacagaacatttgtttaattgttccatattgctggtttgcacttattcaccacatcatctgctgtgattatggacagtttgtctcctgcacgaagaagccctagtcatagccgcagccgcagttacactcctgatgattacaagaggcgtggcaaagacagcgcatcacctgcaagtaggagccctagtcgctcccctcctcgcaagacgccaccttctcctaagagatctcctgtcaggcacaatgatgaccggtctccacgctcacggagcccttcaacataagcacaattcacttgcaaagcatcttcaacagctcaggatgaatggacttgctctgatcctatgtgtgtgtggctatgcttgtgctcaatgttacatggagtgaagatatgctggctgatatgcggtcaacatgcacgtagcttactgttgaagttgatataatctgtgctgtttgcgttgttgatgatgatggctgatgaggtgatggaactgcagctgtctgcaccatttgctgctgtctgcacctattatgctgacaagtaagattccaatgatttagctgaattcagtggtccccatttttcgtgtcataaaatgcatggcaccacgaatcttgaatctacatgcttaggtattac

SEQ ID NO: 76513 - protein, 71 aa, Zea mays
  misc_feature: Ceres CLONE 1561259
MDSLSPARRSPSHSRSRSYTPDDYKRRGKDSASPASRSPSRSPPRKTPPSPKRSPVRHNDDRSPRSRSPST

SEQ ID NO: 76514 - DNA, 816 bp, Zea mays
  misc_feature: Ceres CLONE 1561261
  misc_feature: Encodes the peptide sequence at SEQ ID NO. 76515
ccgcggtggcggccgctctagaactagtggatcccccgggctgcaggaattcgtctcacccctagaaaaaatgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctgggtggctgatgagatagcggagcaggctggaattcttcttcctttcggaacgaacgacctggacgcagatgaaccttttgggtacagcaagggatgattgtgggggaaatttcatttcccgttctaatcttggctcaggggcatccctccaaaaatgaaccccctttcaaagggcccttggaaaccaaaaagggggaaatgggggccaaaccctgggggaaaaaatttttgcccacaaaaaaaaagggggccccccaaaaaagcttagggccccttaaactttgggagaggggggggggcaattttttgtgggggagaaaaaaaccggggggggggaaaagaaacccccttctccctccttggggggtggggccttttttttttattcaccaaagaagc

SEQ ID NO: 76515 - protein, 92 aa, Zea mays
  misc_feature: Ceres CLONE 1561261
  misc_feature: SWISSPROT Homolog: EC 2.7.9.1 Pyruvate, phosphate dikinase
MLGFRGCRLGISYPELTEMQARAIFEAAIAMTNQGVQVFPEIMVPLVGTPQELGHQVTLIRQVAEKVFANVGKTIGYKVGTMIEIPRAALGG

SEQ ID NO: 76516 - DNA, 887 bp, Zea mays
  misc_feature: Ceres CLONE 1561264
  misc_feature (438)..(438): n is a, c, t, g, unknown, or other
  misc_feature (824)..(824): n is a, c, t, g, unknown, or other
ctccccgcggtggcggccgctctagaactagtggatcccccgggctgcaggaattcgtctcacccctagaaaaaatccccccgatccaagaaaccggccaccgggccggagcgaacccttagaagcgaccttggcccgtgaggaagccaatcagccagagacagaacaatccatccaccatgaacagcctgttctcgagctcatgcttgcgcgacggaggggacatcgagtccagcggcatggagatgtctgctgcgccgggcgacgcggcgggcgccgaccctggacaggttccttcgagggacctggaagtccatcaaaggacgagctccggcaaacctggaagcccatcccgcgggtccgttccccccaaggccaacaagggggggaaaagtgaattgcccaaaaccgggggggcctttgggcgggccttccccnccccccgaattggaaaccggaaacttggccccccgccgcttattcaaaaaaagggcccaaagggggggggggaaaaacctccccccccctcaaaatttcctttggggaaaagcggccaaaaaaagcccccccaaaaaaaaggtgttcccttgttccccccggggtggggtggggggcccgcggtgttttttctttcttccccccgaaaattgtaccccccccggggaaattttctccttcttttttgtggggcggggggtgggtgtgccccaaaaaaaaaaaatatcccccgggggggagaacctttgttgggaggggagggcttttttcttttttttaaaccctcgcgcgggggggccccccccccggttttttttgggggcgcnaaaaataatttaccccggggggaaaaaaaaaaatttgggggcccccccgcgcgggggtttttt

SEQ ID NO: 76517 - DNA, 853 bp, Zea mays
  misc_feature: Ceres CLONE 1561268
  misc_feature: Encodes the peptide sequence at SEQ ID NO. 76518
  misc_feature (670)..(670): n is a, c, t, g, unknown, or other
  misc_feature (707)..(707): n is a, c, t, g, unknown, or other
  misc_feature (735)..(735): n is a, c, t, g, unknown, or other
  misc_feature (775)..(775): n is a, c, t, g, unknown, or other
  misc_feature (813)..(813): n is a, c, t, g, unknown, or other
  misc_feature (814)..(814): n is a, c, t, g, unknown, or other
ctccccgcggtggcggccgctctagaactagtggatcccccgggctgcaggaattcgtctcacccctagaaaaaacatcacctcagtatttgtcagaagctcaaatactgatctcactgatccagtatggctatggcaaaggcaggcgcgccgagggtctcggcggcccagctggtggctctcgggctagcgctcctctgcgctgtcgccggcccggccgccgcgcagaactgcggctgccagccaaacgtctgctgcagcaagttcggctactgcggcacgaccgacgagtactgcggcgacgggtgccagtcgggcccgtgccgctcgggcggcggcggcggcggcagcagtggcggcagtggtgcgaacgtggctagcgtcgtcaccggctccttcttcaacggcatcaagaaccaggccgggagcgggtgcgagggcaagaacttctacacccggagcgcgttcctgagcgccgtcaaggcgtacccaggcttcgcccacggcgggtcgcaggtgcagggcaagcgcgagatcgccgccttcttcgcgcacgccacgcacgagaccgggcatttctgctacatcagcgagatcaacaagagcaacgcctactgcgacccgagcaagaagcagtggccgtgcgccgcggggcaaaagtactacgggncgcgccccgctgcagatctcgtggaactaccactacnggcccgcgggggagggccatcggcttcnacgggctcgggaccccccgcagggtggcgcgggacccccntggtggcgtccaggcggcgctctggtctggataccaanncccaaagggggggtggcccccccagggttccggcccccc

SEQ ID NO: 76518 - protein, 242 aa, Zea mays
  misc_feature: Ceres CLONE 1561268
  misc_feature (86)..(239): Pfam Name: Glyco_hydro_19 Pfam Description: Chitinase class I
  misc_feature (33)..(66): Pfam Name: Chitin_bind_1 Pfam Description: Chitin recognition protein
  misc_feature: SWISSPROT Homolog: EC 3.2.1.14 Chitinase
  misc_feature (182)..(182): Xaa is any aa, unknown, or other
  misc_feature (194)..(194): Xaa is any aa, unknown, or other
  misc_feature (217)..(217): Xaa is any aa, unknown, or other
  misc_feature (229)..(229): Xaa is any aa, unknown, or other
  misc_feature (230)..(230): Xaa is any aa, unknown, or other
MAMAKAGAPRVSAAQLVALGLALLCAVAGPAAAQNCGCQPNVCCSKFGYCGTTDEYCGDGCQSGPCRSGGGGGGSSGGSGANVASVVTGSFFNGIKNQAGSGCEGKNFYTRSAFLSAVKAYPGFAHGGSQVQGKREIAAFFAHATHETGHFCYISEINKSNAYCDPSKKQWPCAAGQKYYGXRPAADLVELPLXARGGGPSASTGSGPPAGWRGTPXVASRRRSGLDTXXQRGGGPPRVPAP

SEQ ID NO: 76519 - DNA, 860 bp, Zea mays
  misc_feature: Ceres CLONE 1561270
  misc_feature: Encodes the peptide sequence at SEQ ID NO. 76520
ctggagctccccgcggtggcggccgctctagactagtggatcccccgggctgcaggaattcgtctccccctagaaaaaaacttgcgtagagagttgggcgcagagaatccccaagcaaacaaacagggtagagggagaggagaggagaggagacgagaggatagttgggtctgggacccatggctccgatgaagctgttcggggcggtgatgtcgtgcaacgtgacgaggtgcgcaacggctctggatgacgctggctcctactacgagatcgtgcccatctacttcgccaccgtcgagcattagagccccgagcacctggtcagcatcccgcttggtcaggttctagctctgctggatggtgacttgtaccctcttcaagtcacgaatcaatctgcaaagtcccctgcctcgcaataaccacgcccagagctggttgagggaatggaataccttctttggaccgcttcaaatggggggaatgtttttgtattcgaaagcctgttttcctaacccccttattcccgcctcccacttgatctccccaattccttttttcccgggccccctttccccattccccattttttttttggggggaaaccctccggaaaccaggggagggggtttgagacctttatttctcctttaagaaaaggccaaaaaaaaacgggggcgggaaaaggggtaaaatttggcgccaccccgcggggcccccgaaaagaagaaatttccccccttttgggggggaaaatttttcccgtgggccccctctttttttgtattcttaagacccccacttggggttttttttttaataattatttccccccccccctttttttttttaagcccctccat

SEQ ID NO: 76520 - protein, 41 aa, Zea mays
  misc_feature: Ceres CLONE 1561270
  misc_feature: SWISSPROT Homolog: EC 2.5.1.18 Glutathione transferase
MAPMKLFGAVMSCNVTRCATALDDAGSYYEIVPIYFATVEH

SEQ ID NO: 76521 - DNA, 773 bp, Zea mays
  misc_feature: Ceres CLONE 1561275
  misc_feature: Encodes the peptide sequence at SEQ ID NO. 76522
  misc_feature (765)..(765): n is a, c, t, g, unknown, or other
agctccccgcggtggcggccgctctagaactagtggatcccccgggctgcaggaattcgtctcacccctagaaaaaagccatccccttttgctgcaaatctttacatgaattgtgggtctccaacaatggcggcgctcgctccatccaaaattctgggaacccagctcaacttcgcgggctcctcccactactccaccgaatcgcccaccgcgagggctcacaagattgtctcccttttcaccaagaagcctgcccaaaagcccaagcccgctgcggtatcgtcctcttctccagacatcagctacaagctcaccaagtggtatggtcctgacaggaggatctacctgccagatgggctgctggaccgatccgaggtgccggactacctcaccggagaagtccctggatactatggctaccacccttttggcctgcgcaagaagccagaggacttcaccaagtacatggcctacgagctgatccatgccatatgggccatgctcggtgccgctggcgctgtcatcccagacgcctgcaacaagttcggatctaactgtggccctgatgctgtctggttcaagaccggcgcgctgctcctggacggcaacaccctcaactacttcggcaacaacatccccagcaacctggtggtggccgtgatcgcagaggtcatcctcttcggcggcgcccagtactaccggatcaccaacagactggaccttgacgtacagatgcacccccagggagcccttcaaacacctgtncatggtca

SEQ ID NO: 76522 - protein, 215 aa, Zea mays
  misc_feature: Ceres CLONE 1561275
  misc_feature (83)..(207): Pfam Name: Chloroa_b-bind Pfam Description: Chlorophyll A-B binding protein
MAALAPSKILGTQLNFAGSSHYSTESPTARAHKIVSLFTKKPAQKPKPAAVSSSSPDISYKLTKWYGPDRRIYLPDGLLDRSEVPDYLTGEVPGYYGYHPFGLRKKPEDFTKYMAYELIHAIWAMLGAAGAVIPDACNKFGSNCGPDAVWFKTGALLLDGNTLNYFGNNIPSNLVVAVIAEVILFGGAQYYRITNRLDLDVQMHPQGALQTPVHG

SEQ ID NO: 76523 - DNA, 1029 bp, Zea mays
  misc_feature: Ceres CLONE 1561276
  misc_feature: Encodes the peptide sequence at SEQ ID NO. 76524
aagcacgcacttgcaaagaactcgagagcttgattcaatcataccctacactgccatggagtccagcaggatgcgctgctgcatgctgcttgttgtttccttggctctgctgctcccgctgggcatggccgcggactccatcggcagctactgctcaggaagcagctacgctggcagcagcaaggccgtggccaacatcaactccgtcctcgccgacctcgtcgcctcggcctcctccaccgggggctacgccacgtccaccgccggcaagggcaacagcatcatctacggcctcgcgcaatgccgcggcgacgtctccgccagcgactgcgcgtcctgccttgccgacgccgccaagcagctccccagcacctgcagctacagttccgacgcgaggatatggtacgactactgcttcatgcggtacgagaacgccaacttcttcgggcaggcggacacggacgcgggcgtgatcctggtgaacgtgcaggccatggacaacccgaaggcgttcgagaaggcggtggggaaggtgatgggcaaggcgacggcgcaggcgtcggcggcgggcagcgcggggctcgggcgggacaaggagcagtacacgccgttcgtgtccatctacgggctggcgcagtgcacgcgggacctcacgccgctgacctgcgcgcagtgcctgtccacggcgctgtccaggttcggcgactactgcggcgcgcagcagggctgccagatcaactacagcagctgcagggtgcgctacgagatctaccccttctacttcccgctcgccggcaagggcggcggcctcgccaccaccgacatgacgaagaacaccaagatcgtcgtgcgtccttaattagcctgaagtgacttgtgtgccttaacgtagggtaaagtagccttgcgttagctagcaataaagatgtgcaactgtatgtgttaagagcttatgcagtgtaagtacatctctgcgtcgaagcaatagtattgatatgttaaactaaaaaataaaaaaaaaaaaaaaaa

SEQ ID NO: 76524 - protein, 267 aa, Zea mays
  misc_feature: Ceres CLONE 1561276
  misc_feature (77)..(131): Pfam Name: DUF26 Pfam Description: Domain of unknown function DUF26
  misc_feature (189)..(243): Pfam Name: DUF26 Pfam Description: Domain of unknown function DUF26
MESSRMRCCMLLVVSLALLLPLGMAADSIGSYCSGSSYAGSSKAVANINSVLADLVASASSTGGYATSTAGKGNSIIYGLAQCRGDVSASDCASCLADAAKQLPSTCSYSSDARIWYDYCFMRYENANFFGQADTDAGVILVNVQAMDNPKAFEKAVGKVMGKATAQASAAGSAGLGRDKEQYTPFVSIYGLAQCTRDLTPLTCAQCLSTALSRFGDYCGAQQGCQINYSSCRVRYEIYPFYFPLAGKGGGLATTDMTKNTKIVVRP

SEQ ID NO: 76525 - DNA, 810 bp, Zea mays
  misc_feature: Ceres CLONE 1561278
  misc_feature: Encodes the peptide sequence at SEQ ID NO. 76526
ctccccgcggtggcggccgctctagaactagtggatcccccgggctgcaggaattcgtctcacccctagaaaaatcttttttctccaaaccatcgtcggctgcggcactcctgaagggaggaagccccaagcccttgccgccgcagctgccgcagccagcaacgaaccgtacataggcagggacgaagcgatggagggagccaatggagtcggtgggtcggagtccgagcggaagccgctgtcagaggtggtcggcgactgcgtccagcgctggttccaggacgcgtacaaggaggcgcgcaaaggagacatcgccaaccaggtgcttgtagcgcagatgttcttctcgggttatgggacccccaagaacgagtacaagggaaaacaatggatggatagagcatcaaggttcaggtcttccgctttgaaggttggcatgaaacgtccaggatacaatgcaagtgactcagactctgatgacgatgcatatgatgacgccaaccaataacactcaattacaaattgagttattagttaagagattcacagggaagggacccaattacataacaccactatattcagaactgcgcatcaggttgacgaagaaaaaggtttccagcgccctccaaagtccccctggagccatggaggatttcctttgaacgtccgcgggctttcaaatcgggccccccgttgggggggccttccaaaaccttggaggggaaaaaaaaccccataaccccctccacccttttttggcggggctcaaccccccccggggggggggagaaaccttcccaggggaaa

SEQ ID NO: 76526 - protein, 105 aa, Zea mays
  misc_feature: Ceres CLONE 1561278
MEGANGVGGSESERKPLSEVVGDCVQRWFQDAYKEARKGDIANQVLVAQMFFSGYGTPKNEYKGKQWMDRASRFRSSALKVGMKRPGYNASDSDSDDDAYDDANQ

SEQ ID NO: 76527 - DNA, 847 bp, Zea mays
  misc_feature: Ceres CLONE 1561279
  misc_feature: Encodes the peptide sequence at SEQ ID NO. 76528
ctccccgcggtggcggccgctctagaactagtggatcccccgggctgcaggaattcgtctcacccctagaaaaatcttttttctccaaaccatcgtcggctgcggcactcctgaaagggaggaagccccaagcccttgccgccgcagctgccgcagccagcaacgaaccgtacataggcagggacgaagcgatggagggagccaatggagtcggtgggtcggagtccgagcggaagccgctgtcagaggtggtcggcgactgcctccagcgctggttccaggacgcgtacaaggaggcgcgcaaaggagacatcgccaaccaggtgcttgtagcgcagatgttcttctcgggttatgggacccccaagaacgagtacaagggaaaacaatggatggatagagcatcaaggttcaggtcttccgctttgaaggttggcatgaaacgtccaggatacaatgcaagtgactcagactctgatgacgatgcaaatgatgacgccaaccaataacactcaattacaaattgagttattagttaggagattcacagggagggacccaattacatacccacactatattcaagacatgcgcatcaagttgacgagtataaggtttccagcgccttctaagtcactcttggagccatgaggtattcgttagcacgtccgcggtcttccatcgggtcctcggtgtgtggccttcgaaatccttgatggacaagacaaccataaactcaatcaactatattgacggatctaactcccatggggggggaagacttcacgggtagacctcatgaaccttcgagtgaccctgccatccaataggaatgaagccctaacaa

SEQ ID NO: 76528 - protein, 105 aa, Zea mays
  misc_feature: Ceres CLONE 1561279
MEGANGVGGSESERKPLSEVVGDCLQRWFQDAYKEARKGDIANQVLVAQMFFSGYGTPKNEYKGKQWMDRASRFRSSALKVGMKRPGYNASDSDSDDDANDDANQ

SEQ ID NO: 76529 - DNA, 748 bp, Zea mays
  misc_feature: Ceres CLONE 1561282
  misc_feature: Encodes the peptide sequence at SEQ ID NO. 76530
  misc_feature (547)..(547): n is a, c, t, g, unknown, or other
  misc_feature (548)..(548): n is a, c, t, g, unknown, or other
ctccccgcggtggcggccgctctagaactagtggatcccccgggctgcaggaattcgtctcacccctagaaaaaatcgcgatttcccctcgcagtctctcgcacgcgccggcatggcgacgctcgcgcggtggcatctacaacctcctactgcccgccccctcgctcaccggcggaggatcccgcgtcgggctgcgaccgtggtttccccgcgcgcgttcagccgcgcggacttcgatggcttcgtgcggcgcgcgtggcagggcgccaacgcgggggccgagcgcttcgccttcgaggcacggcaggccgcgcagcggctggacagcaggttctcgatctcccggaggctcgcggacgcttcccgtgccgcccgcgcccgcgccgttgagatcgacgccgagttcggcatcgggcggcggtggcgctcccttctctgtcgacttcctccccgcatttggccccaggtatcggaagggacatcaattgactttctggggaaacccccccatccggggagaagcaattaacctaccaatatttttttnncccccgggggggtttaaaccccccttcccgggggggggggtgtttcaaaaaatttttttttttttttggccccctttgttgggggccccttttttttggggcgccccctttttttttttgggggggccctttttttaaaaagaggggggggccccctttttggggaagaaaaaagggccctcctttttttttattttttt

SEQ ID NO: 76530 - protein, 138 aa, Zea mays
  misc_feature: Ceres CLONE 1561282
MATLARWHLQPPTARPLAHRRRIPRRAATVVSPRAFSRADFDGFVRRAWQGANAGAERFAFEARQAAQRLDSRFSISRRLADASRAARARAVEIDAEFGIGRRWRSLLCRLPPRIWPQVSEGTSIDFLGKPPHPGRSN

SEQ ID NO: 76531 - DNA, 813 bp, Zea mays
  misc_feature: Ceres CLONE 1561284
  misc_feature: Encodes the peptide sequence at SEQ ID NO. 76532
  misc_feature (540)..(540): n is a, c, t, g, unknown, or other
  misc_feature (600)..(600): n is a, c, t, g, unknown, or other
ctccccgcggtggcggccgctctagaactagtggatcccccgggctgcaggaattcgtctcacccctagaaaaacttttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggcccccgtgaggatgccacccgtattggtnccgctggtgttgtgagaaggcaggccgtggatatctcacccctgaggaaggtgaacaggncatctacctcctcaccactggtgccagggagagtgctttcgggacatcaaaacattggccagtggcttgcagatgagctgatcaacgctgccaagggctcattccaacagtacgccttccagaagaaggacgaaaattgaaccgggtggccaagccaaacggtgaacgggacctttgtatccggggggcactctgcgccggggaaactttaag

SEQ ID NO: 76532 - protein, 190 aa, Zea mays
  misc_feature: Ceres CLONE 1561284
  misc_feature (44)..(191): Pfam Name: Ribosomal_S7 Pfam Description: Ribosomal protein S7p/S5e
  misc_feature (125)..(125): Xaa is any aa, unknown, or other
  misc_feature (145)..(145): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGXAGVVRRQAVDISPLRKVNRXSTSSPLVPGRVLSGHQNIGQWLADELINAAKGSFQQYAFQKKDEN

SEQ ID NO: 76533 - DNA, 854 bp, Zea mays
  misc_feature: Ceres CLONE 1561285
  misc_feature: Translation starting site: 292
  misc_feature (682)..(682): n is a, c, t, g, unknown, or other
ctccccgcggtggcggccgctctagaactagtggatcccccgggctgcaggaattcgtctcacccctagaaaaaatgcaaatagatcccactcatacactccagtagctagtagtagtcgacccatctgcatctgtatgtgtgcttgcccccggccggccacctttccggccgatccatcatctagagctagctagctcatcatcagtctttcgcgtgtgtgtatgtatatggtggtgaccagagcagctagctagctaggagcagggtggttgttctatagttcgttcctatggttatggtggcggcggcggcggtactgctcgctctggccgccgtggcgacggaggtggccgcggcagggacgacgtacacggtgggcgcgccggacgggctgtgggacatgcagaccgactacgcgcagtgggtgaagagcaagaccttccgccccggcgacaccatcacgttcacgtactcgccggagctgcacgacgtggtggaaggtgacgagggccggctacgatgcctgctccagcgccaacaacatctccgccttccgcaccggcaacgacgccgtgcccctcaccgccgtcggcacccgctacttcctctgcggcctcacgggccactgcggcaacggcatgaaatcccgccgtcgacgtcgtcgccgccgcgggcctcgnccgtccgcgccggggccccgccgcttgccgccgcgtcgccgccgaacgacctcgtcgccctggcaaacgtcgggagtcgtcgcccgccctcgctactaactgcttctgcctgaacgcccgtcgtcaagctactagctttcccacccgttgcgcttggagttttttgtaatgt

SEQ ID NO: 76534 - DNA, 848 bp, Zea mays
  misc_feature: Ceres CLONE 1561286
  misc_feature: Encodes the peptide sequence at SEQ ID NO. 76535
  misc_feature (330)..(330): n is a, c, t, g, unknown, or other
  misc_feature (601)..(601): n is a, c, t, g, unknown, or other
ctggagctccccgcggtggcggccgctctagaactagtggatcccccgggctgcaggaattcgtctcacccctagaaaaaatctgccgtccctgcactgcgcttataccctgcaggcaacagcagcgatggcggcgagggtaccggcggccgatctcaaccagcacctctcctcgccgttcatcgcacggcgctgccacggcccaggtgaagccgccctcgaggcgcctctcagcgtacgcatcaaatccagaacgccgcggcgacgcgcggaatccacgaccacgaggatcctctgcagaggcgcagccgggctctggaggagggaggnaaggagggagccgctgcggcgcggggccgtcagcgcgcgcctcccggtgccggaccacatacgccggccgccctacgtcggcacggccgccgtcccggaggtgtgccccgaccggcaggtgcacgacggcgagagcatcatgcggatgctggacgcctgcgagctcgccgctcgggtgctgcaccatgccggggcgatggtcaagccctcggtgacgacggacgagatcgacagggctgtgcaccagatgatcgttgacgccggccttaancccctccccatctcgatacggcggggtcccccaagagcgtgtgcacgtcgggtgaacgagtgcacctgccacggcatcccccgactcacgcaagctacaggatgggcgaccttatcaacattcgaagtttactgtctacttaaaacggatacctgggggacccctcgaaggacctacctggggccggaagaaatccacgacccaacttaagccagctcgtggaaggtccactgaaaaaatgcatgga

SEQ ID NO: 76535 - protein, 227 aa, Zea mays
  misc_feature: Ceres CLONE 1561286
  misc_feature: SWISSPROT Homolog: EC 3.4.11.18 Methionyl aminopeptidase
  misc_feature (68)..(68): Xaa is any aa, unknown, or other
  misc_feature (158)..(158): Xaa is any aa, unknown, or other
MAARVPAADLNQHLSSPFIARRCHGPGEAALEAPLSVRIKSRTPRRRAESTTTRILCRGAAGLWRREXRREPLRRGAVSARLPVPDHIRRPPYVGTAAVPEVCPDRQVHDGESIMRMLDACELAARVLHHAGAMVKPSVTTDEIDRAVHQMIVDAGLXPLPISIRRGPPRACARRVNECTCHGIPRLTQATGWATLSTFEVYCLLKTDTWGTPRRTYLGPEEIHDPT

SEQ ID NO: 76536 - DNA, 802 bp, Zea mays
  misc_feature: Ceres CLONE 1561287
  misc_feature: Encodes the peptide sequence at SEQ ID NO. 76537
ggagctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcatcgccatctgggcctgccaggtcgtgctcatgggcgccatcgaggggtaccgcgtcgccggccgaccgctccgagaggtcgtcgacccgctctaccccggcgcagcttcgaacccttcggcctcgccgacaaccctgaaggcttcgcggaactcaaggggggagaaccccagaacggccgccctgccctt

SEQ ID NO: 76537 - protein, 220 aa, Zea mays
  misc_feature: Ceres CLONE 1561287
  misc_feature (64)..(219): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSIIAIWACQVVLMGAIEGYRVAGRPLREVVDPLYPGAASNPSASPTTLKASRNSRGENPRTAALP

SEQ ID NO: 76538 - DNA, 847 bp, Zea mays
  misc_feature: Ceres CLONE 1561288
  misc_feature: Encodes the peptide sequence at SEQ ID NO. 76539
ctggagctccccgcggtggcggccgctctagaactagtggatcccccgggctgcaggaattcgtctcacccctagaaaaaaattcatcccaaaccagttcagcttccaaaaaggcaaagcagagcccgcacgcggagaggctacagaagggtatgggtcacctccgcggcctcaccgccgcgcggctcctcgcggcggccttcctgctctccgttgccgtcccggccgccagagcccaggaagaaaccgagcacgaggaggagttcagctacgtcgtcggcgacgagaacgggccggagcactggggcagcatcaaggcggagtggggcaactgcagcgccgggcggatgcagtcccccatcgacctctcccacgagcgcgtctcgctggtgcggtccctcggctacctcacccactcctaccgccccgccgaggccgccatcgccaaccgcggccacgacatcatggtgaggttcaagggcgacgccggcttcctggtgatcaacggcacggcgtactacctgaagcagatgcactggcactcgcccaccgagcacaccgtcgacggccgcaggtacgacactggagctgcacctggtgcacgagagctcggcgaacaaggcggcggtgatcggcatgctctacgagatcggccggcgaaggacccgttcctgcaagcgctggagccgtcaatccaccggattcgccgacagcaggaacggggagaagccatccggcgtggtggaacccccgggcccgccccggaaggccaacttctactaacggttacgggggctccctaacacgccgccctggaacggagggggtcatttgggaacgtccttaa

SEQ ID NO: 76539 - protein, 216 aa, Zea mays
  misc_feature: Ceres CLONE 1561288
  misc_feature: SWISSPROT Homolog: EC 4.2.1.1 Carbonate dehydratase
MGHLRGLTAARLLAAAFLLSVAVPAARAQEETEHEEEFSYVVGDENGPEHWGSIKAEWGNCSAGRMQSPIDLSHERVSLVRSLGYLTHSYRPAEAAIANRGHDIMVRFKGDAGFLVINGTAYYLKQMHWHSPTEHTVDGRRYDTGAAPGARELGEQGGGDRHALRDRPAKDPFLQALEPSIHRIRRQQERGEAIRRGGTPGPAPEGQLLLTVTGAP

SEQ ID NO: 76540 - DNA, 829 bp, Zea mays
  misc_feature: Ceres CLONE 1561290
  misc_feature: Encodes the peptide sequence at SEQ ID NO. 76541
  misc_feature (585)..(585): n is a, c, t, g, unknown, or other
  misc_feature (586)..(586): n is a, c, t, g, unknown, or other
  misc_feature (604)..(604): n is a, c, t, g, unknown, or other
  misc_feature (610)..(610): n is a, c, t, g, unknown, or other
ctccccgcggtggcggccgctctagaactagtggatcccccgggctgcaggaattcgtctcacccctagaaaaaacccaccacacaccaccaccaccgcacacccggcggcgccaagcccttcgaccaggtagctgaccagcatcagctgagccgagcggcagatggtttcgcggccgctagaggcttagcgtcgaggaagaggaggaagcggcgtgccacatgttgagtgagcagacggcggctagcactagcactagcggcggcggcgtcgagcgtcaggacaggtggctgcagccgggtggcggagaacgaggaggaggaggaggaacaggaggagttcagggacatccacgcgctgagcccgccgccgagccagccgtcgtcgtaccgccgggcgcgcggcggcgagccgtgggggtccgccgcgggcgggagcaggcacacgtccgtccgctccgtcgggagcgacaccgcgcccagcgagcccttcccgactatgaccagtgagttctcggccatggtcgccgcagcaggcagcgccgcagcagccagccgtgacgctgacagcgacgtctggcagggnncctaaggaaggagaggangaggancttggaggagaccaacccgcttggcatcgtgccggaacagaaccccttcccgtcggccgcgccgggggcccgccgtcccggcgccccgggaggccaacccgggggcgcctggtggccccccaaagggccccggaaaccccaaggggggggggggggccccggggggcaggccaggaaaggaagggagggggagcccaataatccccgcgtggggagggg

SEQ ID NO: 76541 - protein, 29 aa, Zea mays
  misc_feature: Ceres CLONE 1561290
MTSEFSAMVAAAGSAAAASRDADSDVWQG

SEQ ID NO: 76542 - DNA, 846 bp, Zea mays
  misc_feature: Ceres CLONE 1561291
  misc_feature: Encodes the peptide sequence at SEQ ID NO. 76543
  misc_feature (604)..(604): n is a, c, t, g, unknown, or other
ctccccgcggtggcggccgctctagaactagtggatcccccgggctgcaggaattcgtctcacccctagaaaaaaaagcgttccagatcgtactggaccaatctgccaccacactttgatcacacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgtgtagctgccgtcgtcgcgaccgaggccgcgcagatcgactacagctcaagcgtctcggtgttcccgatggaggcctgcgacctgcttggtggcgacgcgtgcaacgggcccatgttcccggagccaccccccccccttcggcggcggcggcggctagcaggactgtggtcgggggtggacagggactacctgtcctacgacgagccaaagacggtgttcccgggcgaggcgtgcgatgaccttggcggcgagttctgcgaggcgccgtaccaggacggcgtctccaaggagctggcgcacgcctgaagaccctgatccatccatttgctgtccccacactatngtacgtatgtgtagcagatggtttacatctacttgttagagcccggagagctggagaagctagctagcgtgcttacagaataacagcagccaagcaaaggcaagggtggtgtatatgatacgcatgcccttgggttgtgtcagctgcgactggatgtatactttaaaccaagatgaaatggtactgatggtgaataaaaaaaagcctgaggcactcctcccactacttactgaaaagctaga

SEQ ID NO: 76543 - protein, 139 aa, Zea mays
  misc_feature: Ceres CLONE 1561291
  misc_feature (1)..(127): Pfam Name: Lir1 Pfam Description: Light regulated protein Lir1
MQAAATAAGFSAVLPAKGRPAARSRVVARVPATRRSVRVAAVVATEAAQIDYSSSVSVFPMEACDLLGGDACNGPMFPEPPPPLRRRRRLAGLWSGVDRDYLSYDEPKTVFPGEACDDLGGEFCEAPYQDGVSKELAHA

SEQ ID NO: 76544 - DNA, 800 bp, Zea mays
  misc_feature: Ceres CLONE 1561295
  misc_feature: Encodes the peptide sequence at SEQ ID NO. 76545
ctggagctcaccgcggtggcggccgctctagaactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcaccaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaagcaccaccacctcttcggctgaccgtagtaccggccggcgcgcgaccgagagctagctagctccggcgcacacaaccacacacctgtttaaatctgtactggatgcgtgtgtaatctgatggttcacaataatgaagccctccccggacctgggtagctgctttcttgtggtgagtgaaaatgggaaactgaaggaaaaaagggggggtgggcctgtgggttcttcaaaaaaagggtgttct

SEQ ID NO: 76545 - protein, 131 aa, Zea mays
  misc_feature: Ceres CLONE 1561295
  misc_feature (41)..(120): Pfam Name: ABA_WDS Pfam Description: ABA/WDS induced protein
MSEEKHHHFFNHHKKDEEQPAGEYGYSETEVVTATGEGEYERYKKEEKEHKHKQHLGEAGAIAAGAFALYEKHQAKKDPEHAHRHKITEEVAAAAAVGAGGYVFHEHHEKKKDHKDAEEASGEKKHHHLFG

SEQ ID NO: 76546 - DNA, 797 bp, Zea mays
  misc_feature: Ceres CLONE 1561298
  misc_feature: Encodes the peptide sequence at SEQ ID NO. 76547
  misc_feature (539)..(539): n is a, c, t, g, unknown, or other
ctccccgcggtggcggccgctctagaactagtggatcccccgggctgcaggaattcgtctcacccctagaaaaagagcacgtactaccagcaagatggtggcgtctcccagattctagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctaggcgccgacaaggtcgtcnggaccgagctggaggtcggcagggacggcaagggcacgggcttcatgaccaggccaggcgtgctcatcggctaccacaagaagagtgccgtccttcaggagctcggggaaccgcttcccaactcggggttgggggatagggaaacgactttcgacttttgtccatccgcagggaggcccccctggggaaagtccaagaaataaaggcccggttcccaaaaaaccagtttttaaacccccttttattggggcaaaaagc

SEQ ID NO: 76547 - protein, 121 aa, Zea mays
  misc_feature: Ceres CLONE 1561298
  misc_feature: SWISSPROT Homolog: EC 2.3.1.15 Glycerol-3-phosphate O-acyltransferase
  misc_feature (55)..(55): Xaa is any aa, unknown, or other
MVARSVLPRFYAGDVHPESWRVFSSFGRRYVVTASPRVMVEPFARAFLGADKVVXTELEVGRDGKGTGFMTRPGVLIGYHKKSAVLQELGEPLPNSGLGDRETTFDFCPSAGRPPWGKSKK

SEQ ID NO: 76548 - DNA, 771 bp, Zea mays
  misc_feature: Ceres CLONE 1561301
  misc_feature: SWISSPROT Homolog: EC 1.1.1.82 Malate dehydrogenase (NADP(+))
ctccccgcggtggcggccgctctagaactagtggatcccccgggctgcaggaattcgtctcacccctagaaaaagcggtgaccaccactccctcctctcctctgccgtcctatccatccggcacgcccagcatccatccactcctcccctgctccggctccggctccggctccgccatgggcctttacaacagtttactccccggccggaccgcgcctcgtgccagcccctctcggccgctgccactctgcccaaccccgcagcccgcgccgagccccactcgacaccgtaccggtgctccgtctacgccaccaaccaagcccaagatggcgtggctacatgcccgtcgcgactgatgcacctgcatgacttaacgagcgcttctgggacctctgcaccacctacgacctgcaaggcggaggacaagaccaagccatgaaagaagctagtaaaagatactgtatcaggtgcagtcgggatgatatcaaatcacctgactgttcaaactcacttctggtgaggctagcggacaagaccaaccaatagcacttaaactaatcggctcataaagatcgtgataagcccgtccaggagtagctatggcactgcacgactcgctgtatcacatgctgagggaagtcagcattggcatatatacttacgtggtcttacaagagtagtattgggccctttctacctggctctaataccccgaggtcccggcatgtagcgagctaccctactggatatcaaggaccaaaacttttctaa

SEQ ID NO: 76549 - DNA, 828 bp, Zea mays
  misc_feature: Ceres CLONE 1561302
  misc_feature: Encodes the peptide sequence at SEQ ID NO. 76550
  misc_feature (813)..(813): n is a, c, t, g, unknown, or other
  misc_feature (828)..(828): n is a, c, t, g, unknown, or other
ctccccgcggtggcggccgctctagaactagtggatcccccgggctgcaggaattcgtctcacccctagaaaaaagcggcggctccacgcgaccggcgcgatggcggctttgacgcgaccggcacggcggcggcgcacagccccgacaacgaccctccccgctgccttctccacgatccctacaacaccaattatagttggggaaggtgaacctcctccctcttgggatccggtaccaactccaaaagctatggttggaaaaggctccccaaggttcaacataggtggttccccaaagttgcgtaggttcattcctacaacaagtgctactaaaaagaagacttctcctaaatgcagtggggcaaaaaagagtggaagttctccaagagtagtgaaacaaagagcggattggaatccaggccttgagaggtctcttgttgacattctccatgaatttaaagaaagtggatatagaggtgacaatggttggaactcggaagggtggaatagaatggtcaaggagtttcatgtgaggaacaagtatgtctcctttacaaagtctcaaattcaggataaagaaggtcagctgaagagagactacaagatgctcaaagcagcaaagcaacagagtgggtccacctggaatgagaaaaggaatatggttgaaggaccaccagctttgtgggagaatctcattgtgacatttcctaaaatcaagaagtttacaacaacaaggcaaccttcccgctctttgatgctttgggagagctttatgatggacactgggctgaagggacttggaaatgcacttcntcttgaggcaccgcn

SEQ ID NO: 76550 - protein, 192 aa, Zea mays
  misc_feature: Ceres CLONE 1561302
  misc_feature (188)..(188): Xaa is any aa, unknown, or other
MVGKGSPRFNIGGSPKLRRFIPTTSATKKKTSPKCSGAKKSGSSPRVVKQRADWNPGLERSLVDILHEFKESGYRGDNGWNSEGWNRMVKEFHVRNKYVSFTKSQIQDKEGQLKRDYKMLKAAKQQSGSTWNEKRNMVEGPPALWENLIVTFPKIKKFTTTRQPSRSLMLWESFMMDTGLKGLGNALXLEAP

SEQ ID NO: 76551 - DNA, 839 bp, Zea mays
  misc_feature: Ceres CLONE 1561303
  misc_feature: Encodes the peptide sequence at SEQ ID NO. 76552
ctccccgcggtggcggccgctctagaactagtggatcccccgggctgcaggaattcgtctcacccctagaaaaaattcctcctctccctctccacgggccacgcccaccgccccatccaccccgaaaccctaggggatcgtcgccatggccgcggtcgcgctccttcgccgcatccccgccgcgcgggccccggccacggccttcatggaggcgcgcccggtctccgattccacggcggcgctcaccatcgagacatctgtccctttcacctcccacctcgtcgacccgccctcgcgcgatgtcaccaccacccccgccgagctcgtcaccttcttccgcgacatgtccctcatgcgccgcatggagatcgctgccgactccctctataaggccaagctcatccgatggttctgccacctctacgacggccatgaggccgtcgccgtatggatggaggccgccgtctcccgctgcgattccatcatcaccgcctaccgggaaactgtacgtacctcgaccgcggaggggacctcgtctccgcctcctccgaactgatgggcctcgagggcagctgctcccgcgggtagggcggattcaatgctttttctttaaaaaggagccaattgctcccgccgggaacgggaaaaagggggcccgggtggaggcccccccgaaggtgggctggggcatattccctaggaaggccctttcaaggaaggaaaagggggccttttttttgccccccttttgtggggcgtcgggccgcgggctttaaaacagggggataagggcccctctttgtgggggtctccgagaaacatttttgggggcgccgcgc

SEQ ID NO: 76552 - protein, 136 aa, Zea mays
  misc_feature: Ceres CLONE 1561303
  misc_feature: SWISSPROT Homolog: EC 1.2.4.1 Pyruvate dehydrogenase (acetyl-transferring)
MAAVALLRRIPAARAPATAFMEARPVSDSTAALTIETSVPFTSHLVDPPSRDVTTTPAELVTFFRDMSLMRRMEIAADSLYKAKLIRWFCHLYDGHEAVAVWMEAAVSRCDSIITAYRETVRTSTAEGTSSPPPPN

SEQ ID NO: 76553 - DNA, 813 bp, Zea mays
  misc_feature: Ceres CLONE 1561304
  misc_feature: Encodes the peptide sequence at SEQ ID NO. 76554
  misc_feature (756)..(756): n is a, c, t, g, unknown, or other
  misc_feature (798)..(798): n is a, c, t, g, unknown, or other
agctccccgcggtggcggccgctctagaactagtggatcccccgggctgcaggaattcgtctcacccctagaaaaagcatcgttagaatcagccttacacgagacagaattcagggaaaggaggagggcgcggcggcgacgagcttagcgatacagcggcaccggagagctagccgcggcctcgatgctcgcggggatctgaactagtgccgctgcccaatcgcgccgaggactgtggcgctcactcctcatatcccatttccagcactcgtttctccatttcccaccttcccaaacgccacttaaaagagaaaggagagcatcgcagtgacacacgcgcaatggaaggctcgccggtgacgcgcctcccggaggctaactccctccccgacggcttcgttcccgactccgagagccctggcacggacgcgacgtttcccttctccgcgcccatcgttgatgatgcgctcaactccgatatccccgccgcgaccaacccaggcggcgaggaaaccctaaacgatccccccctccctgcgtccagcgccgaagatgcctcctcggccgccgctgctgaagccttgggcacactttctctggacgctgccgccgagccagaacgcgctctagaggagaacggacccaccggcgctgcaagaggtgaagcatccttgaagaattgtgcatcagagctagtgggcgctccaactgctcaaaaagggagcgttgagcgaaaacgtaaggttgtgaaacgtnagcagcttgagaaggatagagagttgtttgaactggcccacnataccacaaagttgt

SEQ ID NO: 76554 - protein, 157 aa, Zea mays
  misc_feature: Ceres CLONE 1561304
  misc_feature (139)..(139): Xaa is any aa, unknown, or other
  misc_feature (153)..(153): Xaa is any aa, unknown, or other
MEGSPVTRLPEANSLPDGFVPDSESPGTDATFPFSAPIVDDALNSDIPAATNPGGEETLNDPPLPASSAEDASSAAAAEALGTLSLDAAAEPERALEENGPTGAARGEASLKNCASELVGAPTAQKGSVERKRKVVKRXQLEKDRELFELAHXTTKL

SEQ ID NO: 76555 - DNA, 841 bp, Zea mays
  misc_feature: Ceres CLONE 1561306
  misc_feature: Encodes the peptide sequence at SEQ ID NO. 76556
ggagctccccgcggtggcggccgctctagaactagtggatcccccgggctgcaggaattcgtctcacccctagaaaaaagcgcgcacacctacgtgtcgagccgtcttcatccctccgaccggaaatcaacggtgcgtttgcttctctcctccggaaggttctcggcttctcgcaggcgcggcgaccggcttcaaccccaactcttcttcttcttccgcgcaaacttcgaacgggacgagaaggaagcggacgcgagaggagactaaccgacctcggatccatcgacgcgtgaagatgtcttcgcccgccgagtactacaaatcactgtccacctataagcaaggcatatgggacattgggtttctttaccaccgtgctagttcagctccagattttgcacccattatttctttacttagattaccccttggtgttcaagaagtttgagatatggaggctattgacaagtttctttttcctggcaccattttccatgaaatttggtattcgccttctgatgatagcaaggtatggtgtcatgttggaaaagggtgcatttgataagcggactgcagatttcttatggatgatgatatttggtgccatctcactataggtgttgactattattcccctattcaattcttttttcttaggaatacctatggtcagcatgctcctttatgtctggagccgagagaatccagatgctcagatgaatatgtactgcctcggccaattgatgtccttttatcttccatgggctatgctcattatggatgtgatagttgggtcatcattaatgctggaactctggggcatcatgtctggacatctcat

SEQ ID NO: 76556 - protein, 40 aa, Zea mays
  misc_feature: Ceres CLONE 1561306
MKFGIRLLMIARYGVMLEKGAFDKRTADFLWMMIFGAISL

SEQ ID NO: 76557 - DNA, 766 bp, Zea mays
  misc_feature: Ceres CLONE 1561307
  misc_feature: Encodes the peptide sequence at SEQ ID NO. 76558
ctcaccgcggtggcggccgctctagaactagtggatcccccgggctgcaggaattcgtctcacccctagaaaaaacgtcccatccctcctgcatttcaaaataggcgtatctccctgcgcttttcctagccctttgtcatccaaggaaacaataaacaaccggcggcttttacacccccgccaagaacaggagcaacaacaacaaggctcctcgcaacaatccattctcatccatggcgaagctcatgaacaagttggtcgattcgttcgagcacgacgagataccggacgtcggctgcgtgcgcgccgtgctggccgagctcgtcctcaccttcctcttcgtcttcaccggcgtctccgccgccatggccgccggatccgacgggaagcccggcgacgctatgccgatggcgacgctggcggcggtggctatcgcgcacgcgctggccgctggcgtcctggtgacggccgggttccacgtctccggcggccacctgaaccccgcggtgacggtgggtctcatggtgcgcggccacatcacgaagctccgggcggtgctgtacgtcgccgcccagctgctggcctcatcccgcgcctgcgtcctcctccgcttactcagcggcggcatggtgacccggatgcacgccctgggcaggggcatcaccccgatgcagggcctggtgatggaggtcatcctcaccttctccctgctctttcgtaacttacgcatgatcctggacccgccgagccaggtcctcgccatcgg

SEQ ID NO: 76558 - protein, 177 aa, Zea mays
  misc_feature: Ceres CLONE 1561307
  misc_feature (16)..(177): Pfam Name: MIP Pfam Description: Major intrinsic protein
MAKLMNKLVDSFEHDEIPDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSRACVLLRLLSGGMVTRMHALGRGITPMQGLVMEVILTFSLLFRNLRMILDPPSQVLAI

SEQ ID NO: 76559 - DNA, 812 bp, Zea mays
  misc_feature: Ceres CLONE 1561311
  misc_feature: Encodes the peptide sequence at SEQ ID NO. 76560
  misc_feature (774)..(774): n is a, c, t, g, unknown, or other
tggagctccccgcggtggcggccgctctagaactagtggatcccccgggctgcaggaattcgtctcacccctagaaaaaccacacgtcgtattcggatgaagcatgagagagaagagcaagaaagacttcgtcacgtcaggtcgacggcgaaagacgcggaggttggtgaaggagtgaaggaagaaagagaacgaaaggcggcctctcactcgcagtcgcagtagcaggttctagaccaccaaacccagcggctcccgctcatctcagttcggcttcggccttcgcattcctctacagatttcgcagttttgctgggggtaactacggaatggggggcggatccggatctttcctcaaggtcttggtcaacaacatggatgtcctcgcggggcctttggtttcacttgcgtatcctctgtatgcctctgttagagcaattgaaacaaaatctgctgtggatgatcagcaatggctcacgtactgggtgctgtactcatttatcactctattcgagctcacctttgctccggtactcgaatggcttcctttctggtcttatgcaaagctgttcttcaattgctggttagtattgccacagttcaatggagctgcacatgtatatgagcattttgtgaggccaatgattgtaaatcagcaagttgtaaacatctggtatattccaaagaaggatgaatcaagtagaccctgatgatgtaatttcagctgcacagaggtacattgagcaaaatggatcaaaagcgttttgagaatcnttgttaaccaagtttaagagttcgaacccaaggcgctc

SEQ ID NO: 76560 - protein, 126 aa, Zea mays
  misc_feature: Ceres CLONE 1561311
  misc_feature (9)..(106): Pfam Name: TB2_DP1_HVA22 Pfam Description: TB2/DP1, HVA22 family
MGGGSGSFLKVLVNNMDVLAGPLVSLAYPLYASVRAIETKSAVDDQQWLTYWVLYSFITLFELTFAPVLEWLPFWSYAKLFFNCWLVLPQFNGAAHVYEHFVRPMIVNQQVVNIWYIPKKDESSRP

SEQ ID NO: 76561 - DNA, 830 bp, Zea mays
  misc_feature: Ceres CLONE 1561312
  misc_feature: Encodes the peptide sequence at SEQ ID NO. 76562
ctccccgcggtggcggccgctctagaactagtggatcccccgggctgcaggaattcgtctcacccctagaaaaagtccccccggcatccccgctgcccgcgaccataggccgctccgctccaccccgccgcgactttcgtcccagctccgccgcatctctcctcctccacctctaccccgccgctcgggccagctagcaggcatccactgcgccgcaaccgcgcgcagccagcagccagccagccatggagaagcgacggcgaggcagcggcggcgtgccgtccttggcggtggcggtgctggcggcgctcctggcggcggcctcgatgccgtcgccgccccgcgtggcggccgcgctgtcgccggactactacaaggacagctgcccgggcctggagtcgatcgtgcggtacgaggtggcgaggaagaagaacgagacggtggtcaccatcccggcgacgctccgcctcgtcttccacgactgcatggtcgggggctgcgacgccgccgtcctgatcgcgtccaagaacaacgacgccgagaaggacgcgccggacaacgagtcgctcgccggcgacggcttcgacaccatcaaccgggtcaaggcggccgtcgagaagaagtgccccggcgtgatgtcctgcgccgacatcatcgcgctcgccgccagagacgtcgtctacctggcggatgccccctactggcgcgtcaagctcggccgtctgtacgggctcgaatccaaggcagcgacttcaggggaaactgccggaacccgacatggacttcaagaacctcggcccggtggtccagcggaaagcctttccggaggg

SEQ ID NO: 76562 - protein, 195 aa, Zea mays
  misc_feature: Ceres CLONE 1561312
  misc_feature (54)..(195): Pfam Name: peroxidase Pfam Description: Peroxidase
  misc_feature: SWISSPROT Homolog: EC 1.11.1.7 Peroxidase
MEKRRRGSGGVPSLAVAVLAALLAAASMPSPPRVAAALSPDYYKDSCPGLESIVRYEVARKKNETVVTIPATLRLVFHDCMVGGCDAAVLIASKNNDAEKDAPDNESLAGDGFDTINRVKAAVEKKCPGVMSCADIIALAARDVVYLADAPYWRVKLGRLYGLESKAATSGETAGTRHGLQEPRPGGPAESLSGG

SEQ ID NO: 76563 - DNA, 795 bp, Zea mays
  misc_feature: Ceres CLONE 1561313
  misc_feature: Encodes the peptide sequence at SEQ ID NO. 76564
tggagctcaccgcggtggcggccgctctagaactagtggatcccccgggctgcaggaattcgtctcacccctagaaaaactccaggaccgcccgctcttatcccgtttctcccttctctgggctcggagaatcggagatggcgtccagcgcctctcggttcatcaagtgcgtcacggtcggcgacggtgccgtgggcaagacatgtatgctcatctgctacaccagcaacaagttccccactgattacatacccacggtgttcgacaatttcagtgcaaatgtcgttgtggatggcaccacggtgaatttgggcctgtgggataccgcatggcaggaagattacaaccgactgaggcctctaagctaccgtggtgcagatgttttcgtgcttgcattctcacttgtgagtcgagctagctatgagaatatcatgaagaagtggataccggagcttcagcattatgcacgtggggtgcctgttgtgttggtaggcacaaaatttgatcttcgtgaagacaagcactacttgatggaccatcctgggttggtgcctgttaccacagcacaaggggaggaacttcatagacaaattggtgctatgtattacatcgaatgcagttcgaagacacagcagaatgtcaaagctgtgttcgatgctgccatcgaggttgtaatccagcctccaactcagctaagagaacagaagatgaagaatcccgctagggatgttcgatggtgtacatcctatctgggaagaaaatgctatgcttctagtctgcatgatctgaaggggt

SEQ ID NO: 76564 - protein, 219 aa, Zea mays
  misc_feature: Ceres CLONE 1561313
  misc_feature (10)..(181): Pfam Name: Ras Pfam Description: Ras family
  misc_feature (10)..(123): Pfam Name: Miro Pfam Description: Miro-like protein
MASSASRFIKCVTVGDGAVGKTCMLICYTSNKFPTDYIPTVFDNFSANVVVDGTTVNLGLWDTAWQEDYNRLRPLSYRGADVFVLAFSLVSRASYENIMKKWIPELQHYARGVPVVLVGTKFDLREDKHYLMDHPGLVPVTTAQGEELHRQIGAMYYIECSSKTQQNVKAVFDAAIEVVIQPPTQLREQKMKNPARDVRWCTSYLGRKCYASSLHDLKG

SEQ ID NO: 76565 - DNA, 863 bp, Zea mays
  misc_feature: Ceres CLONE 1561314
  misc_feature (255)..(255): n is a, c, t, g, unknown, or other
  misc_feature (265)..(265): n is a, c, t, g, unknown, or other
  misc_feature (266)..(266): n is a, c, t, g, unknown, or other
  misc_feature (577)..(577): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (680)..(680): n is a, c, t, g, unknown, or other
ctccccgcggtggcggccgctctagaactagtggatcccccgggctgcaggaattcgtctcacccctagaaaaaacaccacagctcccacacacagcaggcagcagctcgatcgctagctcctccgaaccggaaagccaagcccgctttggcgatcgtgcttgcttgcttggttccttcaattcctgccggagccagcgagagctagctgctgctgtcgcgtggtagacgtcgtcttgccagcgagagcctagcntgcgatcggnntctctgctgggtaccaacgtaggggagaaagatcgagggggagaggacgacgactatggccggcgcgaccgtgaccgtggagattgtgatgaagggccaacgtcgcaaccggccccgcccacgttgctggcgatttgggaacccggcccacggccccgggcaaaaatgggggtggtttcccaaggggcccgaactaccccggactaataacttccgggattttccccagttgagcgggtgggcccctttcccccgacacccccaaagggggaaaaatttcgccaaaaaaaaaatttttggcgaggaagagncgcccaatttaatcccccnnnnaaaagggtttttaatggccccccgagagggggggatgttccccccggggggagaaaaaccaccccccgatttttgtttttncgcgggcttattttttgtgggcggcccccctccttttttaccccccccaaaaaaaaaagggggggtttgggggggaaagttcccccccaaaactcctttgaaaaaaacgcgcccccccgcaaaaaaaggaaacaaaaaagggggggggggggggggggcgaaatatatttttttttttttttt

SEQ ID NO: 76566 - DNA, 856 bp, Zea mays
  misc_feature: Ceres CLONE 1561315
  misc_feature (178)..(178): n is a, c, t, g, unknown, or other
ctccccgcggtggcggccgctctagaactagtggatcccccgggctgcaggaattcgtctcacccctagaaaaaaacccaaacaccacaatccccttcaacaaacgcaccgcactccacggcagccagaaaacacaatccacagagtctccgtgaggtctgagcgaggtaggactagnctctgagcgagttcttccgtgcttccaggtataatcctagcaactctcactatcctcttcgcatcgctcgtctctttttgagaccagttggatttctcttatttttccttggatcctactacctaatagaacagagctccggagccttttagtttctggtctctgatctactcattttcttttcttccccttttggtgacataggtaggtctagcttaagatctgtcgtgcctggttcttttgattttagctaagaaaccaggcgattttagtcttcttctcccttacaaaaaaattccccggaaaaaaaaaagttgtgaggtagtatattccttgtaccagttggatggcccgctgcttataaatcttcccccgggccccggcggaggattcctgatgcgaggcgaatgggagtcctttcatgcaaagaagaacgcccccatcccccttttggggccatgccggccgggggggcctttctttttcccaagggggccggaaggcccaaggggggccccagttaccccgggggaaccccacctggaaaccccggggcgccaaatatgaaattttttttccaagggcccccaggtttccacctgtgaaaggggagaaacccggggggggtgggggtccccgcggggggcccccacccctttttaagccccccgcccccct

SEQ ID NO: 76567 - DNA, 780 bp, Zea mays
  misc_feature: Ceres CLONE 1561316
  misc_feature: Encodes the peptide sequence at SEQ ID NO. 76568
  misc_feature (673)..(673): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (767)..(767): n is a, c, t, g, unknown, or other
  misc_feature (768)..(768): n is a, c, t, g, unknown, or other
ctccccgcggtggcggccgctctagaactagtggatcccccgggctgcaggaattcgtctcacccctagaaaaactgtgacccgacaggtgaatgcgccgccgctgcagtgtccatagccaccgcacgtagacctgacatggtggggtttctgtccagacccacaagagcaatggcgtacttcaagcgtttccaggtgatattcaagataacgcgcgctggcaagacagactacacggccaggataacgctgattaacctagacagaaacaagtacaatacacccaaatacagatttgttgtgcgatttaccaacaaggacatcacagcactgatcatctgtgctagtatagcatgtgatatggctgcttgcttctgcttactcgcatgatgttgctacggatatggctcttgaaagttggtcatgaccatactttggcaccctgccctactggcacctggaccttcctgtctggggtcacccgtggtgcctcaagaacccccccgagttttggaataaaggaaatttccgatggggccaatggtcttttaaaggggcccaacaagggagaaaagggagactcccccccccccccccgggggggggaaaaacacccccccccccctttcttatttttataaaaaaaaaaaaaggggggaggaggcgggggggntttctctctttnnncccccccccccccccaccccacccccnnncccgnnnggggtagttttgtgggaaaacccccccacnnnnnnnncaaaaannaaaaaaacaaat

SEQ ID NO: 76568 - protein, 83 aa, Zea mays
  misc_feature: Ceres CLONE 1561316
MVGFLSRPTRAMAYFKRFQVIFKITRAGKTDYTARITLINLDRNKYNTPKYRFVVRFTNKDITALIICASIACDMAACFCLLA

SEQ ID NO: 76569 - DNA, 858 bp, Zea mays
  misc_feature: Ceres CLONE 1561318
  misc_feature: Encodes the peptide sequence at SEQ ID NO. 76570
  misc_feature (537)..(537): n is a, c, t, g, unknown, or other
  misc_feature (542)..(542): n is a, c, t, g, unknown, or other
ggagctccccgcggtggcggccgctctagaactagtggatcccccgggctgcaggaattcgtctcacccctagaaaaagtgagcagcggcgtgcgatcgatcgaggcagtcgtagtaataagccaacaaacaaaccggccggaacgccatgctggaggagtacaaaccgtgtgcggccatggtggtgacgcagtgcatctacgccgctctagcgctcttgtccaaggcggcgttcaccggcggcatgagccccctggtgttcgtcgtctacaggcaggccgtcgccaccattgtactcgtccccgtcgtcatcgcggccaacaggaagaagatgaaggagatgacgacgggccttggactgacgggcttctcgctggtcttcgtcgcctcccttgtcggggcaacggtgaaccagtgcatgtactaccaaggggtgaatctgggctcgtcgtccatggcaacggccatgaccaacttgatccccgccatcaccttcgtcatggcggcatcagtcggcctagaagagggtggaggccnagtanggccgagaagcctggccaagatcttcggcacggccgtctgcgtgagcggcgccatggccatggcttttcttcaaggcccgaagctgctcggcgaccgccccaacgttctcaagctctcctccaggcgggcggcggcaggtgggtggccgggcccctcctcctggggggaacaacctcctgctgggcgctctgggctaacccggaagggacaatttttcaaaattttaacgggagacccctggctttttcgggggtggaatggcccccggtccaccctcaagtccgcggttgtttttttcctttcccttgggggaaa

SEQ ID NO: 76570 - protein, 236 aa, Zea mays
  misc_feature: Ceres CLONE 1561318
  misc_feature (16)..(154): Pfam Name: DUF6 Pfam Description: Integral membrane protein DUF6
  misc_feature (130)..(130): Xaa is any aa, unknown, or other
  misc_feature (132)..(132): Xaa is any aa, unknown, or other
MLEEYKPCAAMVVTQCIYAALALLSKAAFTGGMSPLVFVVYRQAVATIVLVPVVIAANRKKMKEMTTGLGLTGFSLVFVASLVGATVNQCMYYQGVNLGSSSMATAMTNLIPAITFVMAASVGLEEGGGXVXPRSLAKIFGTAVCVSGAMAMAFLQGPKLLGDRPNVLKLSSRRAAAGGWPGPSSWGEQPPAGRSGLTRKGQFFKILTGDPWLFRGWNGPRSTLKSAVVFFLSLGG

SEQ ID NO: 76571 - DNA, 804 bp, Zea mays
  misc_feature: Ceres CLONE 1561319
  misc_feature: Encodes the peptide sequence at SEQ ID NO. 76572
ctggagctccccgcggtggcggccgctctagaactagtggatcccccgggctgcaggaattcgtctcacccctagaaaaaatcatatcgatcagctcttgcaaccttatctccattgcactgcattgcattgcattgcattagtaaagggagatccatggacagagaaatggagaaggcaaagaaggccacatcttcccctaagagctcaacaattagtactggtcccaagagcccggtgaggaatggaggacgatctccccctcataagaaaaacactactactgctaccgaggcacgtggacggaaacatgagcagcaaaacgttcgaaaaggaggagacactttgtctcatgacgagagcaaaccacgacgttcttcatcaactgcggcacaaacctcacccaagagatcaccgagacactaacaacccctgagctacaacaggctccacacagaggagagagcaataaggcgggctggctacaattatcaggttgcaagcaagataaatacccaggaaatcattcgcagatttgaagagaagcttgcacagctgatggaggagcgcgagataaagctgatgaggaacgatatggttcccaaggcccaactgatgccagcatttgacaagccattccacccacaaaggtcgacgaggcctctgacggtgccaaaggagccgagtttcctgaggctgacatgctgcatcgggtggagagttccatctccattgttgctgctatggagtcaacacaagggccatcaaggtcgtagtcgatacataatacatgcaccgcagaga

SEQ ID NO: 76572 - protein, 89 aa, Zea mays
  misc_feature: Ceres CLONE 1561319
MDREMEKAKKATSSPKSSTISTGPKSPVRNGGRSPPHKKNTTTATEARGRKHEQQNVRKGGDTLSHDESKPRRSSSTAAQTSPKRSPRH

SEQ ID NO: 76573 - DNA, 813 bp, Zea mays
  misc_feature: Ceres CLONE 1561320
  misc_feature: Encodes the peptide sequence at SEQ ID NO. 76574
  misc_feature (803)..(803): n is a, c, t, g, unknown, or other
ctccccgcggtggcggccgctctagaactagtggatcccccgggctgcaggaattcgtctcacccctagaaaaaaagccgccgtgaccgccagacccaagccaacaagcaagagcattactacttctgcttccgaccgaaacctttcttggaacgcaagaagaatcccaaccccgaccgacctaccctaatcggcgatggcgacggtggcgatggacatctcgaagcccactccagtggcgtccggcgacgaggccgcggcggcggccaaggggaggagcggcggagggggcgaggggctgcggcagtactacctgcagcacatccacgacctgcagctccagatccggcagaagacccacaacctcaaccgtctcgaggcccagcgcaatgacctcaactcccgagttagaatgctcagggaagagttgcagttgcttcaagagcctggctcatatgttggtgaggtggtgaaggtcatggggaaatcaaaggttctggtgaaggtacaccccgaaggcaaatatgttgttgatatagataagagcattgatatcacaaagatcacaccttcaacaagagtcgctcttcgtaatgacagctatatgctccatctgatcctaccaagcaaagttgatccattggtcaatctcatgaaagttgagaaggttcctgattctacatatgatatgattggaggccttgaccagcaaattaaagagatcaaagaggtcattgagcttccaatcaaacatccggaactatttgagagccttggaatgcccaaccaaagggtgtcctccntttatggaca

SEQ ID NO: 76574 - protein, 205 aa, Zea mays
  misc_feature: Ceres CLONE 1561320
  misc_feature (203)..(203): Xaa is any aa, unknown, or other
MATVAMDISKPTPVASGDEAAAAAKGRSGGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGMPNQRVSSXYG

SEQ ID NO: 76575 - DNA, 807 bp, Zea mays
  misc_feature: Ceres CLONE 1561325
  misc_feature: Encodes the peptide sequence at SEQ ID NO. 76576
  misc_feature (704)..(704): n is a, c, t, g, unknown, or other
tggagctccccgcggtggcggccgctctagaactagtggatcccccgggctgcaggaattcgtctcacccctagaaaaaggccggggtcagtagctaacgttccatcccagaaaaccccatcttatcataggaagtctaccagttttgccaccaaggtcacaccatccaccacggccatggagtccggcgcagacgaggtggcgttcgagtccccggcacatttccgcatctacaagagcgggaggatcgagcgcctgaaccggcccccggtccttcccgccggcctcgacgaggccaccggtgtcacctcaaaggacgtcgtcctggacgccggcaccggcctttccgtacgcatctacctccccaagctccaggaaccatccaagaagctcccggtcctcgtctacttccactgcggcgcgttcctcctcgagtcggccggctctgccacgtaccacacctacgtcaacccactcgcagccgccgcgggcgtcctggtggtgtccgtggactaccgcctggcaccggagcacccggtcccggcggcctacgaggactcgtgggccgcgctccagtgggcgacgtcggcgcaggaccgagtggatcgtcgagcacggcgacacggcgcggctcttccctcgcgggcgacgcgcccgcgcaaacatcgtgcacgacatgctgatgcgggcgtcccgcgccgggngggcccgacgtcaagggcgccatcctgcttccacccctgtttccgcgggaccggccccttcaagccgaaacccgagggtggcccaacggccaccccttgggtt

SEQ ID NO: 76576 - protein, 210 aa, Zea mays
  misc_feature: Ceres CLONE 1561325
  misc_feature (75)..(191): Pfam Name: Abhydrolase_3 Pfam Description: alpha/beta hydrolase fold
  misc_feature: SWISSPROT Homolog: EC 3.1.1.3 Triacylglycerol lipase
  misc_feature (176)..(176): Xaa is any aa, unknown, or other
MESGADEVAFESPAHFRIYKSGRIERLNRPPVLPAGLDEATGVTSKDVVLDAGTGLSVRIYLPKLQEPSKKLPVLVYFHCGAFLLESAGSATYHTYVNPLAAAAGVLVVSVDYRLAPEHPVPAAYEDSWAALQWATSAQDRVDRRARRHGAALPSRATRPRKHRARHADAGVPRRXGPTSRAPSCFHPCFRGTGPFKPKPEGGPTATPWV

SEQ ID NO: 76577 - DNA, 819 bp, Zea mays
  misc_feature: Ceres CLONE 1561326
  misc_feature: Encodes the peptide sequence at SEQ ID NO. 76578
  misc_feature (727)..(727): n is a, c, t, g, unknown, or other
  misc_feature (783)..(783): n is a, c, t, g, unknown, or other
  misc_feature (786)..(786): n is a, c, t, g, unknown, or other
ctccccgcggtggcggccgctctagaactagtggatcccccgggctgcaggaattcgtctcacccctagaaaaaaaaaatctctcactcgctagcactagcatagtcgtctctttcttttctgcttccagacattgtccacacgagctagtgcactggtgtcgctcgcaaccaaattaaggacgtactgagccatggcatccaagggcgtcctcttcttggctctcaacctcctgttcttcacagtggccaacgcctgcggcagctgcccgaccccaacgccgccggtcgtgccaccgccgccgcctccttctgctaccccacccccttcatcctccagtgggaagtgcccgctgaacgcgctcaagttcggcgtgtgcgtcaatgtgctcggcctcgtcaaaggcgaggctggcaaggtacctgccgagccatgctgcaacctcatcaaaggccttgcagacttcgaggccgccgtctgcctctgcacggccatcaagggcaacgtcctcggcgtcgtcttcgatgtccctatcaagttcaatgccctcgtcaactactgtggcaagtgcgtgcccaagggctacatgtgtgcgtaagctccgcgcggttacactctcgtagccgttcgcgtgcgtaattaagcatgcacctgcatggcacacatgtattgtgcgcctgctgatctctcctgtctcatttgtgcaccttaggttctacagtcctangaacatattccaggcaaattcttgtcagttcacatgtattgtctcttggtgaattnctnatttttggttttattttgtatttgacatttgtt

SEQ ID NO: 76578 - protein, 134 aa, Zea mays; identical to SEQ ID NO: 74714
  misc_feature: Ceres CLONE 1561326
  misc_feature (52)..(133): Pfam Name: Tryp_alpha_amyl Pfam Description: Protease inhibitor/seed storage/LTP family

SEQ ID NO: 76579 - DNA, 834 bp, Zea mays
  misc_feature: Ceres CLONE 1561327
  misc_feature (312)..(312): n is a, c, t, g, unknown, or other
  misc_feature (473)..(473): n is a, c, t, g, unknown, or other
  misc_feature (561)..(561): n is a, c, t, g, unknown, or other
  misc_feature (646)..(646): n is a, c, t, g, unknown, or other
ctccccgcggtggcggccgctctagaactagtggatcccccgggctgcaggaattcgtctcacccctagaaaaagtcacagaccgacaacgcctaggcaagcagcaagcgtacacgtaaacgtacacctacctcggcgagcaaaaggcaaaacgctgatcggagcaaccaacgaagcccgcagccatgccgacggccacggccacggcggctcctcgccacgccgcgctcttcctgctgctgctgctcggcctccacgccacgttcgccgccgccgcgcgcgcgggcgtcgccgtggacgccgaagctcacngtccaacccaaaagcccgtcccccccgggttgcccccaaaaaaaaaacccccccccggggtggaaaaaaacccccccccggggggccccccggggggggcccccccccggacaccccccccaaaaatttttcttcctcgcgggggggggggtttgtgtctntcccccccccccccacccccgaaaagagaagggggggggggggggggggtataatttttttttctccccaccaccccccccccccccntaggaacgaattaggggggggggggccccgccccgccccccccaaacaaggaggaaaggaggggaatggaagggggggggaaacntcctcgagaatacaaatccgattaaataggggggagggaaagggggggaaaacgggcgccgctaaagggtggtgaggggggagggggggggagaaaagaagaggaggagacaatgcggggaacaacaaggcgtgggaaaggggaggaaaggggggtaggagtgggtagatgggggataggccccccac

SEQ ID NO: 76580 - DNA, 813 bp, Zea mays
  misc_feature: Ceres CLONE 1561329
  misc_feature: Encodes the peptide sequence at SEQ ID NO. 76581
  misc_feature (643)..(643): n is a, c, t, g, unknown, or other
  misc_feature (759)..(759): n is a, c, t, g, unknown, or other
ggagctccccgcggtggcggccgctctagaactagtggatcccccgggctgcaggaattcgtctcacccctagaaaaaacacagcatccgcagttccccgaccacaccgttcctccgaggtccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaatcttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcangacattgctctggctgagctggcacctacccatccgataaggctgggacttgctcttaatttttcagtggtctattatgagaatctgaactccccagacaaagcttgcaacctggncaaagcaggccgtttgattgagcctatctctgaattaggacagccctttggtga

SEQ ID NO: 76581 - protein, 213 aa, Zea mays
  misc_feature: Ceres CLONE 1561329
  misc_feature (3)..(213): Pfam Name: 14-3-3 Pfam Description: 14-3-3 protein
  misc_feature (157)..(157): Xaa is any aa, unknown, or other
  misc_feature (196)..(196): Xaa is any aa, unknown, or other
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAXDIALAELAPTHPIRLGLALNFSVVYYENLNSPDKACNLXKAGRLIEPISELGQPFG

SEQ ID NO: 76582 - DNA, 835 bp, Zea mays
  misc_feature: Ceres CLONE 1561330
  misc_feature: Encodes the peptide sequence at SEQ ID NO. 76583
ctggagctccccgcggtggcggccgctctagaactagtggatcccccgggctgcaggaattcgtctcacccctagaaaaaaccaccacgaaccaaccgacagaaagagggacgaatggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccgattatgaggaagatagccgacaaggttgcttcgtcagggtactttgttgtggtaccagatttgtttcatggggatccttatgcacctgagaatgttgagaagccctttcctgtgtggataaagtcacatactccggaaaaagggtttgaagagacaaaacaagttattggggctctaaaggagaagggagtgtctgctgttggagctgcagggtatggctggggtgcaaagggtgtttgtggaagttggcaaaagctcatgagatcccagctgctgtgctgttgcacccttcttttggtaccgttgacgattcaaagaagtcagtgcgcaattttctatctcgggagctaaaatggacaaaatgtccccaccggaactaattaagcagttcgagcaggtcctttctttgaacccgggggtgggcccctttcccaaaaaccttccctggggtgggcccatggttgggaccggtgaataaacccccaaaaaaccaattccccgtgaaaaaggtctaaaaaacccttttgggaaatgtccaaaagggttaaccaaaaaa

SEQ ID NO: 76583 - protein, 171 aa, Zea mays
  misc_feature: Ceres CLONE 1561330
MASSQCCDNPPALNPACGEGKVVDSFGGLKAYVAGPEDSKAAVVLVADVFGFEAPIMRKIADKVASSGYFVVVPDLFHGDPYAPENVEKPFPVWIKSHTPEKGFEETKQVIGALKEKGVSAVGAAGYGWGAKGVCGSWQKLMRSQLLCCCTLLLVPLTIQRSQCAIFYLGS

SEQ ID NO: 76584 - DNA, 817 bp, Zea mays
  misc_feature: Ceres CLONE 1561331
  misc_feature: Encodes the peptide sequence at SEQ ID NO. 76585
  misc_feature (491)..(491): n is a, c, t, g, unknown, or other
  misc_feature (496)..(496): n is a, c, t, g, unknown, or other
  misc_feature (521)..(521): n is a, c, t, g, unknown, or other
  misc_feature (603)..(603): n is a, c, t, g, unknown, or other
tggagctccccgcggtggcggccgctctagaactagtggatcccccgggctgcaggaattcgtctcacccctagaaaaaacgcaacaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactacgtggaggaggacctggggaacaagagcgacgagctgctgcgccacaaccccgtccacaagaaggtgcccgtgctcgtccacggcggccgcgcgctcccggagtccgtcattatcctccagtaccttgacgacgcctggccggagacccgcccgctgctccccgccgacgccttcgaccgcgcgctcgcgcggttctggtgccacttcgccgacgacaagctcgggccggcggtgggcgcggtgttcncgtcnacggggaggcccccaggaggcggcngttgcggcaggtgcacgagtacctggcgctgatcgagtccgagctccgcgaacgcgcgtttccgggggccgccgcttcttcngcgggcaacaaggtggccctggctggacgtcctcctggggttggggctcctaatgggtcccccgtggttcaagaggggaaccggggtggccccctcggggaacgccaaaccctttccggggtttcaagcctttggttggcgaatttcaaggcccttgaaaaaaggccggggaaaacctccccccgggggaacccccctgccccaaattcccccg

SEQ ID NO: 76585 - protein, 145 aa, Zea mays
  misc_feature: Ceres CLONE 1561331
  misc_feature (14)..(87): Pfam Name: GST_N Pfam Description: Glutathione S-transferase, N-terminal domain
  misc_feature: SWISSPROT Homolog: EC 2.5.1.18 Glutathione transferase
  misc_feature (126)..(126): Xaa is any aa, unknown, or other
  misc_feature (136)..(136): Xaa is any aa, unknown, or other
MEKTSENAIPPAASPLMLFGSWASSYTHRVQLALRLKGLEYDYVEEDLGNKSDELLRHNPVHKKVPVLVHGGRALPESVIILQYLDDAWPETRPLLPADAFDRALARFWCHFADDKLGPAVGAVFXSTGRPPGGGXCGRCTSTWR

SEQ ID NO: 76586 - DNA, 787 bp, Zea mays
  misc_feature: Ceres CLONE 1561333
  misc_feature: Encodes the peptide sequence at SEQ ID NO. 76587
ctccccgcggtggcggccgctctagaactagtggatcccccgggctgcaggaattcgtctcacccctagaaaaactttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcacccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcatggctgccagctttaacatcattcccagcagcaccggtgctgccaaggctgtcggtaaagttcttcctgaattgaatggcaagctcactggcatgtccttcccgggttcccaccgtgggatgtgttcatttggttgaccctcactggtcaaaatcgaaggaaggggggccctccctttgaagggaaaatttaaaaaaaccctttttaaagggcctggcctttcttgaaaggggcccccacctccaagggggggaaatttatggggggccccacaccctctgggaaaagagaaaaaagaaaaaacccccggggggttttttctccccccaccccgaaataact

SEQ ID NO: 76587 - protein, 115 aa, Zea mays
  misc_feature: Ceres CLONE 1561333
  misc_feature (28)..(115): Pfam Name: Gp_dh_C Pfam Description: Glyceraldehyde 3-phosphate dehydrogenase, C-terminal domain
  misc_feature: SWISSPROT Homolog: EC 1.2.1.12 Glyceraldehyde-3-phosphate dehydrogenase (phosphorylating)
MFVVGVNEDKYTSDVNIVSNASCTTNCLAPLAKVIHDNFGIIEGLMTTVHAITATQKTVDGPSAKDWRGGMAASFNIIPSSTGAAKAVGKVLPELNGKLTGMSFPGSHRGMCSFG

SEQ ID NO: 76588 - DNA, 796 bp, Zea mays
  misc_feature: Ceres CLONE 1561335
  misc_feature: Encodes the peptide sequence at SEQ ID NO. 76589
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
ctggagctccccgcggtggcggccgctctagaactagtggatcccccgggctgcaggaattcgtctcacccctagaaaaaacaccgcgcatcccctgctctcggcagtctctgcacgacctcgtcgaatcattggctccctcctcctccgccgcttccatggactccacgccggcacccgaggcagcccccggcacgtcctcttcctccccggccgcggccgccgagggtcttgcggggggcgtggcggcaatgaccctggatgagcggttcgaaatgctgcggggcatcggggaggagtgcatccaggaggacgagctcagacgactgcttgagaacaagcccgtacccatctgctacgacggcttcgagccatctggacgcatgcacatcgctcagggcgttgtgaagaccatcaacgtgaacaagatggtcagcgccgggtgcaaggtgaaaatttggatcgccgactggttcgcgcagctcaacaacaagatgggaggcgacctgaagaagatccagacggtagggcgctacatgatcgagatttggatagcggctgggatgaacttgaccggggtggagttcctgtggtcctccgaagagatcaacagcgcgcacacgagtactggccaattgtgatggacatctgcccggaaaaaacacggtcaaaggataatgagatgctgccgattttggggcgatggccagnnnnnnncccctttgccggctgcccaaaatttttacccctggcatgccatgggcctgaaaaatttttcttaaaggctggacttttg

SEQ ID NO: 76589 - protein, 160 aa, Zea mays
  misc_feature: Ceres CLONE 1561335
  misc_feature: SWISSPROT Homolog: EC 6.1.1.1
MDSTPAPEAAPGTSSSSPAAAAEGLAGGVAAMTLDERFEMLRGIGEECIQEDELRRLLENKPVPICYDGFEPSGRMHIAQGVVKTINVNKMVSAGCKVKIWIADWFAQLNNKMGGDLKKIQTVGRYMIEIWIAAGMNLTGVEFLWSSEEINSAHTSTGQL

SEQ ID NO: 76590 - DNA, 874 bp, Zea mays
  misc_feature: Ceres CLONE 1561339
  misc_feature: Translation starting site: 200
  misc_feature (312)..(312): n is a, c, t, g, unknown, or other
agctccccgcggtggcggccgctctagaactagtggatcccccgggctgcaggaattcgtctcacccctagaaaaacccctcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacanccggggggggcgccaagagagtggcagcagccctcctcaggaggatggcgtaccggagcaagcagcctgggtttcctggatctcgacctggtgctgggcacgtgggtcgaacatcacctgcacgccatggacgagacgaacatggacgccgttctacaagtgctcgacctcgaaaaccagatttgtggaaatggttgacgagtcaggagcagccaccagaagatctgaattctaatccggtgttttctagcatcaaaatcaaaggtcacaggataactgatcaagcctgctttctcccgagacccgatcaacacctggccaaaccttggggtttgaggatggggatgacttaaagaaaggccaaaaagggccccaggtcttggaaaaccggggaatacgtttccttaaaaggggggttgaacgaattttacatccctaaattattaccttttggccccaaccccaccaaaccggggctggtttggtttgtgttttccaggttaaaaaagaaattaaaccttgggacccgggaagggggaaaaaattttcggtaaaaaccaat

SEQ ID NO: 76591 - DNA, 850 bp, Zea mays
  misc_feature: Ceres CLONE 1561342
  misc_feature: Encodes the peptide sequence at SEQ ID NO. 76592
  misc_feature (698)..(698): n is a, c, t, g, unknown, or other
  misc_feature (756)..(756): n is a, c, t, g, unknown, or other
  misc_feature (778)..(778): n is a, c, t, g, unknown, or other
  misc_feature (794)..(794): n is a, c, t, g, unknown, or other
  misc_feature (850)..(850): n is a, c, t, g, unknown, or other
ggagctccccgcggtggcggccgctctagaactagtggatcccccgggctgcaggaattcgtctcacccctagaaaaaagcgtaacaagtgtccttcctccatcttcctcctccactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagctttggtggttgtcaaacctggacagaataaatcaatcgctggcattgtcactgagagagattatctccggaaaatcatagtgcagggaaggtcttccaagtcaactaaggttggcgacatcatgactgaagagaacaaactgatcacagtgaatcccgacaccaaggtcctgcaggcaatgcagctcatgacagaaaaccgcgtcagacacnatcccggtgatcgacggcacggggaatgctgggggatggtctccatccggcgacatcntgccgcgcggtgggtggccgancacaggggaggagctngacccggctcaatgactacatcccaggaggctactaaggacgggcgtgtgcaacgn

SEQ ID NO: 76592 - protein, 215 aa, Zea mays
  misc_feature: Ceres CLONE 1561342
  misc_feature (65)..(188): Pfam Name: CBS Pfam Description: CBS domain pair
  misc_feature: SWISSPROT Homolog: EC 1.1.1.205 IMP dehydrogenase
  misc_feature (165)..(165): Xaa is any aa, unknown, or other
  misc_feature (184)..(184): Xaa is any aa, unknown, or other
  misc_feature (191)..(191): Xaa is any aa, unknown, or other
  misc_feature (197)..(197): Xaa is any aa, unknown, or other
MQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEENKLITVNPDTKVLQAMQLMTENRVRHXPGDRRHGECWGMVSIRRHXAARWVAXHRGGAXPGSMTTSQEATKDGRVQR

SEQ ID NO: 76593 - DNA, 796 bp, Zea mays
  misc_feature: Ceres CLONE 1561343
  misc_feature: Encodes the peptide sequence at SEQ ID NO. 76594
ctggagctccccgcggtggcggccgctctagaactagtggatcccccgggctgcaggaattcgtctcacccctagaaaaaacaccccgcttcacgttctcaataatggcgccgttcccacgtcgtcttccggccgccgtgccacttctcctcctcctcggcgccgcagtggccagcgccggcgcggaggacaccgatggcggcaactcccgccggcggcactcccgcttgctgttcgcgttcggcaactcgctcaccgacacgggaaacggggccatcttcccggtgactgcaggcgggccattcacccggccgccgtacggggagaccttcttcggtcgtcccagcggccgggcttgcaacggcaggctcgtcctcgacttcctcgtggaggagctgaaggtgccagagccgacgccgtacctggccggcagtacggccgccgactttgcgaagaacggggccaactttgcgctgggtggtgcaacggcgctcgaccaggcgttcttagcaagcaaggggataaagtcgttcgtgcccatctctctcatcaacgagacgagctgtttccagaacgtttcgaagctactggacgcgtcacactacgatgagcgtagatcatgccgaagtcgatcttctacgtcgggggagatcggttgtcacgactactttcgcgccctaagcacaaacgactcgtcgacgtccgggtcagcttggtgccgacatcatcgaaaccattcgttcgccctgaccgtaatgatccatccggggcgaagacagtggtgaacccgggaaac

SEQ ID NO: 76594 - protein, 226 aa, Zea mays
  misc_feature: Ceres CLONE 1561343
  misc_feature: SWISSPROT Homolog: EC 3.2.1.51 Alpha-L-fucosidase
MAPFPRRLPAAVPLLLLLGAAVASAGAEDTDGGNSRRRHSRLLFAFGNSLTDTGNGAIFPVTAGGPFTRPPYGETFFGRPSGRACNGRLVLDFLVEELKVPEPTPYLAGSTAADFAKNGANFALGGATALDQAFLASKGIKSFVPISLINETSCFQNVSKLLDASHYDERRSCRSRSSTSGEIGCHDYFRALSTNDSSTSGSAWCRHHRNHSFALTVMIHPGRRQW

SEQ ID NO: 76595 - DNA, 801 bp, Zea mays
  misc_feature: Ceres CLONE 1561344
  misc_feature: Encodes the peptide sequence at SEQ ID NO. 76596
ctccccgcggtggcggccgctctagaactagtggatcccccgggctgcaggaattcgtctcacccctagaaaaaaggagctactaggtagaccgtgtccccgtagacatgaaacggaagcgtggctagagctagagacgcggaaaagacgagaggaggggcccactgaacccacacagcgcgaggaagcgggaaggacgaccgtgttcccgattcccgttgcaccatgccaccgtgacaccgtctctctctctctgtcaggcctccgctccgccgctttaaaacctaagccgaaccactgctccgcccactccatcccggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccatggcatgatctggagataggtcctggtgctccaaccatattctactgcgtcattgagatacccaggggcagcaaggctaaatatgaacttgaccagaaaactggactgatcaaggtggaccgtgtgcagtattcatcagttgtttaccctcacaacgatggattcattcctcgcacgctttgtgaagacagagatccttatggatgaactggttataatgctggagcctgctatcccaggctgtttcctacctgcgaatgccatgcgccttatgccgatga

SEQ ID NO: 76596 - protein, 105 aa, Zea mays
  misc_feature: Ceres CLONE 1561344
  misc_feature: SWISSPROT Homolog: EC 3.6.1.1 Inorganic diphosphatase
MAPAVEAVKETGTFQKVPALNERILSSMSRRSVAAHPWHDLEIGPGAPTIFYCVIEIPRGSKAKYELDQKTGLIKVDRVQYSSVVYPHNDGFIPRTLCEDRDPYG

SEQ ID NO: 76597 - DNA, 612 bp, Zea mays
  misc_feature: Ceres CLONE 1561346
  misc_feature: Encodes the peptide sequence at SEQ ID NO. 76598
acccgcggtggcggccgctctagactagtggatcccccgggctgcaggaattcgtctcacccctagaaaaagcagagccgccgacaacgctctctaccgtccgagaccccaagcaccagcgcggcggcgggggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcagggctccgtgctgaagatgtgcaggggcaggaaatggtgctcacaaacttttggggggcattgaatttttacccactggataaaactccagaatcccctaggtggaaaaaaagtgggcaaaaaaaattttaatcggaaagccccccatgggttgaattgttccaaagaaaaaacccggaaaaaaaccttacccttggtttttgcccgtttttttt

SEQ ID NO: 76598 - protein, 88 aa, Zea mays
  misc_feature: Ceres CLONE 1561346
  misc_feature (11)..(88): Pfam Name: Ribosomal_S3Ae Pfam Description: Ribosomal S3Ae family
MAVGKNKRISKGKKGGKKKTVDPFSKKDWYDIKAPSVFSVRNIGKTLVSRTQGTRIASEGLKHRVFEVCLADLQGDEDQAYRKIRAPC

SEQ ID NO: 76599 - DNA, 804 bp, Zea mays
  misc_feature: Ceres CLONE 1561351
  misc_feature: Encodes the peptide sequence at SEQ ID NO. 76600
tggagctccccgcggtggcggccgctctagaactagtggatcccccgggctgcaggaattcgtctcacccctagaaaaagcgcgtgcccgtttgtggccgaaatcgcagcgcgggtgggtagaccgtagaagactgcagggccggccagccgagcagagctgccgaagccaccacccacccatggcccccgtccccgtgtcggtgtcggccaccctcgcgccgccgccggcggcgccgccaaaggcaacatccaggagctgggaacggcgtgcgccggctgacgccgcgttcgcggccgcctcttccgtcgccatctcggccgcgttgctgacactgacgccggccgcgcccgccgcggccttgtccaaggaggacgtcgccggctcgcttaccaaggccgtggacacggtgagccaggccatcgacgtcggcggcaaggccgctgagcaggtggcggcccgtgctcaagccgttggggcgaaggccgtcaaagccggccgccttcccggtccttgaaggagcgcccagcggacgaggcccctcaaagctggggccggccccccgggggtggccccccccgcccttccaaagcggggccccgggaagggacccctcagggggggcccgggggttttaaccccccccccccgttttttggccggttccccaaaaaacccccccgggaaaaaaaaaaccccaaagggggtgttttacccccccccaaaaccccggggtgctcgtgggggggcggggggaaaacaccataccttcccttgggggcccccaggaaaaacatcttttgt

SEQ ID NO: 76600 - protein, 111 aa, Zea mays
  misc_feature: Ceres CLONE 1561351
MAPVPVSVSATLAPPPAAPPKATSRSWERRAPADAAFAAASSVAISAALLTLTPAAPAAALSKEDVAGSLTKAVDTVSQAIDVGGKAAEQVAARAQAVGAKAVKAGRLPGP

SEQ ID NO: 76601 - DNA, 821 bp, Zea mays
  misc_feature: Ceres CLONE 1561354
  misc_feature: Translation starting site: 149
  misc_feature (623)..(623): n is a, c, t, g, unknown, or other
tggagctccccgcggtggcggccgctctagaactagtggatcccccgggctgcaggaattcgtctcacccctagaaaaaagcgggacgaactcgtcactggtgtgggccgtggctgtacgccgcagagtgaagcgagacgagacgacgatgcgcaagtgggcgctctcctccgcgctcctcctcctcttcctcctcaccaccctccccgacccagctaagaagctacaggtgaatgcggaagagagcagcgatgacttagctaacccacccaaggtagaggagaagcttggtgctgtccctcatggcctgtccaccgactctgaggttgcccagagggaagctgagtctatctctaggaagactcttaggagctccgccgagaagtttgagttccaggctgaggtgtccagactcatggacatcatcatcaactcactctacagcaacaaggatatcttcctgagggagctcatatccaatgcctctgatgcattggataagatcaggtttcctttccttactgataaggaaagtctggggtgaaggtgacactgcaaagcttgagattcagatttagttggacaaagagaagaaaatcctctccatcggggatagggggtantgggattgaccaaggaggatctttataaatacctttggaacctttgctaagtccggcacttcagcttttggggaaaaaatgcatcccgggagtgactccatcttttggggaaggttgggggttggctccacccggggggacttgggtggccgaaactttggcaaaggggcccccacgcccactggtgaaaaaccaatg

SEQ ID NO: 76602 - DNA, 775 bp, Zea mays
  misc_feature: Ceres CLONE 1561355
  misc_feature: Encodes the peptide sequence at SEQ ID NO. 76603
  misc_feature (486)..(486): n is a, c, t, g, unknown, or other
  misc_feature (487)..(487): n is a, c, t, g, unknown, or other
  misc_feature (489)..(489): n is a, c, t, g, unknown, or other
  misc_feature (490)..(490): n is a, c, t, g, unknown, or other
  misc_feature (566)..(566): n is a, c, t, g, unknown, or other
ctccccgcggtggcggccgctctagaactagtggatcccccgggctgcaggaattcgtctcacccctagaaaaaatccctaatcccagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgagcgggaatttggttcagtgttgctattcctcattctttttgtatcatatatgtctgcgacatttatatatatgaataaagttggatgatctgctgcnnannaaaaaaaaaaagaaaaaaaaaaaaaaaaaaaactggtgcagggtcaccctttcccctcggcctcaagagctctgcnggttgccgcggccaaggggcgtcccgtgggagaagcggggagcaaggtgggcggcgtatgggaagagcaaaggcggcccaggccggggcctcgggttggggcgggcccaagaaaaaatttccgggggttcccctcccccccttaaaggtttttcccgaaaaaggggttccctttaagaaaaaacaaattgttcccccaataaaaggggg

SEQ ID NO: 76603 - protein, 65 aa, Zea mays; identical to SEQ ID NO: 66489
  misc_feature: Ceres CLONE 1561355

SEQ ID NO: 76604 - DNA, 808 bp, Zea mays
  misc_feature: Ceres CLONE 1561360
  misc_feature: Encodes the peptide sequence at SEQ ID NO. 76605
  misc_feature (490)..(490): n is a, c, t, g, unknown, or other
  misc_feature (491)..(491): n is a, c, t, g, unknown, or other
tggagctccccgcggtggcggccgctctagaactagtggatcccccgggctgcaggaattcgtctcacccctagaaaaaaccgcgcgcgcgtgtgctcgcctcacttcgcttggcccggctgtctccacgccacgctgcccacaatcccctttcccctccagtaggtagagtggcgagaaggatggtggccgtgtccacggcgacgatggcgagctcgctgctcctccggccgcgcgcgctcctgccaccccatccgattcctagctccagccgccggccattgccagctccgcgtgtacaactacaggggagcatccaggagaagccgggccttccggcgaaaagcgacggcgagcggaggcggccggctgggacgcggctctactcgctggcgccctaccctctgctgctggccgcgctgctgccgggagctgagccggtgacggccgtgttcgcgccgttcgtggagctggtgaagacgtgggaccnntcccggctggctcgtgcactgggggccacccgggtaacatggctgtggtgctcttcgcaatggggtggttaccgggacatacctgggggcttcaggatcaaactatcagacggaccttgaaagaaaaaggccaaggcccaaagattccccacccgaaaactccctcggccggggatgttttcttttttctttccccccttgggggccgaaccccgggggggaattaaaaagtcttttttttcccccttaaaaaaaaaacccctttttttttaaaaaacccccctaaccgcccggggaaaacggggaaaattcttccc

SEQ ID NO: 76605 - protein, 142 aa, Zea mays
  misc_feature: Ceres CLONE 1561360
  misc_feature (103)..(103): Xaa is any aa, unknown, or other
MVAVSTATMASSLLLRPRALLPPHPIPSSSRRPLPAPRVQLQGSIQEKPGLPAKSDGERRRPAGTRLYSLAPYPLLLAALLPGAEPVTAVFAPFVELVKTWDXSRLARALGATRVTWLWCSSQWGGYRDIPGGFRIKLSDGP

SEQ ID NO: 76606 - DNA, 792 bp, Zea mays
  misc_feature: Ceres CLONE 1561361
  misc_feature: Encodes the peptide sequence at SEQ ID NO. 76607
  misc_feature (541)..(541): n is a, c, t, g, unknown, or other
  misc_feature (770)..(770): n is a, c, t, g, unknown, or other
agctcaccgcggtggcggccgctctagaactagtggatcccccgggctgcaggaattcgtctcacccctagaaaaaaacaacgcctcctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcggctaccgcgtctgctcgtacctggacccntccgagcccacgcacaccaaggtgaagcagctgctcttctccctcctgctctccagcaggacgacgtgatccccaccttgcgctccaactaatctcgctcctcggcaccgttgaagctgaactgggcaagggccgcaaagcccaaattcacaagctcaaagacttcacctcttttaaataatccgggaaggcttacttgggggggggccctttggcgaccaaactttgnaagggggggcccaacagggggt

SEQ ID NO: 76607 - protein, 139 aa, Zea mays
  misc_feature: Ceres CLONE 1561361
  misc_feature: SWISSPROT Homolog: EC 4.2.1.92 Hydroperoxide dehydratase
MASSDHGSTTAPKDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGYRVCSYLDPSEPTHTKVKQLLFSLLLSSRTT

SEQ ID NO: 76608 - DNA, 836 bp, Zea mays
  misc_feature: Ceres CLONE 1561363
  misc_feature: Translation starting site: 264
  misc_feature (521)..(521): n is a, c, t, g, unknown, or other
  misc_feature (657)..(657): n is a, c, t, g, unknown, or other
tggagctccccgcggtggcggccgctctagaactagtggatcccccgggctgcaggaattcgtctcacccctagaaaaaaatccgtccaatcaaccgggctgctctgctgcctctccggcgccattgacgagcaagagagtgctccgacacctggtccgtcgcgtgccgtgcccacccgctaaggccagggcgccccgactcgagctcaccgcgtcgaactcgaaccgctgctgttcctcggcagggggcagggtcgtcgaggatgccggagcactcagagaacgcggcggcggacctgatgggcaacatcatggagaccatcgcggagaacctcccgaggcagaagtccgtgcggttcgacgacggcgacggctcctccatctccgagcaggccaagaagctgttcagcggcggcgagagcaggaagaagtcggtccaccacgtgctgggcggcggcaaatccgccgacgtgctgctgtggcggaacaagaagatctcgtccagcgtgctgggcgtggcngacgctggtgtgggtgttcttcgagtggctggactaccacttcctcaccatcctctgcttcgtgctcgcgctcggcatggccgtccagtttcgctggtccatctttctcgtcagcgtgcctcgcgtgcagctgccngaagagctggtcgctagcgccggcccggcccccgcccccaggtgacaaggcgctgggctccttcaagacttggcctgcgaaaccacctcaagggttggcctcgtgatcgccgggttttccctggggggttttggaaatttttgaaaccctgaaggtatttaatggggttcgttgcgccc

SEQ ID NO: 76609 - DNA, 827 bp, Zea mays
  misc_feature: Ceres CLONE 1561366
  misc_feature: Encodes the peptide sequence at SEQ ID NO. 76610
  misc_feature (578)..(578): n is a, c, t, g, unknown, or other
  misc_feature (722)..(722): n is a, c, t, g, unknown, or other
  misc_feature (789)..(789): n is a, c, t, g, unknown, or other
ggagctccccgcggtggcggccgctctagaactagtggatcccccgggctgcaggaattcgtctcacccctagaaaaagacgcggttcggttccagtttcactcccactgccgtctcggcaacctcccctgttccacgcttcgtcctcgcgttcccaaccaagctctcccgcctgccatggccgcgacctcccccttcgactgcgtcctcctagacctcgacgacaccctgtacccgggcgacacgggcatcggcgcggccctgaggcgcaacatcgacgagttcctccaggccaagctcggcgtgtcggccgacgaggccgccgccacgcgcgccgagctcttccgcgcgcacggcagctccctcgccgggctcatcgcgctcggctacgacgtgcacccggacgagtaccacagctacgtgcacggcaggctaccgtacgacaggatcgcgcgcgacccgcagctggcgcgcctgctgcagagcatcccgcagcgcaaagtgctgttcaccaactcggaccgcgcgcacatggagcgggcgctggagcggctgggcgtggacgaggccgccttcgnacgacgtcgtgtgcttcgagaccatgaacccgcacctgttcgggcgacagcggtggcgaccgggcgcccggccgtggtgctcaaaaccggctgtgggacgcaaatcgtcgcccgggctgcgcgcccgccggctccaacccacgncggggacgctgttcctggaccacagcgagaagaacatcccccgccgggaaaagcgctcggccttcgnaaaccgccttgggttggcaaaaggtcgaagaaccagga

SEQ ID NO: 76610 - protein, 216 aa, Zea mays
  misc_feature: Ceres CLONE 1561366
  misc_feature (134)..(134): Xaa is any aa, unknown, or other
  misc_feature (182)..(182): Xaa is any aa, unknown, or other
MAATSPFDCVLLDLDDTLYPGDTGIGAALRRNIDEFLQAKLGVSADEAAATRAELFRAHGSSLAGLIALGYDVHPDEYHSYVHGRLPYDRIARDPQLARLLQSIPQRKVLFTNSDRAHMERALERLGVDEAAFXRRRVLRDHEPAPVRATAVATGRPAVVLKTGCGTQIVARAARPPAPTHXGDAVPGPQREEHPPPGKALGLRKPPWVGKRSKNQ

SEQ ID NO: 76611 - DNA, 841 bp, Zea mays
  misc_feature: Ceres CLONE 1561369
  misc_feature: Encodes the peptide sequence at SEQ ID NO. 76612
  misc_feature (424)..(424): n is a, c, t, g, unknown, or other
  misc_feature (485)..(485): n is a, c, t, g, unknown, or other
  misc_feature (526)..(526): n is a, c, t, g, unknown, or other
  misc_feature (699)..(699): n is a, c, t, g, unknown, or other
  misc_feature (735)..(735): n is a, c, t, g, unknown, or other
ggagctccccgcggtggcggccgctctagaactagtggatcccccgggctgcaggaattcgtctcacccctagaaaaaacccatccaagataccgacgagcaggccagagcgaaggaatggactccatggccagcgacgacagcaaccaaggagcagcagccaagccgaagccgaagccaccaccgctaccgctgtccgtgcgcctccagctggccgggctgacagcggccatcgacgccgtggagcgccgcgacgggacggtgaaccgctgcctgtacggcgtgatcgaccggctcctgagcgcgcgcgccagcccgcgcccggacgcctccggggtgcgctcctacgacgtgaccatggacgcgtcccgcggcatctgggcgcgcgtcttcgcgccggccgcggcggaccgcccgctccccngtggtggtgtacttccacggcggcggcttcgcgctcttctccccggccatcgggcccttcnaacggcgtgtgccgccgcctctgcgccgcgctcggcgccgntcgtggtgtccgtcaactaccgcctggcccgggagcaccgctggcccgccgcctacgacgacggcgtcgacgcgctgcgcttcctcgacgcccgcggcggcgtcccgggcctgggacgacggcgtgcccgtcgacctcggcacctgctttctggcccggggagagcgcgggcngaaaacatcgtgcaccacgtcgccaaccgctggggncgcggcgtggcagccgtccgcgcggggccttcggggttcgcgggcgtctttcccgtgcaggcctaacttcgggcggcgtggagcgcacgccgtccgagctgaaact

SEQ ID NO: 76612 - protein, 227 aa, Zea mays
  misc_feature: Ceres CLONE 1561369
  misc_feature (103)..(103): Xaa is any aa, unknown, or other
  misc_feature (123)..(123): Xaa is any aa, unknown, or other
  misc_feature (137)..(137): Xaa is any aa, unknown, or other
MDSMASDDSNQGAAAKPKPKPPPLPLSVRLQLAGLTAAIDAVERRDGTVNRCLYGVIDRLLSARASPRPDASGVRSYDVTMDASRGIWARVFAPAAADRPLPXGGVLPRRRLRALLPGHRALXTACAAASAPRSAPXVVSVNYRLAREHRWPAAYDDGVDALRFLDARGGVPGLGRRRARRPRHLLSGPGRARAENIVHHVANRWGRGVAAVRAGPSGFAGVFPVQA

SEQ ID NO: 76613 - DNA, 800 bp, Zea mays
  misc_feature: Ceres CLONE 1561371
  misc_feature: Encodes the peptide sequence at SEQ ID NO. 76614
agctccccgcggtggcggccgctctagaactagtggatcccccgggctgcaggaattcgtctcacccctagaaaaagcccatccttgtgacggctcctcgccagtcgcctcgtctctccctgccgcgtcgcctccagttccgcctccgccgcgcctcccgcctccgccgcgcctgacgaacgcagtataggactgtgcaggtagagaggaggagggtccggcgagatggggatgcgagataagaagcggaaccagaagcgagtgctcgcgcgccgtaccgcggcaccgcgcccaggcgagggcaaggatttcctgccgctggaaggaggccccggtaagaagcatctgaaggtgcagcagcctgaagagcccgaaaacacagccacaatcgtctacattgggcatatcccccatggtttctacgaggacgagatgaaagggttctttaagcagtttggggatattaagaggcttaggatcgctcgtaaccgcaagacaggaaagtccaagcactatggattcattgagtttgagaaccctgctgtggcaaaggtcgtagcagatgagatgaataactatctcttgtttgagcgcaccttgcaagttgcacttgttgagccagagaaagttcatcctaaattatggaaaggggtgcgaaggggatttatacctggttgatcgagtagcaattgaacggaagagacacaacaaggataagactgtagcagagcacaaaaagatggttgaaggaatttgtaagcgggatggaaagcgtcgcaaaagatcaaggcagctggtat

SEQ ID NO: 76614 - protein, 150 aa, Zea mays
  misc_feature: Ceres CLONE 1561371
  misc_feature (56)..(127): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGMRDKKRNQKRVLARRTAAPRPGEGKDFLPLEGGPGKKHLKVQQPEEPENTATIVYIGHIPHGFYEDEMKGFFKQFGDIKRLRIARNRKTGKSKHYGFIEFENPAVAKVVADEMNNYLLFERTLQVALVEPEKVHPKLWKGVRRGFIPG

SEQ ID NO: 76615 - DNA, 850 bp, Zea mays
  misc_feature: Ceres CLONE 1561372
  misc_feature: Encodes the peptide sequence at SEQ ID NO. 76616
  misc_feature (634)..(634): n is a, c, t, g, unknown, or other
  misc_feature (645)..(645): n is a, c, t, g, unknown, or other
  misc_feature (667)..(667): n is a, c, t, g, unknown, or other
  misc_feature (683)..(683): n is a, c, t, g, unknown, or other
  misc_feature (736)..(736): n is a, c, t, g, unknown, or other
ctggagctccccgcggtggcggccgctctagaactagtggatcccccgggctgcaggaattcgtctcacaccagagaccccttgctaatttaccgacccctgagaactgcttacttggaaagattcaggaggggactgctggatggcacaaagtgtcggatgaagcagccaggactattccgggaagggagaatggcggtaattgtgacataaaaaacctaagcagaggttccaaagtttatctgccagtatttgtcgaaggagcgaatcttagcaccggtgatatgcacttctcccagggcgatggtgaagtttcgttttgtggagcaattgaaatgagtggattccttgagctcaagtgcgagatcataagaggcgggatgaaggaatacttgaccccagttggtccgacaccgctacacgtgaaccctatctttgagatcggtcctgtcgagccacgcttctcggagtggctagtgtttgagggcataagcgtggatgaatctgggaagcagcatttccttgatgcgtcagttgcttacaagcgtgcagtcctgaacgccattgagtacattgctagatttgggtactcgaaggagcaggtgtatctcttactatcatgctgtccctgtgnagggtaggatnctctggaatagttgactctccntaatgcagtggcaacntcttgccatccctacagcaatatttgatcaggatataaagccaaaacacctgnagaggaagaccggggaccaaagtttgatagggcttccagatctcctgagctgttcaaacaatggggcatattcctgtcccccaagaccaaagtgggtacagggcgtcctagggg

SEQ ID NO: 76616 - protein, 212 aa, Zea mays
  misc_feature: Ceres CLONE 1561372
  misc_feature (2)..(213): Pfam Name: FmdA_AmdA Pfam Description: Acetamidase/Formamidase family
  misc_feature: SWISSPROT Homolog: EC 3.5.1.49 Formamidase
  misc_feature (211)..(211): Xaa is any aa, unknown, or other
GAPRGGGRSRTSGSPGLQEFVSHQRPLANLPTPENCLLGKIQEGTAGWHKVSDEAARTIPGRENGGNCDIKNLSRGSKVYLPVFVEGANLSTGDMHFSQGDGEVSFCGAIEMSGFLELKCEIIRGGMKEYLTPVGPTPLHVNPIFEIGPVEPRFSEWLVFEGISVDESGKQHFLDASVAYKRAVLNAIEYIARFGYSKEQVYLLLSCCPCXG

SEQ ID NO: 76617 - DNA, 855 bp, Zea mays
  misc_feature: Ceres CLONE 1561375
  misc_feature: Encodes the peptide sequence at SEQ ID NO. 76618
  misc_feature (756)..(756): n is a, c, t, g, unknown, or other
  misc_feature (831)..(831): n is a, c, t, g, unknown, or other
agctccccgcggtggcggccgctctagaactagtggatcccccgggctgcaggaattcgtctcacccctagaaaaaatcccaacccactcacagtctcacgctactatcgctatctagagctccggccgtcacagacacgagctagagctagagctgcagggaagaagaagaaggaggaggaggagaagatgagggcgtccgcgctggtctgcttcgtggcggtgtcggcgtgcatagcgtgcatcgcgcatggcggcaacttctaccaggacacggagatgacctgggggcaggggcgcggcaaggtggtggacggcgggcgcgggctggacctgagcctggacagggcctccgggtccgggttccagtccaaggacgagtacctgttcggcaagatcgagatgcagatgaagctggtgcctggcaactcggcgggcaccgtgacgaccttgtacctgtcgtcgcagggcgacgcgcacgacgagatcgacctggagttcctgggcaacgtgtcgggcgagccctacacgctgcacacgaacgtgttcacgcgcgggcgggggcagcgggagcagcagttccgcctctggttcgaccccaccgccgacttccacaccctactccgtgggtgtggaacccgcggcacgtcatcttcgcggtggacggcacgccgggtgagggacttcgccaaccgcgaggccctgcggggggtggcgttccccgcggtacgcagcccatgcggggtgtacgccagncctctggaaacgccgacgactggggccacgcaggggcggccgcggtcaaggcgggactggggcgcggggcgccgnttcgtcgccctcggttccgcgggg

SEQ ID NO: 76618 - protein, 222 aa, Zea mays
  misc_feature: Ceres CLONE 1561375
  misc_feature (25)..(211): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature (189)..(189): Xaa is any aa, unknown, or other
MRASALVCFVAVSACIACIAHGGNFYQDTEMTWGQGRGKVVDGGRGLDLSLDRASGSGFQSKDEYLFGKIEMQMKLVPGNSAGTVTTLYLSSQGDAHDEIDLEFLGNVSGEPYTLHTNVFTRGRGQREQQFRLWFDPTADFHTLLRGCGTRGTSSSRWTARRVRDFANREALRGVAFPAVRSPCGVYAXPLETPTTGATQGRPRSRRDWGAGRRFVALGSAG

SEQ ID NO: 76619 - DNA, 805 bp, Zea mays
  misc_feature: Ceres CLONE 1561376
  misc_feature: Encodes the peptide sequence at SEQ ID NO. 76620
  misc_feature (754)..(754): n is a, c, t, g, unknown, or other
  misc_feature (770)..(770): n is a, c, t, g, unknown, or other
ggagctccccgcggtggcggccgctctagaactagtggatcccccgggctgcaggaattcgtctcacccctagaaaaagctgtggctgcggcacaaacaccgcgccagcacaacacatacgcatacctcaccttcctttcctcctcccgtcctccatcaaaagaaggcagggaaagatctgatctggggggtgagagagcaggaggagaaagccaagccattgccctcccctcttgaaggcttggagcttggttctacatcctcttctcttcccctccgtctttctctctctctctctctatttggtttgcttgcttgcctctactagactctagtcgtcgggtccggccatggccaccatcctggagaacatccagaaggcgaggttcctgccgaccaggccgctcaaggacgagctgcccaccttccagggcggcggcggcggcaagggcaaggaggagagccacctcatgggcctgaggaagcggctgtccagcttctccggcaagatccagcccatctcctccgcgtcggccgccgagtgggcgttccgccgctccaagtcggcgccctccctcggcgccgccttcgccgcggggggcggctccctgaggcagtggtggcagtggggcgtcggctggctcctgtccaagaagcccgggttcgcgggcgacctcgagatgaacgaggaggaggtcgccgcgctgggccgccagagcaggggcacctgggcccacgtcctcttcaagatgcnggtcgggcgtcgccgnctcgttgggtcggggaatcgctccccacaagaaaa

SEQ ID NO: 76620 - protein, 151 aa, Zea mays
  misc_feature: Ceres CLONE 1561376
  misc_feature (135)..(135): Xaa is any aa, unknown, or other
MATILENIQKARFLPTRPLKDELPTFQGGGGGKGKEESHLMGLRKRLSSFSGKIQPISSASAAEWAFRRSKSAPSLGAAFAAGGGSLRQWWQWGVGWLLSKKPGFAGDLEMNEEEVAALGRQSRGTWAHVLFKMXVGRRRLVGSGNRSPQE

SEQ ID NO: 76621 - DNA, 840 bp, Zea mays
  misc_feature: Ceres CLONE 1561378
  misc_feature (161)..(161): n is a, c, t, g, unknown, or other
  misc_feature (162)..(162): n is a, c, t, g, unknown, or other
  misc_feature (813)..(813): n is a, c, t, g, unknown, or other
ggagctcaccgacaggtggcggccgctctagaactagtggatcccccgggctgcaggaattcgtctcacccctagaaaaaaatcgtccggccgggttcgtcgggaagcgacccaaccccacgcccgcttccaacctcgttctgaccgacggcgtaccgccnngtgccgcgccaccgctatacttacatctgctccatcatccctcgcccgccgcgaccaccacctcggcagggaaatccactccggtttctcctcctcgcagcgtctcttcccccatcgggaaatcccggttggccccccccgtaatcactccctcgcccttgggcccccggttattttcccctcctaaccccaaccccccggggggccccaaggggcccccgaaggcgcggggaattgggggaaaaaaggggcaaccgggggggggtggtccgaaacaaaatttttggggggacaccttttctttggctccaaattgccggggtgtagtgggggctcttcccccaggggggggcttttatcccccccccccgctttatatgggggggggggggggggcggcggctcccccgcgaaaaaaccccacggggggtgccccccgcccggggaggggagagggcccgccctccccaaaaaaaaaaaatagttgttttctctccaaagcgccggccgcctttttttaaaaagagagggtgttttctttttccccccaaaggggtggtttctctccttggggggggctgtcctctcctgcaaacaccccccccttttttttgggggggagttgatgggcggccggagaacaaaccaaancacccgctgcggaggagaaaacaaacc

SEQ ID NO: 76622 - DNA, 794 bp, Zea mays
  misc_feature: Ceres CLONE 1561380
  misc_feature: Translation starting site: 180
ctccccgcggtggcggccgctctagaactagtggatcccccgggctgcaggaattcgtctcacccctagaaaaaaccaaaccaacactcgagctaagctcagcctcacacagcctctcctctcgagctagagtgctactagcttagaagaagcagcagcttacagctgaagctgcagcaatggcgaaatcttacaccttactgttcgtcgcactggtcgttctggcccttctagtgagccccattgcttgctcccgcaagctcgccaagccgaacaagcccaagccgacccacaagccggcggccagggtcacgcccggcagcaaccacaccggtatccccgcagtgtctgccgcctacggttccggcggctggttgtctgccggcgcgacgtactacggcgccccaaacggcgacggcagtgacggcggtgcgtgcgggtaccagaccgccgtcgggcagcgccccttctcgtcgatgatcgccgccgggagcccgtccctgtttcaagggggggcaagggctgcggcgcctgctacgaggttaaatgcgacagcaacccggcatgctccggccagccggccaccgtggtcatcaccgacgagtgccccggcggtgtctgcctcgcagaggcggctcacttcgacatgagcggcacctccatgggcgccatggcgaagcccggcatggccgacaggcttcgcgcccgcggcatcctcaagatcaggtacaagagggtgccgtgcagatacagcggcgtgaacatcggctttccgttgggaccagggatccaac

SEQ ID NO: 76623 - DNA, 783 bp, Zea mays
  misc_feature: Ceres CLONE 1561383
  misc_feature: Encodes the peptide sequence at SEQ ID NO. 76624
  misc_feature (726)..(726): n is a, c, t, g, unknown, or other
ctccccgcggtggcggccgctctagaactagtggatcccccgggctgcaggaattcgtctcacccctagaaaaaatccataaaaaggacggcgacgcggtcaccactgcggcaccgccgccgccgccatcctcgacccctgaagtgaagaggcaacccgaggacgcctctcccatccacgcgcgaatcctaccgccctcccactcccaaaaacctagccgcgcgcgccacctgcatcccatggcggcaaccgcggccgtggcggggaccgggtcgtccctctcctcgcgccgcagtcgcagcgttgtctcctcgtccttccgcgcagctgcctcgcgcttccgctcgccggtgagcgtttcgtctcgtcgtggggctttctgattcacgtgtgatgcctacgaagcggtgaggtattgtgtgtttttggttggtcttcttttggtgtgcgcagagatgcgtgctcgggagcgagcagctgcgggtggcgcatgaagggaagcggatgagcggcgccgagtccaggaccgcgtgggcgccaaaggtgcccgcaccggagtccaggcttgccgcactgccaagggagctgcgggactccaggatgaagatcttctccggcacggctaaccgtccgctcgctcagggaattgctgcttacctgggtatagaactcggcaagatcctgatcaagcgctttgctgatggaagaaattatgtgcactgcaanagaacgtgagaagaagtgatggtgtccttgattccagccacatgctctcctgtcaac

SEQ ID NO: 76624 - protein, 76 aa, Zea mays
  misc_feature: Ceres CLONE 1561383
  misc_feature: SWISSPROT Homolog: EC 2.7.6.1 Ribose-phosphate diphosphokinase
  misc_feature (74)..(74): Xaa is any aa, unknown, or other
MSGAESRTAWAPKVPAPESRLAALPRELRDSRMKIFSGTANRPLAQGIAAYLGIELGKILIKRFADGRNYVHCXRT

SEQ ID NO: 76625 - DNA, 845 bp, Zea mays
  misc_feature: Ceres CLONE 1561384
  misc_feature: Encodes the peptide sequence at SEQ ID NO. 76626
  misc_feature (581)..(581): n is a, c, t, g, unknown, or other
agctccccgcggtggcggccgctctagaactagtggatcccccgggctgcaggaattcgtctcacccctagaaaaaatcgtcctccgctccagcagctgccacagagacatcagagagcggtcctccttgtgagtctgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcagggcgcgcacgcggtgcggctgggcaacgaggcgtcgatccggcagcgcctggccgtggcgcgcggcgcctactacgccatcacgttcagcgcgggcgcggacgtgcgcgcaggcggaacggcagcggctgaccgtgtncgtgagccccgaatgggggggtgctgcccatgcaaaccatcctacgcagcaacggcttgggactcgtaccccttgggcattcaaaggcaaaattggaccccggtgacccttgtcatccccaaccccggggcaaggaggaagaaccgggcctggggcccccttattgaagggtgtccccattcggggccctgtacccccccgccttttcccggggggggggggggaaaaaccccctttaaaaaacgggggggtttcgaaagaagg

SEQ ID NO: 76626 - protein, 215 aa, Zea mays
  misc_feature: Ceres CLONE 1561384
  misc_feature (43)..(214): Pfam Name: DUF642 Pfam Description: Protein of unknown function, DUF642
MRRVALLLVAAVCALAAPAAAVVTDGLLPNGNFEDGPPKSALVNGTVVSGAHAIPRWETSGFVEYIESGHKQGDMLLVVPQGAHAVRLGNEASIRQRLAVARGAYYAITFSAGADVRAGGTAAADRVREPRMGGCCPCKPSYAATAWDSYPLGIQRQNWTPVTLVIPNPGARRKNRAWGPLIEGCPHSGPCTPPPFPGGGGGKTPFKKRGGFERR

SEQ ID NO: 76627 - DNA, 841 bp, Zea mays
  misc_feature: Ceres CLONE 1561393
  misc_feature: Encodes the peptide sequence at SEQ ID NO. 76628
  misc_feature (695)..(695): n is a, c, t, g, unknown, or other
  misc_feature (774)..(774): n is a, c, t, g, unknown, or other
  misc_feature (782)..(782): n is a, c, t, g, unknown, or other
  misc_feature (783)..(783): n is a, c, t, g, unknown, or other
ctggagctccccgcggtggcggccgctctagaactagtggatcccccgggctgcaggaattcgtctcacccctagaaaaaaccgtccacctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgcccagaaggttgttatctctgccccaagcaagatgcgcccatgtttgttgttggtgtcaatgaagaccagtacaccctccgatggttaacacttggttccccaatgctagctggcaccacaaaactgcccttggctcccccctttgctaagtcatttcatgacacctttggngccctttattggagggcttgatgacaactgttcatgccatcctgccacccagaaaactggttgatggacctttcagcanggaactgnnagaggttggcaggggctgccaagcttttacatcatttcccaagcagcaccgttgctgc

SEQ ID NO: 76628 - protein, 146 aa, Zea mays
  misc_feature: Ceres CLONE 1561393
  misc_feature (4)..(145): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAQKVVISAPSKMRPCLLLVSMKTSTPSDG

SEQ ID NO: 76629 - DNA, 857 bp, Zea mays
  misc_feature: Ceres CLONE 1561394
  misc_feature: Encodes the peptide sequence at SEQ ID NO. 76630
  misc_feature (618)..(618): n is a, c, t, g, unknown, or other
  misc_feature (622)..(622): n is a, c, t, g, unknown, or other
  misc_feature (623)..(623): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
ctggagctccccgcggtggcggccgctctagaactagtggatcccccgggctgcaggaattcgtctcacccctagaaaaaagaggagcaaacagcaactccagaagatgagtctccctcgccgccgccaccttgtcctgctcgcctgcctcctggtcttcctcgtcttcgccgcgtccgcgtcgacgagttccgccgaggtggccccgagcgtggcggtggacttcgtgcggcggtcgtgccggtcgacggagtacccgcgcgtgtgcgagagcacgctggtcccctgcgcggctggcgtggggcgcagcccgcgcctgctggcgcgagcggcgctggtggttggcgccgaccgcgcgcgcaactgctcctcctacatccgcggcggcggcggcggcgcgatgaaggactgcgcggagctggcgcgcgacgcggaggagcggctgcggcagtccgcggcagagatggagcggatgggccgtgccggcacaccgcgcttcgcttggtccctcagcaacgtccagacctgggccagcgccgcgctcaccgacacctccacctgcctcgactccctcgcccagcagtcccgcggtggcaaggacagcgacgagcctcaggnaaannaaagggggggggtgggtgnnngttggcaaaggcaacaaagaaacggggctgggggctcgtcaacagggcttccagccgggcgccgcacccggcggggcgtctccctgtggacttcttggtagcaggcagcctagcccacggaaaattcttttgatgggttcccctcgtttctcaatccatggttcgacaattcatccgtcccccctggcatcttcctttctcccaattggccat

SEQ ID NO: 76630 - protein, 212 aa, Zea mays
  misc_feature: Ceres CLONE 1561394
  misc_feature (35)..(198): Pfam Name: PMEI Pfam Description: Plant invertase/pectin methylesterase inhibitor
  misc_feature: SWISSPROT Homolog: EC 3.1.1.11 Pectinesterase
  misc_feature (171)..(171): Xaa is any aa, unknown, or other
  misc_feature (172)..(172): Xaa is any aa, unknown, or other
  misc_feature (173)..(173): Xaa is any aa, unknown, or other
  misc_feature (179)..(179): Xaa is any aa, unknown, or other
  misc_feature (180)..(180): Xaa is any aa, unknown, or other
MSLPRRRHLVLLACLLVFLVFAASASTSSAEVAPSVAVDFVRRSCRSTEYPRVCESTLVPCAAGVGRSPRLLARAALVVGADRARNCSSYIRGGGGGAMKDCAELARDAEERLRQSAAEMERMGRAGTPRFAWSLSNVQTWASAALTDTSTCLDSLAQQSRGGKDSDEPQXXXRGGVGXXWQRQQRNGAGGSSTGLPAGRRTRRGVSLWTSW

SEQ ID NO: 76631 - DNA, 847 bp, Zea mays
  misc_feature: Ceres CLONE 1561399
  misc_feature: Encodes the peptide sequence at SEQ ID NO. 76632
ctggagctcaccgcggtggcggccgctctagaactagtggatcccccgggctgcaggaattcgtctcacccctagaaaaaatcgagtatagcagtcgatggcccatcgagtatagcagacgaagttgtagttgctctcctccgagaaccctcgccgccgccacccaccggagctccggtttgcagttcttcgctgaaggccatggatcacgacagattgaatttgccgagcacgtcggctatttcgctggaggtgatgggccaccagctacatatttcacaggatccaaactccaagcaccatgggaccacggtctgggatgcatcaatggtgtttgtcaagtttttggaaaagaatagcagaaaaggtcgcttttgtccgtccaaactaaaaggaaagagagtgattgaattgggagctggctgcggtctagctgggttcggaatggccttgttggggtggtgatgttacaacaactgaccaagccgaggtgctcccactgcttatgagaaatgttgaacggaacagatcttggatctcacaatcgaaccccgactcagattccgttggctcaattacagttgcaggaattggactgggggaacaaagaactatcagggccgtggaacctccatttggatacattgtaggaacctgactttggttatccggaacatccgttggcaaccttctatgggaaacgattaccggcttattctggccctaaaaacaaaaattttggtaaggggccaaaaatcctttccgaacaaccggccctgaaaaaaaagaggagaattggggaaaaagaatttccttgggaaaaagggccccttaatccaaaaaaggg

SEQ ID NO: 76632 - protein, 87 aa, Zea mays
  misc_feature: Ceres CLONE 1561399
MDHDRLNLPSTSAISLEVMGHQLHISQDPNSKHHGTTVWDASMVFVKFLEKNSRKGRFCPSKLKGKRVIELGAGCGLAGFGMALLGW

SEQ ID NO: 76633 - DNA, 784 bp, Zea mays
  misc_feature: Ceres CLONE 1561401
  misc_feature: Translation starting site: 200
  misc_feature (668)..(668): n is a, c, t, g, unknown, or other
  misc_feature (697)..(697): n is a, c, t, g, unknown, or other
ctggagctccccgcggtggcggccgctctagaactagtggatcccccgggctgcaggaattcgtctcacccctagaaaaaacctccccctcctcgccgctccgggctgaccaagggctcgccgcctcccgtgtcctccgactccgacagggaaaggcgaaaccttgggtcggctcgctagtggagtgcagggtacgttgatgacggagctgtggatggaggtgctgccgccgccctacttcgcggggcaggcggcgggcgggtggttcctgccggaccggcgggccgggcccggggcgtggacgctggaggagaacaagatgttcgagcgcgcgctggcgagggtcgactgggacgcgccggaccggtgtggagcgggtggccgcgttgctgcccggcaggacggcgtccgacgtcgcggcccactacgacgacctggagtgcgatgtcggctgcatcgaggcaggcttcgtgcccttcccctgctacggcagcggcggcggcgcgtcgcaatccgccgggttcacgttcgactgggacgccggcgggctgggctttaagcgctcctgctacgtggtctgcggcggcaagcgcgagcgcggtgcggaccaggagcgcaagatgggcgtctcctggacaggaggagagcacaagcagttcttgatgggncctgacaagtacgggcgagggaactggangacatctcgcgcaacttgctgaacaagccgacgccgacccagtgggcagccacgcacagaaatactcatccgacgtaaactccgtcg

SEQ ID NO: 76634 - DNA, 811 bp, Zea mays
  misc_feature: Ceres CLONE 1561408
  misc_feature: Encodes the peptide sequence at SEQ ID NO. 76635
acccgcggtggcggccgctctagaactagtggatcccccgggctgcaggaattcgtctcacccctagaaaaaaaaaaaccccacctccaccacacctcgtcgtttgcttttcctcggtgcgggcggtgcggcacaagcccccagaccggttgcctccattactgagctgtgcgtgcgtggtggctgtctgccttgtggcggcgccggtcatggtgatggtggagatggacggtggcgtgggaggaggaggaggacgagggcagacgccggcgccacggcggtggcgcctggcggacgagcggtgtgacctgcgcgccatggagacggactacgtgcggcggtttcaccggcacgagccccgcgaacaccattgctcctacgccgtcgccaagcacatcaaggcgcccgtccacctcgtctggtctctagtgaggcggtttgatcaaccacagcttttcaagccctttgtgagccggtgtgaaatgaatggcaacattgaaattggcagtgtcacggaagttaatgtaaagtctgggctgccagccacaagaagcacggagaggctggaactgttacatgacaatgagcacatactcagcgtcagatttgttggatgtgatcacaggatgcataactactcgtgcatcctcaccgtccaccccaaggtcatcgacggccgaccggggacgctcgtgatcgagtccttcatggtgaacatccccgacggcaacgctatgacgacacctgctacatcctggagccctgctcaatacaaacccaagtcgctcggagatggtcccaacgacaggct

SEQ ID NO: 76635 - protein, 200 aa, Zea mays
  misc_feature: Ceres CLONE 1561408
MVMVEMDGGVGGGGGRGQTPAPRRWRLADERCDLRAMETDYVRRFHRHEPREHHCSYAVAKHIKAPVHLVWSLVRRFDQPQLFKPFVSRCEMNGNIEIGSVTEVNVKSGLPATRSTERLELLHDNEHILSVRFVGCDHRMHNYSCILTVHPKVIDGRPGTLVIESFMVNIPDGNAMTTPATSWSPAQYKPKSLGDGPNDR

SEQ ID NO: 76636 - DNA, 782 bp, Zea mays
  misc_feature: Ceres CLONE 1561413
  misc_feature: Encodes the peptide sequence at SEQ ID NO. 76637
  misc_feature (584)..(584): n is a, c, t, g, unknown, or other
  misc_feature (609)..(609): n is a, c, t, g, unknown, or other
ggagctccccgcggtggcggccgctctagaactagtggatcccccgggctgcaggaattcgtctcacccctagaaaaaggatgcttccttccgtttccacctcaacccgtcccaccgctcccagtcccgggacgtacggtgaccccacaccacaccaccacaacccctccgtcctcttcgcggctgcggtgcggccccgggagttccttgattcggcgggcatcgccatgggagggcgtcgctggctagctgtggtaacctgacctcgccgctgcagctctgtaggtagctagtattccagaggtgatttctcctctcctgatcgacagagggcaaatctggttcgtgaccccccagtatcatatcagagagggccacggttttgcttatcaatgtgttaggagttaggaccaagtactggagctatttcgtggttccgatggagtctaagtgtgtgaacgaccaggacaccttgatcgacctggagagtggcaacggcactgcagtgatcaaccatagcaacgacctgaagagtggttgcgtgtgtgcgtgcgccaacggatgtccgagggatgacaggaacnaccagcacatggactgctcttcacnggcttcggacgccgttgctagaaagtgaaaccacgggaaagtccgagggggaagaaaaaactgggccctgggccttctggaaaagctcgggaagggggaacaggcaaaaaaaaaaaaccgtccaaaaaaaaaaacccccccccgggcccccccaaggccccctttaaccccta

SEQ ID NO: 76637 - protein, 65 aa, Zea mays
  misc_feature: Ceres CLONE 1561413
  misc_feature (49)..(49): Xaa is any aa, unknown, or other
  misc_feature (57)..(57): Xaa is any aa, unknown, or other
MESKCVNDQDTLIDLESGNGTAVINHSNDLKSGCVCACANGCPRDDRNXQHMDCSSXASDAVARK

SEQ ID NO: 76638 - DNA, 798 bp, Zea mays
  misc_feature: Ceres CLONE 1561415
  misc_feature: Encodes the peptide sequence at SEQ ID NO. 76639
  misc_feature (43)..(43): n is a, c, t, g, unknown, or other
  misc_feature (58)..(58): n is a, c, t, g, unknown, or other
  misc_feature (70)..(70): n is a, c, t, g, unknown, or other
  misc_feature (72)..(72): n is a, c, t, g, unknown, or other
ctcacccgcggtggcggccgctctagaactagtggatcccccngggctgcaggaattncgtctcaccccntngaaaaaaaaaaaaaaaaaaaaaaaagaccgcaccgcggccacagcctcgcgtcgtcgccccacagccacgcgagccttcgccgatccgcgagcgcagatcgccgaagccaggcggcggagagggagctcgaggcggcggaggaaggcgttcgccacagtcgctgatttccctggggaagagatggggctctcctttggtaagctgttcagccgcctcttcgccaagaaggagatgaggattctcatggtcgggctcgatgccgccggtaagaccaccatcctctacaagctcaagctcggcgagatcgtcaccaccatccccactatcggattcaatgttgaaactgttgagtataagaacattagcttcactgtttgggatgttggtggccaggacaagatcaggcccctgtggaggcactactttcagaacacacagggacttatttttgttgtagacagcaacgacagggaacgtgttgttgaggctagagatgagctccacaggatgctgaatgaggatgagctgcgtgacgctgtgctgcttgtatttgcaaacaaacaagatcttcccaatgctatgaatgctgctgaaattactgacaagcttggtctgcattccctgcgacagcggcactggtacatccagagcacttgtgctacatctgggtgaggggttgtatgaaggggcttgactggctttccagcacatctccagcaagtctg

SEQ ID NO: 76639 - protein, 163 aa, Zea mays
  misc_feature: Ceres CLONE 1561415
  misc_feature (1)..(164): Pfam Name: Arf Pfam Description: ADP-ribosylation factor family
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSG

SEQ ID NO: 76640 - DNA, 938 bp, Zea mays
  misc_feature: Ceres CLONE 1561418
  misc_feature: Encodes the peptide sequence at SEQ ID NO. 76641
ctggagctcaccgcggtggcggccgctctagaactagtggatcccccgggctgcaggaattcgtctcacccctagaaaaaacctcccttcccgacccaattctcctcaatcaaagaaagtccccacgcagagcaagccaagatctgcgccgcggcgaggcgaagcaaagcaccggctggctcccatggccgtggacctgatggggtgctacgccccgcgccgcgccaacgaccagctcgccatccaggaggcggcggcggcggggctccgcagcctggagctcctcgtgtcgtcgctgtccacgcaggccgccgcgccgcacagggccgcggctcaccagctgcagaagccgccgccgcagctgccgatcggcgagatcgccgaccaggccgtctccaggttccgcaaggtcatctccatcctggaccgcaccggccacgcccgcttccggcgcgggcccgtcgtcgagccgccaccggtgcctcctccggccgtctccgctcccgctcccgctccggcccccgctctccccgtggcgcacgtggtggctcccgtcggcgcggcgcagccccagagcctgaccctggacttcaccaagccgaacctggccgtgtctggcggcgccacgtccgtcacctccacgtccttcttctcctcggtcacggccggcgagggcagcgtgtccaaagggcgcagcctggtgtcttccggcaagccgccgctgtccggccacaagaggaagccctgcgccgtgcccccactcgtaggcaccacctacgggggccgctgccactggctccaagagaagggtaaaccccgtggagaggaacatcagaagggccggcgatcagcgcccaaatcgcggacttcccgcccgaagaaggaccccggtgggaaattcggccaaaaaccctccagggatccccctttccctggga

SEQ ID NO: 76641 - protein, 251 aa, Zea mays
  misc_feature: Ceres CLONE 1561418
MAVDLMGCYAPRRANDQLAIQEAAAAGLRSLELLVSSLSTQAAAPHRAAAHQLQKPPPQLPIGEIADQAVSRFRKVISILDRTGHARFRRGPVVEPPPVPPPAVSAPAPAPAPALPVAHVVAPVGAAQPQSLTLDFTKPNLAVSGGATSVTSTSFFSSVTAGEGSVSKGRSLVSSGKPPLSGHKRKPCAVPPLVGTTYGGRCHWLQEKGKPRGEEHQKGRRSAPKSRTSRPKKDPGGKFGQKPSRDPPFPG

SEQ ID NO: 76642 - DNA, 946 bp, Zea mays
  misc_feature: Ceres CLONE 1561419
  misc_feature: Encodes the peptide sequence at SEQ ID NO. 76643
ctccccgcggtggcggccgctctagaactagtggatcccccgggctgcaggaattcgtctcacccctagaaaaaatccttcccgagggaccgagaaagataagaaaggcggtggtcaacttgtgtcctgaggtgcccgtagaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcacgacaagaagattacaatagactgcgtccgttgagctatcgtggtgctgatgtttttctgctcgccttttctcttatcagcaaagcaagctatgagaatgtctctaagaagtgggttcctgaattaaggcactatgctcctggcgtgcccataatccttgttgggacaaaacttgatctgcgtgatgataagcagttttttgttgatcaccctggtgctgttccaatttccactgcccagcgcgaagagctgaggaagctaattggtgctgccgcctacatcgaatgcagttcaaaaacccagcagaacataaaagcagtgtttgacgcagcaattaaggtggttctccagcccccaagccaaagaagaggaagatgtacgtgcagaacgcatgccaccattttgtaactaccaacggtagaaggcaacagtctgggctgcggcgctgctgccaatgataaccatcgccctccttgctgtatatatatccgcctgatcatgccccccgcatgcacaaggggagatgggggggttttaggaaccttgccccaccgtgttgggttagac

SEQ ID NO: 76643 - protein, 197 aa, Zea mays
  misc_feature: Ceres CLONE 1561419
  misc_feature (8)..(179): Pfam Name: Ras Pfam Description: Ras family
  misc_feature (8)..(121): Pfam Name: Miro Pfam Description: Miro-like protein
MSASRFIKCVTVGDGAVGKTCMLISYTSNTFPTDYVPTVFDNFSANVVVDGSTVNLGLWDTARQEDYNRLRPLSYRGADVFLLAFSLISKASYENVSKKWVPELRHYAPGVPIILVGTKLDLRDDKQFFVDHPGAVPISTAQREELRKLIGAAAYIECSSKTQQNIKAVFDAAIKVVLQPPSQRRGRCTCRTHATIL

SEQ ID NO: 76644 - DNA, 963 bp, Zea mays
  misc_feature: Ceres CLONE 1561421
  misc_feature: Encodes the peptide sequence at SEQ ID NO. 76645
tccccgcggtggcggccgctctagaactagtggatcccccgggctgcaggaattcgtctaccccctagaaaaaatcgagcatcgcagagataggcgtcttcgtactcgcctacctccgcggctctcaccttgtccccttacaccaattccctccgtcggccgccgctccatcccgtacgtacgacaccatgagggagtgcatttcaatccacatcggccaggccggtatccagatcggaaacgcatgctgggagctgtactgccttgagcatggcattcaggctgacggtcagatgcccggtgacaagaccattgggggaggtgatgatgctttcaacaccttcttcagtgagactggtgctgagaagcacatgccccgtgctgtttttgttcaccctgaacccactgtcatcgatgaggtgaggactgggacctatctccagctcttcctccctgagcagctcatcagtgggaaggaggatgcactccacaactttgcccgtggtcactacaccattggcaaggagattgttggacctatgccttgatcgcatcaggaagcttgccgaacaatgctcttgtctccaggggctcctcgtcttcaatgctggtggtatgggaacgggtttctggcctttggttcccctcctcctagagcgccctgtctggtgactacggccaggaagtcccaggcttgggggtcattggggtacccctcccccccaagtttcccacggcgggcaggtttggccccctacaagattgcgtcgtgtcccgaccatttgcctcttcgtgcacatcctgatttgtggctttattgggtgggaaccatgggggcccactctcgcgcctttctgccgagggaatcccttgtgtcttttgtgtgcccaacctgtgtgccacaccttcacacgtgtttgttgtgtccaggtctttctctctcccgcttgtcgggcttcgcct

SEQ ID NO: 76645 - protein, 119 aa, Zea mays
  misc_feature: Ceres CLONE 1561421
MRECISIHIGQAGIQIGNACWELYCLEHGIQADGQMPGDKTIGGGDDAFNTFFSETGAEKHMPRAVFVHPEPTVIDEVRTGTYLQLFLPEQLISGKEDALHNFARGHYTIGKEIVGPMP

SEQ ID NO: 76646 - DNA, 1313 bp, Zea mays
  misc_feature: Ceres CLONE 1561425
  misc_feature: Encodes the peptide sequence at SEQ ID NO. 76647
  misc_feature (1123)..(1123): n is a, c, t, g, unknown, or other
  misc_feature (1313)..(1313): n is a, c, t, g, unknown, or other
gcgggcggaccagggggcggggactgtttttctctttcttgccccgcgcggtggttgtattattgaaaagcgggagatcccgcggtggaggccgctctagaactgtggatcccccgggctgcaggaattcgtctcacccctagaaaaataacccaacccgcaagaaaaaacccgcagcagagaagaggagtcgccgcgaccgagagctccagagcacgcccccgccacggcctccgacgatggatccaaagatgacagaggtgacccagatgttcgcccgcttcagggcggcctacgcccgcaacgattttaagacttgggacaccctcttctcgcggctctaggcccatcccacccaattccccccccttccgcccttggtttgagcaaacaccgaatcgtggtggaggaatctctaacttttcaagggacttttataaacatgcttttgtacttgagtgttatctctttgtgaggggagaccttcataactctatttccgccaagctgaggccctattaattgggaatcatgagcgcaagaaattccttccccccccctaaaggagtagccctattcttgggtacctagggtccttctgaagggctgtttgtattcataaacactccaatagcatcaataattccgcccctagaagattggtatacctctcttccaactgtaataggtgccactctttttcgtacatgtcccgggccatacctaaggacccagtctgctcaacaacccgccgtaaattatttctcgcgcttcaaatgacggtggacttccctctataacaaccactgtgcgtggagagacgtcacccttcaccctgttgcgtcccaggcttcccgcctcatgtgagagtgccctggttatcgtatgtgactgtgttgatagtggagctggaatccacttgatcttgattctggcgattttttttcggtgggctgtgcggtcccgctctgtgtcgctcgtgcttactctataacactcggtgtcgtctagatacagcacgcgctttgtgctgcagtgttatatgctactgcactgcattcgcatatgagttccatgcgcgctctcgctcttgctggtgcacgtagcggcatatttaccgctnctccatggtcggactatccttgctgtctgcagacatacccttatattgctgtggcgttagttttagcaaaccgctccgtcgctgtctctgtctcgctgtataagatttgatactagtaagctcttatctaccccgtgcacgaagcatgtactctcatttcctgtccgggttctttcgccttcatcttgan

SEQ ID NO: 76647 - protein, 34 aa, Zea mays
  misc_feature: Ceres CLONE 1561425
MDPKMTEVTQMFARFRAAYARNDFKTWDTLFSRL

SEQ ID NO: 76648 - DNA, 825 bp, Zea mays
  misc_feature: Ceres CLONE 1561430
  misc_feature: Encodes the peptide sequence at SEQ ID NO. 76649
  misc_feature (350)..(350): n is a, c, t, g, unknown, or other
ccgcggtggcggccgctctagaactagtggatcccccgggctgcaggaattcgtctcacccctagaaaaagccgcaggccacgcatcttggagatggacaggtacgcgcccgcgctcctctgcctctgcctttgcctttgcctcggcgcgctccgtgccggttccgccgcgcctaccaccaccgggacccccgacggctcggagctgtgggggtacgtcgaagtccggccaaaggctcacctgttctggtggtactacaagagcccgcatcggacgtcgacgcccagcaagccatggccgaccatcctctggctgcagggcgtgcccgggcgtcgtccgggcgtcgggtnctcggcaacccttcctgggagggtggggggcccgcctgggaaccttgggaacccctgaaaagccccccggaaaaccccccaacctggggcctggcccaaaaaggggccaaaccctcttattttttttgtggggaaaaaacccccgggggggggcgcgggggaacccctccccggggaggaaaaccccccgggggggggaaacccaaagggggagagggggggggaagcccccccccccccttctaaaggggggggccaaaagggtgggccaccccctaaaaaacaccccccttttttttggtgcccaaaaaactctggggggggggaatatccccccccccctggtggggggtgttgtctctccaagggggggcccccccccccgcgggaaaaaaaaaaaaagcaacccccgggggggtggtgccccccccccccagaaaaatatatcttcccccccccccgcggggtgtgagta

SEQ ID NO: 76649 - protein, 104 aa, Zea mays
  misc_feature: Ceres CLONE 1561430
  misc_feature (86)..(86): Xaa is any aa, unknown, or other
MDRYAPALLCLCLCLCLGALRAGSAAPTTTGTPDGSELWGYVEVRPKAHLFWWYYKSPHRTSTPSKPWPTILWLQGVPGRRPGVGXSATLPGRVGGPPGNLGNP

SEQ ID NO: 76650 - DNA, 930 bp, Zea mays
  misc_feature: Ceres CLONE 1561431
  misc_feature: Translation starting site: 142
tggagctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactaccctcggcaaccccgagcctgatccacgcgcagagcatcctcgccatctgggcctgccaggtcgtgctcatgggcgccatcgaggggtaccgcgtcgcccggcgcccgctcggagatgtcgtcgacccgctctaccccggcggcagcttcgacccgctcggcctccgcgacgaccctgaaggcttcgcggagctcaaggtgaaggagctcaagaaacgccgcctcgccatgttcttccatgttcgggttcttcgttcaaggcattctcacgggcaagggccccctcgaaaactcggcgaacacctcgccgaccccgttaaaatcaaccatgggcctatgcaactaacttgggccg

SEQ ID NO: 76651 - DNA, 840 bp, Zea mays
  misc_feature: Ceres CLONE 1561433
  misc_feature: Encodes the peptide sequence at SEQ ID NO. 76652
  misc_feature (732)..(732): n is a, c, t, g, unknown, or other
  misc_feature (795)..(795): n is a, c, t, g, unknown, or other
ggagctccccgcggtggcggccgctctagaactagtggatcccccgggctgcaggaattcgtctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagatgtcaacgtcgacaatttcttcgctgttctgcttggcaacaaaactgctctcaggggtgggagcggcaaggttgtggacagtggccccaatgatcatatatttgttttctacagtgaccatgaaggcctcctgccgaatgacataaatgtgtatgcgaccaccgcgtcaaatgcagaggagagtnagctggggggacgtactgcccctggcgagtttcccgaagccctccaccggagtatgacacttngcttgggaagacctgtaatagggtttgcttgggatgggaagacac

SEQ ID NO: 76652 - protein, 224 aa, Zea mays
  misc_feature: Ceres CLONE 1561433
  misc_feature (49)..(218): Pfam Name: Peptidase_C13 Pfam Description: Peptidase C13 family
  misc_feature: SWISSPROT Homolog: EC 3.4.22.34 Legumain
  misc_feature (189)..(189): Xaa is any aa, unknown, or other
  misc_feature (210)..(210): Xaa is any aa, unknown, or other
MVADRLRLALLLSACLCSAWARPRLEPTIRLPSERAAADETDDDAVGTRWAVLIAGSNGYYNYRHQADICHAYQIMKKGGLKDENIVVFMYDDIAHSPENPRPGVIINHPQGGDVYAGVPKDYTGRDVNVDNFFAVLLGNKTALRGGSGKVVDSGPNDHIFVFYSDHEGLLPNDINVYATTASNAEESXLGGRTAPGEFPEALHRSMTLXLGRPVIGFAWDGKT

SEQ ID NO: 76653 - DNA, 991 bp, Zea mays
  misc_feature: Ceres CLONE 1561434
  misc_feature (991)..(991): n is a, c, t, g, unknown, or other
ctggagctccccgcggtggcggccgctctagaactagtggatcccccgggctgcaggaattcgtctcacccctagaaaaaccctgctctcctctcctcctccagtactcctcaccgcacccctcctggacgtcgccggccgcattatgcgccagaacagaatagaggaagagacaccgcgaccgcattagcatgagagagagctaggggggcctggcctgctgcccctgcgtcgtctgaccctgaagatggcggcagcagcatgcctggcgggccgtagcctcgcgctccttgcgagcaggacgaggatgggtggcccgccgcgtctcttggtcgtgagatgcgacgacctgacagcggatgccttctgctacgctagccgccaagatatttgggacctcccacgagctgtaatggaagaaaactccaggggaagtgcgccgggggaggatctcccggcctcttgtcccccgaaggctacacttctgaccccctggtaactggacggggaaacccgacacctggggttttaataaataacaaggccggtttggccaaatggaaggcctcccaaaaggaactaacttggggggggggaaatgggataggaaacccgcccgggggaaaattacaccccgccgggtggaaattggtttttctttacagggtggggcaacacccccctggaaaggaaccttggcggcccaggttttaagaaaatcataccgtcttccctcgaagggagcctaacacgcggggggcctccaagggcgggggggtttattgggcgacggccgctctttgttttcccctacaggccgcgaatataattggaaggacaaaggtgggggggagcctttggcataaaagttctataaaatgcaaacccggtcaaagtggtttggggcccccctttggagagggcgcccatttcccggcgggaacccccccctcttggacttggcccaattttttaggcccccccctaaaan

SEQ ID NO: 76654 - DNA, 933 bp, Zea mays
  misc_feature: Ceres CLONE 1561440
  misc_feature: Translation starting site: 188
  misc_feature (930)..(930): n is a, c, t, g, unknown, or other
  misc_feature (933)..(933): n is a, c, t, g, unknown, or other
ctccccgcggtggcggccgctctagaactagtggatcccccgggctgcaggaattcgtctcacccctagaaaaaatttctctctctcctctcatctccacctctcctccggctagggtgttcacgcctgccgcggcgaagcttctgccctccccggcgtcgcgctctggtcgtcgtcggccgggaagatggctggcggcttcagggtacttcatctggtcaggccctttctggctttcttgccagaggtgcagagcgcggataggaagataccattcagagaaaaagttatctacactgttatttctctcttcatttttctggtgtgcagccagctcccactctatggcattcattcaacgactggagctgatcctttctactggatgcgtgttatcctcgcatcaaaccgtggcactgtgatggagttgggtattactccaattgtgacctctggtatggtaatgcaacttcttgtcggatcgaagatcattgaagttgacaacagtgtgagagaggattgtgctctgctgaatggtgcacaaaagttgcttggtatcttgatcgctattggggaagctgtggcatatgtcctgtctggaatgtatggcagtgtaagccaacttggaacagggaatgctattctcattatacttcagcttttctttgctggcatcatttgtcatctggttggatgaacttctccagaaaagttatgggtttgggatctgggtatttctctgttcattgctacccattatctgtgagaatatcatctggaaggcatttagccccacaacatcaacaagtggtccgtgtggctgatttcaaaggggctgtctttgcactgttccatctgttgatacaagaaccaataaagcccggctcttcgtgaggctttctacgccagaacccttcaattggaccattngcn

SEQ ID NO: 76655 - DNA, 932 bp, Zea mays
  misc_feature: Ceres CLONE 1561441
  misc_feature: Translation starting site: 404
  misc_feature (693)..(693): n is a, c, t, g, unknown, or other
ccgcggtggcggccgctctagaactagtggatcccccgggctgcaggaattcgtctcacccctagaaaaactagaaaaaagcccggcacagacactactggcacgcacgcaccagcaccagcaccacaccacatgaatggtggagcctagcacgggcagctagctcccggccggcgacgtgacgaccaccaccaccacatgttgcatgagcagcaggcaccgccaccggcagtagcagcgccaccgccatccatcaaccccgacgacgacggcggccgcgatgtcgaggtcaccacgttccgcgacatccaccctctgacgcccgacgcgccgccgcccgcctccgcgtcctgggacacggccagccaccgctcccttgtcgtcgtccgacgaccagcagtacatgacgatgagccgcgagttcacggccatggtcgccgccggggcgaccatgcagcccggcggctacgacggcgccgccgaccagctcaccagcatcggcgaagacgagctggaggagaccacccgctggccatcgtccccgacagccaccccatcgccacgcccgccaggtccagggcgtccgggcctggaggtcgtgcccgcgggcccggcgccgcagccggccgcgcacctggaggccagcaggtcaagaagggagaggtggagaccaaagtcacggcctggcagacngccgaagtcgccaagatcaaacaccgctttcagagggaggatgtggtcatcaacggctgggagaaccgagcaggtggagaaaggctccgcgtggctcaagaagatcgagaagtagctggacaaccagcgcgccaaggcgctggaatagacccataacgacatcgccaaggcgcggcgcaaagcgaaggaaaacggggcgtcggcggaggccaaccgggcctcagctggcaaggtgctga

SEQ ID NO: 76656 - DNA, 805 bp, Zea mays
  misc_feature: Ceres CLONE 1561442
  misc_feature: Encodes the peptide sequence at SEQ ID NO. 76657
  misc_feature (773)..(773): n is a, c, t, g, unknown, or other
  misc_feature (774)..(774): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
ctccccgcggtggcggccgctctagaactagtggatcccccgggctgcaggaattcgtctcacccctagaaaaaacgtatgttttggtcggtggtgagatgagcttttctgctctctcgtttgggtggatcaccacgaagaggacgccaacgcccactgcttcacgttacgctcccgccaagacttggcaccgggataggtgctcctgtcctgagcttcaaatccgcacctccttgtcaagactgttacttgcgctgctgccttatcttgatgtggtcgctggcgatctggatttgctgccggcccctcctccttttcatcctttttgtcgtcctctacacagattcctgggacattttcatccaggcaagtcacacttcattgtgttgagacattttctactcatgagtggtttggtccaccaacagtcgttttcaggtgccgtcgacagaataacactatttgtcagatgtgagggaggtgtctctctgtatacctttgacggtgaaagtcatggcgcctcttacgagcttccatcaaagaatgtagctagtggtttgtatgatgggacatattaccctgatgattctttctgaatgggagatgagtctagtgatttcagggtgggaactgctccatgttatgcacgccagttcatgcgtcatactatgtctcactgcactgtctcactggacatgaaagccatgaccttagtccaaatctggatctacgagacgtctgttccgtcatcctatattggagtgtgatggtgnnannnnncacnnngggggttttttttttgggg

SEQ ID NO: 76657 - protein, 39 aa, Zea mays
  misc_feature: Ceres CLONE 1561442
MWSLAIWICCRPLLLFILFVVLYTDSWDIFIQASHTSLC

SEQ ID NO: 76658 - DNA, 912 bp, Zea mays
  misc_feature: Ceres CLONE 1561443
  misc_feature: Translation starting site: 121
  misc_feature (587)..(587): n is a, c, t, g, unknown, or other
  misc_feature (907)..(907): n is a, c, t, g, unknown, or other
ctggagctccccgcggtggcggccgctctagaactagtggatcccccgggctgcaggaattcgtctcacccctagaaaaagccgcggggctccagcttcaaccacaccgacttctactccatggtcggccgcagctccaacttcgccgccggggacgcgttcggcctgcgcacgggcgccacgcccaggccgtccaactacgaggaggacccgcagggcaaggcgaacaagtacggccagtacccggcgcccaacccggccatggcggcgcagcccgccaagggcctcaagaaggcggccaatgggcaggccaagggcgaggacggcaaggacctacacatgttcgtgtggagctccagcgcgtcgcccgtgtccgacgtgttcggcaatggcgccgccgagtacaacgacgcggccgccgtcaaggaggtccgcatggccgtcgcctccccgcgcaagttgcggcggacgggaggaaggagcggggcgaggacttcgcggagcgggacgacttcagcttcgggaacaggggcgcggcggagagggacgcggaagccggcgacgagaaggcggcggcggcggctgcngctgcgcagggggaatgcaggcgccgtggcggcgcccgcggcgatgccaccgacgagcgtgatgacgcggctgatcctcatcatggtgtggcgcaaactcatccgtaaccccacacctactccagcctcatcggcctcatctggtcgctcgtctgcttcaggtggaacttcgagatgccggcgatcatcctcaggtcatctcgatcctctccgacgccgggctcggcatgggccatgtcagcctccggctggtcatggcgctgcagcaacgggatatcgcgtggcgggaccaaggtggcacccgtcgcatgggcgtgcgntcctg

SEQ ID NO: 76659 - DNA, 925 bp, Zea mays
  misc_feature: Ceres CLONE 1561447
  misc_feature: Encodes the peptide sequence at SEQ ID NO. 76660
ctccccgcggtggcggccgctctagaactagtggatcccccgggctgcaggaattcgtctcacccctagaaaaactcccccgtgcctcacggtcgacagctacctggccgagccaccatcaaagcgccagtacaccagtacctatgcattgctagcagctagctcgagtccgctcccaccgtacccactgccagtgccacaccacgcgtacgccatggcgccgtcgccggcggcggtcgcgcacggcgagggcgcgagcgccggcggcgccgtgtgctgcatgtgcggcgaccgcggcctgccgggcgagctgttccggtgcaggtgctgccgctcccggctacagcacaggtactgcagcgacctgtacccgagggcggccgcgtaccggcggtgcaactggtgcctgcgggagccggggccgggggtcggccaagcgggcctgggccatgcccatgccgcggcggtatttgcggctaacaacaagcagcccgaggatgataaacggaagaccacggcggcagcgacggacgaggagcggcggcagcgccacgaccacgatgggtgctccccgaagaggttgtcgccgccgcggccgcctgcggagctcggacacccggtgaagaagaagcacagggccgaggagaagacgccgccgccgccgccggcggtggcggctaacaacaggcccgaggaatggtaacggaagaacacggctgcggcgtcggacgaggagccgccgcggcagcgccacgaggggtgctccccgacccctgaggaagtcgtcgcccgccgcctggcggagctcgtaccccccgggtgaaaaaaaaacacaagggccgaggagaaaaaccccccctgctgttccaagggaaaggggcggggtgtaacagggctcttgccgggtggccgcgcggttcaagcc

SEQ ID NO: 76660 - protein, 162 aa, Zea mays
  misc_feature: Ceres CLONE 1561447
MAPSPAAVAHGEGASAGGAVCCMCGDRGLPGELFRCRCCRSRLQHRYCSDLYPRAAAYRRCNWCLREPGPGVGQAGLGHAHAAAVFAANNKQPEDDKRKTTAAATDEERRQRHDHDGCSPKRLSPPRPPAELGHPVKKKHRAEEKTPPPPPAVAANNRPEEW

SEQ ID NO: 76661 - DNA, 956 bp, Zea mays
  misc_feature: Ceres CLONE 1561449
  misc_feature: Encodes the peptide sequence at SEQ ID NO. 76662
  misc_feature (854)..(854): n is a, c, t, g, unknown, or other
ctccccgcggtggcggccgctctagaactagtggatcccccgggctgcaggaattcgtctcacccctagaaaaactcccccgtgcctcacggtcgacagctacctggccgagccaccatcaaagcgccagtacaccagtacctatgcattgctagcagctagctcgagtccgctcccaccgtacccactgccagtgccacaccacgcgtacgccatggcgccgtcgccggcggcggtcgcgcacggcgagggcgcgagcgccggcggcgccgtgtgctgcatgtgcggcgaccgcggcctgccgggcgagctgttccggtgcaggtgctgccgctcccggctacagcacaggtactgcagcgacctgtacccgagggcggccgcgtaccggcggtgcaactggtgcctgcgggagccggggccgggggtcggccaagcgggcctgggccatgcccatgccgcggcggtatttgcggctaacaacaagcagcccgaggatgataaacggaagaccacggcggcagcgacggacgaggagcggcggcagcgccacgaccacgatgggtgctccccgaagaggttgtcgccgccgcggccgcctgcggagctcggacacccggtgaagaagaagcacagggccgaggagaagacgccgccgccgccgccagcggtggcggctaacaacaggcccgaagatggtaaacggtagaacacggcggcggcgtcggacgaagaagcggcgcggcagcgccacgaagggtgctcccccgaccctgaagaagtcgtccgcggcgccctgctgagctcgtacacccggtgaggaagaacacagggccgagtataaaactcctccngctgtcaaggggaaagtgcgggtgaacagggtctgcaagtgtcgcgggtacagaccctccgctgaagcatcacctgctgaaaaacaactgctcctggcgaat

SEQ ID NO: 76662 - protein, 164 aa, Zea mays
  misc_feature: Ceres CLONE 1561449
MAPSPAAVAHGEGASAGGAVCCMCGDRGLPGELFRCRCCRSRLQHRYCSDLYPRAAAYRRCNWCLREPGPGVGQAGLGHAHAAAVFAANNKQPEDDKRKTTAAATDEERRQRHDHDGCSPKRLSPPRPPAELGHPVKKKHRAEEKTPPPPPAVAANNRPEDGKR

SEQ ID NO: 76663 - DNA, 942 bp, Zea mays
  misc_feature: Ceres CLONE 1561451
  misc_feature: Encodes the peptide sequence at SEQ ID NO. 76664
ctcaccgcggtggcggccgctctagaactagtggatcccccgggctgcaggaattcgtctcacccctagaaaaaactgtgctcattatggagttgatcaacaatgttgctaaggcccatggtggtttctctgtgtttgctggtgttggagaacgtacccgtgaaggtaatgatctgtacagggaaatgattgaaagtggtgtcattaagctagatgacaagcagagcgaaagcaagtgtgctcttgtttacgggcagatgaatgagcccccgggtgctcgtgctcgtgttgggttgactggtttgactgttgctgaacatttccgtgatgctgaaggacaagatgtgcttctgtttattgacaacattttccgttttactcaggcaaactctgaggtgtctgctcttcttggacgtatcccatctgctgtgggataccagccaacccttgccactgatcttggaggactgcaagagcgtattacgacaacaaagaagggttctattacatctgtgcaggccatctacgtgcctgccgatgacttgacggatcctgctcctgctactacctttgcccatcttgatgctacaactgtgttgtcacgacagatctctgagcttggtatttatcctgctgttgatccactggattccacatcaagaatgctttctccccacgtgctgagtgaggatcactacaacactgctcgtggtgtgcagaaggctcttcagaactacaaaatcttcaggatattattgctatcttgggtatggatgacctcagtgaagatgacaagctgacagtcgcccgtgcaagaaagatcagcgtttcctgaaccagcctttcattgtccttgaagtttcccgggtgctccaggaaatttgtggagctgaaggaaccgtgaaagtttcagggggtttcggatgggaatattaaacaccc

SEQ ID NO: 76664 - protein, 265 aa, Zea mays
  misc_feature: Ceres CLONE 1561451
  misc_feature (18)..(219): Pfam Name: ATP-synt_ab Pfam Description: ATP synthase alpha/beta family, nucleotide-binding domain
  misc_feature: SWISSPROT Homolog: EC 3.6.3.14 H(+)-transporting two-sector ATPase
HRGGGRSRTSGSPGLQEFVSPLEKTVLIMELINNVAKAHGGFSVFAGVGERTREGNDLYREMIESGVIKLDDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLSEDHYNTARGVQKALQNYKIFRILLLSWVWMTSVKMTS

SEQ ID NO: 76665 - DNA, 1333 bp, Zea mays
  misc_feature: Ceres CLONE 1561453
  misc_feature: Encodes the peptide sequence at SEQ ID NO. 76666
  misc_feature (1029)..(1029): n is a, c, t, g, unknown, or other
  misc_feature (1041)..(1041): n is a, c, t, g, unknown, or other
  misc_feature (1095)..(1095): n is a, c, t, g, unknown, or other
  misc_feature (1199)..(1199): n is a, c, t, g, unknown, or other
  misc_feature (1216)..(1216): n is a, c, t, g, unknown, or other
  misc_feature (1282)..(1282): n is a, c, t, g, unknown, or other
aagtgggagaaggggtgttgtggcgtgtgggggccggatagatattatttagagtggagggggccgtttgtgaagctggagctcaccgcggtggcggccgctctagaactagtggatcccccgggctgcaggagattcgtctcacccctagaaaaaacccgctgccatcctcgcagtcgcagcccctcaccatggctgccacactctcctccgtggctgccccttccctccccaagcacgtctccgttaccagagctcagcagcaggcgcctccttccatcatctcggcatcaactaagactgccttccatggggtgtcgctggtggtggacaggaggtgggcggccggccacctgagaggcagcggccggcggaagctgctgcatgtgaacgcgaggaccgccgccaagaacatctaggtggaggtcgagaagccgctcggcttagccttggggcagaagcccgggggtggggtcgtcatcacattttgtggattccggagggaatgcagctctcaagccgcggcttgataaacaacgggaaattatcctgggtaaacaaacagacttctttttcgataacaaaactgtgggcgccggccgcaataaactctcggggttgtctccatagtacgggcgcacccccatccgccaacaattaaaacacaccccgctcaaagggctgagtcgctcgtgtgccacccgggtgggcttctgacaacattcttatgcgtcgaagagttagaacgccccccatcccactataaaatgacacggattgctgcggtcgagccccctccgctctttcctcttctcttgatgcatcgcgcatagagcttgcgcaccgctcgcgagaagatctaacttatcttcccctatatatctaccccccccactttgattaataatatcacatacctaatccagtgtgccatcttaccactcgtgtgtcgatgcgccaccaactcatagtcatattcggtcgtagtgaatgtttcgccaaccaccttcttttccatcttctttttcnttataccctcgnttcagtgcacagtgacgagactgcctttggcgccgggcggggtcagacagtacntaactcacatgccatcttaatcgctccttcatcacacgtgttggcgcacacccactctagtatgaaatgcgctgtgcacacactactctacagatatagaacanctgtctctttgggaccncactagctccacacctacactgtgattgtacgccctaccattcacactagaggccccttctgtagncgagtgtgactcagactgcggcacccttatctcttacaccgccgttcacgt

SEQ ID NO: 76666 - protein, 75 aa, Zea mays
  misc_feature: Ceres CLONE 1561453
MAATLSSVAAPSLPKHVSVTRAQQQAPPSIISASTKTAFHGVSLVVDRRWAAGHLRGSGRRKLLHVNARTAAKNI

SEQ ID NO: 76667 - DNA, 811 bp, Zea mays
  misc_feature: Ceres CLONE 1561454
  misc_feature: Translation starting site: 128
  misc_feature: Pfam Name: zf-DHHC Pfam Description: DHHC zinc finger domain
  misc_feature (490)..(490): n is a, c, t, g, unknown, or other
ctccccgcggtggcggccgctctagaactagtggatcccccgggctgcaggaattcgtctcacccctagaaaaaaaaggaaagcgagagccagatcgtaggcggcgagcgcaccgccaccggaggggatggcgcggagacggggcggccccgcgccggcgacagcggtcgcctcgccggccgtgctcggcactgtggccgtcatggtgttcgtgtactactccacggtgttcgtcttcctcgatcactgggtcggcctcgccacgccgatcggcgccgcccacgccgccgccgtctcgctcgccgtcgccgcgtgcttcctcgccttcgtctgcgccgcgggcgccgacccgggcgccgtcccacccgccttcgcccccgacgccgaagccgcgcagggacaggggttgaaatcaaggtattgtgataaatgttgcatgttcaagcctcctcgtacccaccactgcaaggtctgcagaaagtgtgttctngaaaatggatcatcactgtgtctggatcaacaactgtgtaggatacgcgaactacaaagcttcatcatttgtgtcctaatgcaactattgggtctctttattcatttgggaaattctatgcgacctacttctgaagagcatgactttgatattcttagggtgaaatccttatatccttggcgggggtcctccttgtctttctaagctttgacaataggtctctactaagtgggccatctttctattgggtgcttactggccacccttaagttcccgggggggcttaaaaaaccaaatggttttccaaaaaaaatgggaaaa

SEQ ID NO: 76668 - DNA, 1099 bp, Zea mays
  misc_feature: Ceres CLONE 1561455
  misc_feature: Encodes the peptide sequence at SEQ ID NO. 76669
  misc_feature (1099)..(1099): n is a, c, t, g, unknown, or other
acccgcggtggcggccgctctagaactagtggatcccccgggctgcaggaattcgtctcacccctagaaaaagcactgaacattctacaagcctattctgcctctctctctctctctttctctctcaatcgcaagccataagagctagcaaggcagcgcaccctcttcaggcggcaagcaagggaggctgtggcggccggcatacaaaatatatgcagcacatgttccctctgctcagcaccgtcagcagcatgcaaggacctcctcccggccccggccagcagcagagcagcaagcagctgatgaggacggtgtccatctcggtgctggtgatgtcgctgccggtgctctacgtctccttcctccacgtcccgcccgccgcgctcgcccgcgacaccaccttctggttcctcatgtccaactccatcatcatcgtcatcgccgccgactcccggcatgctcttcttccgctcctcctcctcctcctcgccgggacgaaggcgaacagtgacggtggacaggcggccttccacgctgccgcctccccgccaaaggaccaagctaggctttctttgggttgggcgtggtcggcacgaccaaacccccaaaaaagcgggccagcttaagatacaaccccctgccttacggcatttgggtcgtgccgaatccgccggtaatcctgaccgatcctaactcgtatttggtgagcccctgggctgggttataacaatacaagccctgcccttgcggcccccgaagtaagcataaaaaacacctcgtatgggttcgaaaaaacacccaaaacatgcacataaacgcgaataactctggaaaaccccggcccccggggaaactaatagatatccgtgctgtgctcggcaaaggtcctacgtaacaccacactatgtcttaccacggggcaacgggtctggtctcactataatagcaccgtctcaaggggcccccctccccccttgttcttgcttagcaaaagaagaggcggtcttcttccttcgaataagccttatgtggcgtctgtcgggggcgctgaatataacaaataaataacaagactgtccacccggtaaatacccacaan

SEQ ID NO: 76669 - protein, 137 aa, Zea mays
  misc_feature: Ceres CLONE 1561455
MQHMFPLLSTVSSMQGPPPGPGQQQSSKQLMRTVSISVLVMSLPVLYVSFLHVPPAALARDTTFWFLMSNSIIIVIAADSRHALLPLLLLLLAGTKANSDGGQAAFHAAASPPKDQARLSLGWAWSARPNPQKSGPA

SEQ ID NO: 76670 - DNA, 1331 bp, Zea mays
  misc_feature: Ceres CLONE 1561458
cgggccagtttcgcccggtcccccacttttcctttacgctcccctccggagaaagtaaagcgtttttaaagctggtactccccgcggtggcggccgctctagaactagtggatcccccgggctgcaggaattcgtctcacccctagaaaaatcctgtctccctcccacctttcccttcctcgccgctctcgcttgcccgcgcaccgagatttcctgcctgctcgtgctcgctccgctgctctcctcgactcctcctgcgtgcctgccgaccggtccgaggcacgccgcggcggaggctctgcgtctgccggccgggtcgtcggattcggccttaggttggttggttggttggctgggtcgcgggcatgtccacggcggtggcgcggccggcgcacggcggattcctgcagtcggggagcgggaagcccgatccggacgaggcagacaggatgatgctgagcgcctactggtactagccccccgaataggaggaggaagaacacggcgatgaggcggccgcgtaagagagatgtatgacgaggctgatgctggtgtcctaggtcctcttcctacgaggggccgcgaccgcccgactggcttctccttgcgattcagggaggtaaccccgcggtcactacaactggagtaacgtaacgagttaaccttcctatactctattactacttggagactccggtcattcaatacagatactagtcctcacatccttattcacatctacttggtaatatgaagagcttctgtgaacgttcccatacgcgaatgggtccctaattacataagagtatggctgaacatgaaaggtgattggacggactcactagtccgcgagtgatcacatctcgctcggttctcgtcacacacagggttctcctagacattgtcgtactttagctacctacacccccgattgcttagtagagactattcatataacgtccaccgtatatcattccgaccttggatcatagaatcggacaactggagcgtgtcgctatcgcgacactgaggttgacttcactgtgatgcgtactgcacgaatttcgtgatgtgtcgccacttctgtctgtcgacactgtttctccactcggtcctttgatcgatttgatctcattcagtgcattggggttctcgtgcagtcatcgcgtcccgctgggtgcctgtgacgtcttatcgcgcgccgtcttccgtgccaatactgcgtctgcgcgaaattagacagttctgcacgcgctcgagtgtcgtggccacctctactgtctcatatcctctttacaattcctgcagtttgttgcccgcatgtaactgtt

SEQ ID NO: 76671 - DNA, 917 bp, Zea mays
  misc_feature: Ceres CLONE 1561460
  misc_feature: Translation starting site: 96
  misc_feature (421)..(421): n is a, c, t, g, unknown, or other
  misc_feature (752)..(752): n is a, c, t, g, unknown, or other
  misc_feature (753)..(753): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (796)..(796): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (816)..(816): n is a, c, t, g, unknown, or other
gcggtggcggccgctctagaactagtggatcccccgggctgcaggaattcgtctcacccctagaaaaaaccgccaacacaccccgctccaatccaatggcgcctcgccaagccgtcctcgcggtcgtggtcctcgccgcgctgctcccgttcgccctctctcgcgggctgcggcttggccaccaccgcgcccagccgcacccgaggccgcacggccacgcaccgctcggaggtggcgcgtggtcctcggctcacgccaccttctacggcggcggcgatgcgtccggcaccatgggcggggcgtgtgggtacggcaacctctacagccaggggtacggcaccaacacgggcggcgcttaagcacggcgctctttcaacacggcctcagctgcggcgcctgcttccaaggtgcggtgcgacanccgcgggggggccggcggccccctccttgtctgcccgggctcccctctcgtggggaaggggcgacacaaacttctgcccgccccaacaaacggcgctctccgttccaaacaaaagaagggggtggggggggaaacccccccgcggggggcccctcattttaaaaatgatttccaaaccaacccgtggtttcagcgcaatcgggctttgttttaaaggggtgggggatatttttcccccccttcccctaaacaaccaaagggggtcggggggggacaaacaaacaaagagagggaggggagatccgggtttgtcacatataaaaggggcctnngcccaccctcttnnnatataaaccctcggtgggggggagaaancaagnnnnnnnnnnnaaagntggggccgggcccgaaaattaaaccgggtggcgcctaaaagggaacccctttctcctccgcggggggggaggggcccccttttccccaaaaaggggggcac

SEQ ID NO: 76672 - DNA, 870 bp, Zea mays
  misc_feature: Ceres CLONE 1561463
  misc_feature: Encodes the peptide sequence at SEQ ID NO. 76673
  misc_feature (392)..(392): n is a, c, t, g, unknown, or other
  misc_feature (405)..(405): n is a, c, t, g, unknown, or other
  misc_feature (447)..(447): n is a, c, t, g, unknown, or other
  misc_feature (670)..(670): n is a, c, t, g, unknown, or other
  misc_feature (671)..(671): n is a, c, t, g, unknown, or other
  misc_feature (763)..(763): n is a, c, t, g, unknown, or other
  misc_feature (781)..(781): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (843)..(843): n is a, c, t, g, unknown, or other
  misc_feature (866)..(866): n is a, c, t, g, unknown, or other
  misc_feature (870)..(870): n is a, c, t, g, unknown, or other
ctccccgcggtggcggccgctctagaactagtggatcccccgggctgcaggaattcgtctcacccctagaaaaaacccatcacacgacaaaatccctcaccctcgtgagtcctgacgccctcgcccgtgctcgcagttggtagggttgtagccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgttgtaaaggaggctgttcagacagagaaggcaccaccagcactaggcccttattctcaggccatcaaagcaaataatcnttgtgtttgtttnctggagttcttggcttgaatcccgagaacaggaagtttatcntctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaaccctacaagtggcggcgctgccactgaatgcccggattnngagatgagtgcatcgctgctctctaatcagatcatccaaccactcattaaatcatcaatagcaccctaggaatttgtggtagaggtacctgntaccagttcagtgtctgnaaactgcgggtaacaaaactttgtgtcccggaataatgatgtgtgtgtgnnnnnntgtttgntgagtgaacactgcatctagtangagn

SEQ ID NO: 76673 - protein, 89 aa, Zea mays
  misc_feature: Ceres CLONE 1561463
  misc_feature (80)..(80): Xaa is any aa, unknown, or other
  misc_feature (84)..(84): Xaa is any aa, unknown, or other
MAWSAAAVSRFAAASPPAAPISVRLGAAASRSSLSFSSGRRRPVAASLSTSATVVKEAVQTEKAPPALGPYSQAIKANNXCVCXLEFLA

SEQ ID NO: 76674 - DNA, 865 bp, Zea mays
  misc_feature: Ceres CLONE 1561464
  misc_feature: Encodes the peptide sequence at SEQ ID NO. 76675
  misc_feature (492)..(492): n is a, c, t, g, unknown, or other
  misc_feature (518)..(518): n is a, c, t, g, unknown, or other
  misc_feature (529)..(529): n is a, c, t, g, unknown, or other
  misc_feature (734)..(734): n is a, c, t, g, unknown, or other
  misc_feature (837)..(837): n is a, c, t, g, unknown, or other
  misc_feature (840)..(840): n is a, c, t, g, unknown, or other
  misc_feature (843)..(843): n is a, c, t, g, unknown, or other
  misc_feature (852)..(852): n is a, c, t, g, unknown, or other
ccccgcggtggcggccgctctagaactagtggatcccccgggctgcaggaattcgtctcacccctagaaaaaacgcaacaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactacgtggaggaggacctggggaacaagagcgacgagctgctgcgccacaaccccgtccacaagaaggtgcccgtgctcgtccacggcggccgcgcgctcccggagtccgtcattatcctccagtaccttgacgacgcctggccggagacccgcccgctgctccccgccgacgccttcgaccgcgcggtcgcgcggttctggtgccacttcgccgacgacaagctcgggccggcggtgggcgcggtgttcgcgtcgacnggggagggccaggaggcggcggtgcngcaggtgcacnataacctggcgctgatcgagtccgagctccgcgacagcgcgtttccggggccgccgcttcttcggcggcgacgaagtgggcctggctggacgtcgtcctggggctgcgggctctactggctcgccgtgttcgaggaggtggaccggggtgcgcctcgtggacgccgacgccttcccgcggcttcaccgctggctgcgcgacttcnagcccctggagaagtccgggaaccatccccgcggtggacggcctgctcgagtacgcgcgcgggctccgcacatgctgctctggcctcccgggggccgggcccnggnccngggcggaanccccctccaccga

SEQ ID NO: 76675 - protein, 252 aa, Zea mays
  misc_feature: Ceres CLONE 1561464
  misc_feature (14)..(87): Pfam Name: GST_N Pfam Description: Glutathione S-transferase, N-terminal domain
  misc_feature: SWISSPROT Homolog: EC 2.5.1.18 Glutathione transferase
  misc_feature (137)..(137): Xaa is any aa, unknown, or other
  misc_feature (141)..(141): Xaa is any aa, unknown, or other
  misc_feature (209)..(209): Xaa is any aa, unknown, or other
  misc_feature (248)..(248): Xaa is any aa, unknown, or other
MEKTSENAIPPAASPLMLFGSWASSYTHRVQLALRLKGLEYDYVEEDLGNKSDELLRHNPVHKKVPVLVHGGRALPESVIILQYLDDAWPETRPLLPADAFDRAVARFWCHFADDKLGPAVGAVFASTGEGQEAAVXQVHXNLALIESELRDSAFPGPPLLRRRRSGPGWTSSWGCGLYWLAVFEEVDRGAPRGRRRLPAASPLAARLXAPGEVREPSPRWTACSSTRAGSAHAALASRGPGPGPGRXPPPP

SEQ ID NO: 76676 - DNA, 842 bp, Zea mays
  misc_feature: Ceres CLONE 1561465
  misc_feature: Encodes the peptide sequence at SEQ ID NO. 76677
  misc_feature (632)..(632): n is a, c, t, g, unknown, or other
  misc_feature (824)..(824): n is a, c, t, g, unknown, or other
  misc_feature (831)..(831): n is a, c, t, g, unknown, or other
acccgcggtggcggccgctctagaactagtggatcccccgggctgcaggaattcgtctcacccctagaaaaaagcctcgatttctttccctttccctttcccttccccagtcagccgcgagcctcgtaccggcgcagccatggcggaggagcccgccatcgtcgtcgccgcctcctccagctgcgaggtcgacctcggcaacctcatggcgtacgacccgtgtcaccacgtcgcagccgccgcctccgcctccagggaggagctgaggcaggagtgcctgcggaaggggacggagctggcgcaggcggtggccgacgccctcttcgcgctgccgcccaccgaggaccgcgacggccccatcgtccacctcccgccacacaccgttcgactcccgcgcgagaagcatctacccaagcccaagccaccgaccaagtggggagctgtttgcaaaggcgaaaggaattaccaagcgcaagaagaccaagcgtgagtgggacgagcaaactcaatcctggaagcggacttatgggctatgaccgtgtaaatgatgataaagacgttccgattctttgagccaaactgactgacgagccctggtgttgatccctttgcacagagaagggatgagaagnaagaagagggttgaaaagcaagaaaaaagcagattagagaattttaagaaagctggcaaaggttggtgcttttgccaagtcatatacagcttggctgcggaggccttgccccatcacagggaactaaagctgaactttccaaaaaatctaagaaagagggatctttgagagatgttgttgggcatggcttcntcagccnacagcaagagg

SEQ ID NO: 76677 - protein, 116 aa, Zea mays
  misc_feature: Ceres CLONE 1561465
  misc_feature (5)..(117): Pfam Name: RRS1 Pfam Description: Ribosome biogenesis regulatory protein (RRS1)
MAEEPAIVVAASSSCEVDLGNLMAYDPCHHVAAAASASREELRQECLRKGTELAQAVADALFALPPTEDRDGPIVHLPPHTVRLPREKHLPKPKPPTKWGAVCKGERNYQAQEDQA

SEQ ID NO: 76678 - DNA, 969 bp, Zea mays
  misc_feature: Ceres CLONE 1561466
  misc_feature: Encodes the peptide sequence at SEQ ID NO. 76679
  misc_feature (495)..(495): n is a, c, t, g, unknown, or other
ctccccgcggtggcggccgctctagaactagtggatcccccgggctgcaggaattcgtctcacccctagaaaaaaccccaccagtctctggcaggttctcccccccacccctctccgtctccgatcccgtccgcattgcttcgcgccggaccaaggaggaagggtcggcgtcgcaggcattgcggcctgccagccacgagggccatggacccgtgcccgttcgtgcgggtgctggtcggcaacctggcgctgaagatgccggcatcagcgccccccgccgccgccgcgtccggctccggcgtgcacccggccacgccgccctgctactactgccgcatccgcctcaacaagctgccctaccagacggcgcccgcgccgctgctgccggccaccgaggagggctcggcgccggcgccggcgtcgtgcgcggccgccttccacgcctccaaggccgacctggaccgggccgccgccaggcccgcgctcttcctcggnggccgcctccgcaccgcgcgcctcaaggtggccgtgtacgccggcccgcgggggcggtgaaagcgggcgggaggctgctcggcaagctcgtcttccggttcgacctcaggcgcgccgtggccgaacccctggtcttccccagcgggcggttcgacatccgttagcgcggcgccgggaaagcggggggcaaagccgccggccgggcgggcgcatataaactccccgtcctcgggggaccctaccccaaggtccgcctccaagtcccacggccaaccccgaatgggaccccgcagggctcccggttttaggggaaccttgaaacacccccgggtcccgtggaaatttctccggccgaaaaaacaagaactgcgccccctggtccttggattccaaaacggggcccctcgggcccggccaatggttggtgaaaccttgggtccaaacccaatgcctaccccccgggtaaaaatacca

SEQ ID NO: 76679 - protein, 116 aa, Zea mays
  misc_feature: Ceres CLONE 1561466
MDPCPFVRVLVGNLALKMPASAPPAAAASGSGVHPATPPCYYCRIRLNKLPYQTAPAPLLPATEEGSAPAPASCAAAFHASKADLDRAAARPALFLGGRLRTARLKVAVYAGPRGR

SEQ ID NO: 76680 - DNA, 799 bp, Zea mays
  misc_feature: Ceres CLONE 1561467
ggagctccccgcggtggcggccgctctagaactagtggatcccccgggctgcaggaattcgtctcacccctagaaaaatgactgaattgcccaattatgcaacaacaacaacataaccttttattcccaagcaagttggggtaggatagagttgaaacccaacaagatgtcaccaaaaagagaaagcgagagaaacgggaggggaaaaagcttttgagagcactaaaagggaaaaagcctaatcacggttcgggcacatggatagcttttttctaagcatttctatccaaacataactctattgggatatttcattccttcaagtcccttttgattgtctcctctcatgtcaagtttggctgtcctctacctctcttcacattattgtcccgtcttatgatgcccattgggatattctaatccttcaagtccttttttgaattgcttcattatgcaatgctacaaaaataaattttgaaagttattctgctgcctgtggatgatcagaccaaaggtttcccttggttgtagaccttaaacaaacttctaattaacgggctcttatgtggaacaggttttacccgggattcctgcaccactttttttttttccggggaaacctttttttctgtgggggggaggcccccctataaaaaaaaggccccccccaaaaaaggggcccccttgtgggttaaaaaagcccaaaaacttgggggggggggccctttttttctttttccccccccccccaaaaaatattgtccccaacacgaggggtgggagaattctttttctcgcg

SEQ ID NO: 76681 - DNA, 920 bp, Zea mays
  misc_feature: Ceres CLONE 1561468
  misc_feature: Encodes the peptide sequence at SEQ ID NO. 76682
ctccccgcggtggcggccgctctagaactagtggatcccccgggctgcaggaattcgtctcacccctagaaaaaattgcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcacccaggaccacatcttcgcgtcgcggccgccgtccatggccgccgagatcatccgctacgggccctcggacgtcgcgttcgtgccctacggcgagtactggcggcagggcaagaaactcctcaccacgcacatgctcagcaccatgaaagtgcagtccttccgccatggccgacaagaagaggtgcggctcgtcatggacagatcccgcgcggtgccaccgccgccgcgccggccggcggtgaacctgaacgatcttctggtcgggtacaccaactactggttgtgcccccgcggggctgggcgcttcccacccgaaaccaagcccggaacaagctgttcaacgaactgaaagaaaatcaactggcccctctcggcggggtccacctccgaggaatacttcccccccaatagggccttgggggactggccccccccggttg

SEQ ID NO: 76682 - protein, 235 aa, Zea mays
  misc_feature: Ceres CLONE 1561468
  misc_feature: SWISSPROT Homolog: EC 1.14.13.68 4-hydroxyphenylacetaldehyde oxime monooxygenase
MALGAAYHHYLQLAGDHGTATHALLLGVLIFLVIRLVSARRTGTTSANKRKQQQRLPLPPSPPGKLPIIGHLHLIGAETHISIRDLDAKHGRNGLLLLRIGAVPTLFVSSPSAADAVLRTQDHIFASRPPSMAAEIIRYGPSDVAFVPYGEYWRQGKKLLTTHMLSTMKVQSFRHGRQEEVRLVMDRSRAVPPPPRRPAVNLNDLLVGYTNYWLCPRGAGRFPPETKPGTSCSTN

SEQ ID NO: 76683 - DNA, 1015 bp, Zea mays
  misc_feature: Ceres CLONE 1561471
  misc_feature: Encodes the peptide sequence at SEQ ID NO. 76684
  misc_feature (948)..(948): n is a, c, t, g, unknown, or other
acccgcggtggcggccgctctagaactagtggatcccccgggctgcaggaattcgtctcacccctagaatatgacgctcgcttctccaaatccccccttcgccttgcgagggggcggaggggaggtggtagtggtagggttatacaggagtgctctgcccatggagaaggcggggcaacaacgccatgttatcggcggcggcggcaagaaagcgcccgcgctggggctgcagaagcagaactcgtggtcgccggacatcgagcgcgacgaggcgtgggagcgccggcgcaagggcatgcgccgcgtggccacggcgctgccgcggcccgcaccgtcccggacaccacctcgacgagcccgccgctgcatctacctgggttcggcctcccaacccgccccgcccgcccgttgcgcctgcgccctgcccccggaaggaacccctccctggaaaccctgccccggccccaacctctaatacccccttccacggggggggcggggcggaaggccccccccttgctctcttgcgggcccccctccgaaagacccccccccccccaagaatagccccctcccgaaccccccttttcctttatcccctcccagggtacaccccccaaaaaaccggaaaaaaaccgccctaaacacatgggccccccacgggtgttccccccccccttggttaaacccccccctgtttattctcctgggacccatggcccccctccttctttttttcctttgggggggagaaaataaaaaactctctctggtggcgctcccccccagaaaaagtgagatttcccgggggcccccctccccgcttgataaagggtgtgaagaaaaaaacaccttccgaggggtggtctctctggaggcgccccccccccccccccccgttggtccacattgtagagaaacatcaaatccttccctccccaccatatngatatttcctcgcagaaaaaataccgcggccgttacttttgcgttctcttcccccctccccccccca

SEQ ID NO: 76684 - protein, 104 aa, Zea mays
  misc_feature: Ceres CLONE 1561471
MEKAGQQRHVIGGGGKKAPALGLQKQNSWSPDIERDEAWERRRKGMRRVATALPRPAPSRTPPRRARRCIYLGSASQPAPPARCACALPPEGTPPWKPCPGPNL

SEQ ID NO: 76685 - DNA, 919 bp, Zea mays
  misc_feature: Ceres CLONE 1561472
  misc_feature: Encodes the peptide sequence at SEQ ID NO. 76686
  misc_feature (363)..(363): n is a, c, t, g, unknown, or other
  misc_feature (431)..(431): n is a, c, t, g, unknown, or other
  misc_feature (471)..(471): n is a, c, t, g, unknown, or other
  misc_feature (472)..(472): n is a, c, t, g, unknown, or other
ctccccgcggtggcggccgctctagaactagtggatcccccgggctgcaggaattcgtctcacccctagaaaaactcgcgttccatttgcttcggctcatctcagatcaagctagcgcacctgacacccaccacctccctcccagatccaccaccccagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgccccactccaacggcgacctccacgacgaccctttcgccgcacctgctgacntcaacggtgggcccatcccttccgcgcccaccgagatggggcgcggaggagggatccctgctcccccnagtggtgcccaacaaatgctatttcacttggagaaaaaannaaaaaaaggggaaagacctgaggaagcccaatcttcctttgaatgcgaaggaagttagaaaaaccttttgttgagaaaaaaaaagtccaagggtgataacaaggcaaggggccaaaaaccgggacaggggagaaagttttttccttcgaaaccccggaaaaaattccccgggctggggggcaaaaaaaccataactgggaaaggggatatttgaaacttttccccccccaggagaatttgtcccccccccaaaaaaaggaggggccgggaaaaccccggggaaaaaaacccctgggaattgtgggtgtactccggggccaaaacccggggaaaaccccaaaaaaggggccgggagggggggaaaatttttgtgaagaagaaaaaccccccccccccccccaacgagaacacaccccccccccctgtggggataaccccggagaaggg

SEQ ID NO: 76686 - protein, 122 aa, Zea mays
  misc_feature: Ceres CLONE 1561472
  misc_feature (68)..(68): Xaa is any aa, unknown, or other
  misc_feature (104)..(104): Xaa is any aa, unknown, or other
MATAFDSPTSSPAAAPFHDDPFLHFDGSAPAAADGFPASPDAYAPSPFGMPHSNGDLHDDPFAAPADXNGGPIPSAPTEMGRGGGIPAPPSGAQQMLFHLEKKXKKGERPEEAQSSFECEGS

SEQ ID NO: 76687 - DNA, 938 bp, Zea mays
  misc_feature: Ceres CLONE 1561473
  misc_feature: Encodes the peptide sequence at SEQ ID NO. 76688
  misc_feature (651)..(651): n is a, c, t, g, unknown, or other
ctctccgcggtggcggccgctctagaactagtggatcccccgggctgcaggaattcgtctcacccctagaaaaaatccatccatccaaccgctcctccctcgtccggcaggcgacgactcgattccttcctcccttcctcctcctcgtctctttcatcggcgactgcgatcttctctgccgtcgccgccgccgccaagagatcgacccgaccccgagcgcccgacccgaccccccaatccaaccaccaaccgccggcgcgcgcggaagattcagatttggcccctcgccggtaagggagaaagcgaggatgggtgcgtggatgtcgcgcgtgtggttcctcatgttcccagcgcgggagtacaagctcgtcgttgtggggctcgacaacgcggggaacaccaccacgctctacaagctccacctcggcgaggccgtcaccgccgcgcccaccatcggcagcaacgttgaggaggtcgtcttcaagaacctgcgcttcgaggtctgggatctaggagggcaagaaagcctgcgcacttcgtgggcgacgtactaccggggaacacacgccgtgatcgtggtgatcgacagcacggaccgcgcccggatcaacatcatcaaggacgagctgttcccgctgctgcagcacaggngactggagggcgcggtgggtcctggtgttcgcggaataagcaggaccttgaaggaccccttggcacccggcggagatcacctagtgccctctcgcctccacaggcataaagggaccccgactggcacatccagggcctcggtgtggcattcaccaggcgaagggcctcctacgacgggcctgggggtgggaatcgcagcaaaaaagtccccccggccaaggcggaccgccgaacttgaacgggcaaggaaaaaccagggggtggggggggttcatgggaacaggtat

SEQ ID NO: 76688 - protein, 210 aa, Zea mays
  misc_feature: Ceres CLONE 1561473
  misc_feature (5)..(146): Pfam Name: Arf Pfam Description: ADP-ribosylation factor family
  misc_feature (115)..(115): Xaa is any aa, unknown, or other
MGAWMSRVWFLMFPAREYKLVVVGLDNAGNTTTLYKLHLGEAVTAAPTIGSNVEEVVFKNLRFEVWDLGGQESLRTSWATYYRGTHAVIVVIDSTDRARINIIKDELFPLLQHRXLEGAVGPGVRGISRTLKDPLAPGGDHLVPSRLHRHKGTPTGTSRASVWHSPGEGPPTTGLGVGIAAKKSPRPRRTAELERARKNQGVGGVHGNRY

SEQ ID NO: 76689 - DNA, 643 bp, Zea mays
  misc_feature: Ceres CLONE 1561474
  misc_feature: Encodes the peptide sequence at SEQ ID NO. 76690
  misc_feature (296)..(296): n is a, c, t, g, unknown, or other
  misc_feature (297)..(297): n is a, c, t, g, unknown, or other
  misc_feature (343)..(343): n is a, c, t, g, unknown, or other
  misc_feature (346)..(346): n is a, c, t, g, unknown, or other
ctccccgcggtggcggccgctctagaactagtggatcccccgggctgcaggaattcgtctcacccctagaaaaactacagaacatctgatgagattcattaccaaggattctgagggatatgtgccaatatcagtaattgctggctttaagaaagtaaaaacttctgtgcgcaataatgtgatgcttgctgcggctctccgaacctcatcaaaacttgttgtaagcgatgacggtaagagagtcaaaaggcagcagccatttacagaatctgatttgcaggagctccagtcccggnnattgtgtagcagaaaatcttcctggtgatccctcctaccagaatcntangaagatattttcagctgttgggaagttttgatttcaaatccggactttggctattcctccaaaacctcaaaaatggggcaccttgggtcccttgccaacttaaaaaaaaaaattctttccccaagagttaaaaaaaaaagggcttttttttgggccaaaaaaaaaaagggggtggcgaggggctttttttcccggggggggaagaaaacaaaaaaaaaccccctccccttgaaaaagaaaaattccccccccccaaaaaaaaaggggttttttttttttttttttggggagggagcg

SEQ ID NO: 76690 - protein, 78 aa, Zea mays
  misc_feature: Ceres CLONE 1561474
  misc_feature (1)..(40): Pfam Name: La Pfam Description: La domain
  misc_feature (70)..(70): Xaa is any aa, unknown, or other
MRFITKDSEGYVPISVIAGFKKVKTSVRNNVMLAAALRTSSKLVVSDDGKRVKRQQPFTESDLQELQSRXLCSRKSSW

SEQ ID NO: 76691 - DNA, 879 bp, Zea mays
  misc_feature: Ceres CLONE 1561476
  misc_feature: SWISSPROT Homolog: EC 2.5.1.9 Riboflavin synthase
  misc_feature (538)..(538): n is a, c, t, g, unknown, or other
  misc_feature (539)..(539): n is a, c, t, g, unknown, or other
  misc_feature (598)..(598): n is a, c, t, g, unknown, or other
agctccccgcggtggcggccgctctagaactagtggatcccccgggctgcaggaattcgtctcacccctagaaaaactctctctctctctctctctcttggcgtcgattgggcgaccgccgccgcctcccccaggtcttcgctgggcccgtcgccggcgacgagcacccaccaggctcggaaacattgctgacattcacctgtaccacagtagttcagtagagtagctgtcggactcggaacacacatgccggcgatggcaactgctcctgtgaaattctctgtggctacgaactccccctatgtccagcctagcttgcccctgaggcgtacacctgccgccatctccttcccctgtcgtccatggtcagccgcaatgacctcatgtactggattgttgaggcgctctgacgtggttgcagccgcggggcaccagaagttgatgggatctttgaccaccaacgagggactcaggtttggggtgggtgtggcacggttcaacgaggtcgtgacaaatttgttactacagggtgccctgnnaaacttcgagcgatactctgttaaagaagaaataatacagttgttagtggttccggaangcttttgaggttcctataacgcacaaaagcttggggaaaatctggaaattcgatgccattcttgtgccttggagctgtggataagaggtgaaccaaccccctaggaaggttgttgcaaaccaacctgcatcaggggggacccaaggcgggaatacccggcgggggtccctgggggaattggggggtccaacccgggaaaaaatgggataggggcctaaaacccccttgggtggaaggttgggaaaaaagggggctaaaaccctcccttaacggccatggaa

SEQ ID NO: 76692 - DNA, 820 bp, Zea mays
  misc_feature: Ceres CLONE 1561478
  misc_feature: Translation starting site: 456
  misc_feature (700)..(700): n is a, c, t, g, unknown, or other
agctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggaagctggaggtgatccactcccggtgggcgatgctgggcgcgctgggctgcgtgttcccggagatcctggccaagaacggcgtcaagttcggcgaggcggtgtggttcaaggccggcgcgcagatcttctcggagggcgggctggactacctggggaaccccaacctggtgcacgcacagagcatcctggccatctgggcgtgccaggtggtgctcatgggcttcgtcgagggctacccgcgtcggcggcggcccggctcggggaaggctcgacnaggtgtacccccggcggcgccttcgacccgctgggcctcgccgacgacccgggacacgccgccgaagcctcaggtggaagagctcaagaacggccgcccttgcagggtctccctggttcg

SEQ ID NO: 76693 - DNA, 866 bp, Zea mays
  misc_feature: Ceres CLONE 1561480
  misc_feature: Encodes the peptide sequence at SEQ ID NO. 76694
ggagctccccgcggtggcggccgctctagaactagtggatcccccgggctgcaggaattcgtctcacccctagaaaaaaaaagcatcaataataatccactgcggtcgctcgtcctcctcccaacctcctcccaagttgcctcgtgctctgcttcttcggttttcaggagcgtcggccattgctgctggaaaagcagaccattgggactccctcgtgcgttttccaaatcaggttgatggcgatggagggaccagttttatgccgccctgcaatgcaagccaaatcgcctgctgctgcgctggtcaacaactccctgaccagattcgggcagcttgggaccatttcaaaatacaggaacgtttcaagattcatttctcccatctctcagccatctacgaagaacataggtccatgctgtagcttcagctcgtcttctgatggcaatggatacatggctggaaactttagcgacagtgatgaagattatgttaattctactgtgctagaagcagttgaggtgagaagtggatcggaaggatatgtgataaagatgcgagatgggaaaaacttgcgttgtgtccataacaattctcaagggagaaatattccagagagtgcaccccaacctgctattgttttgaggattgaagatggaagcgaaactttacttccaatcattgtttttggagatgccaagtgtacttctggatggcgggctattcgtaaatgtccacattggcacgacccaacccttatattcaagtttgtcaagggaaaatgattgataaaattgggcctaatgaggtaaaaccttggttcgggggtaaacacaaaggaatttcaaggaaaccgtacctgttgcctt

SEQ ID NO: 76694 - protein, 181 aa, Zea mays
  misc_feature: Ceres CLONE 1561480
MAMEGPVLCRPAMQAKSPAAALVNNSLTRFGQLGTISKYRNVSRFISPISQPSTKNIGPCCSFSSSSDGNGYMAGNFSDSDEDYVNSTVLEAVEVRSGSEGYVIKMRDGKNLRCVHNNSQGRNIPESAPQPAIVLRIEDGSETLLPIIVFGDAKCTSGWRAIRKCPHWHDPTLIFKFVKGK

SEQ ID NO: 76695 - DNA, 933 bp, Zea mays
  misc_feature: Ceres CLONE 1561482
  misc_feature: Encodes the peptide sequence at SEQ ID NO. 76696
  misc_feature (404)..(404): n is a, c, t, g, unknown, or other
ctccccgcggtggcggccgctctagaactagtggatcccccgggctgcaggaattcgtctcacccctagaaaaaccctagaaaaaaggtagcgcgtcaagcgagcagagcagcgaaaagcatggatgccgaagccgccgccgccgccgagggccaggtgcggcactggaccgcggacgtcaacggcatttccctccacgtcgccgagcgcggcgccgccgacgcgccggcggtcctcctcatccacggcttcccggagctctggctctcgtggcgccaccagatggccgcgctcgccgcccgcggcttccgcgcgctggcccccgacctccgtggctacggcgactcgtccgtgcccaccgaccccgccgcctactccatcctccacatcgtcggcgacgtctncaggtgggaggctacaaagaacacatcatctgcagcgcacaaaagttttcttttacacaaccggggaaaacgcacagaggaagaaaaaaaactgcacaagatggagcaattcaatttacccaggtccataaaaagggcgaacgggaaacgggtcaagcctccgtcagcatacagggtggaagcgcaccttctccggggaacggcgaacgggaacccacgcttggggcctgatggaaccggacttttcacctatggggcccccctttccgattcccctccgtcccgccgggaccttgttccagcccgccggggttggcccccggggtggaacccccttggatgggggcaatttccccaacccccggcgcgggggggtccccctcccggggggccccggggggggggcgccctaaagggcccttccccttatataccccggagggaaaaaaaaagggccaaaacctttcccccgcgagggggttcacacccccgggccctgggagaaaccccccggggtggagaaacccaa

SEQ ID NO: 76696 - protein, 271 aa, Zea mays
  misc_feature: Ceres CLONE 1561482
  misc_feature: SWISSPROT Homolog: EC 3.3.2.10 Soluble epoxide hydrolase
  misc_feature (95)..(95): Xaa is any aa, unknown, or other
MDAEAAAAAEGQVRHWTADVNGISLHVAERGAADAPAVLLIHGFPELWLSWRHQMAALAARGFRALAPDLRGYGDSSVPTDPAAYSILHIVGDVXRWEATKNTSSAAHKSFLLHNRGKRTEEEKKLHKMEQFNLPRSIKRANGKRVKPPSAYRVEAHLLRGTANGNPRLGPDGTGLFTYGAPLSDSPPSRRDLVPARRGWPPGWNPLGWGQFPQPPARGGPPPGGPRGGGALKGPSPYIPRREKKRAKTFPPRGGSHPRALGETPRGGETQ

SEQ ID NO: 76697 - DNA, 896 bp, Zea mays
  misc_feature: Ceres CLONE 1561486
  misc_feature: Encodes the peptide sequence at SEQ ID NO. 76698
ggagctccccgcggtggcggccgctctagaactagtggatcccccgggctgcaggaattcgtctcacccctagaaaaagccagcgaaccaactattcgtttgcttttcgtcttcgtcctctctttgcccagttgtcggtcgcccgcgccgtcgtctccgctccgccggccttcctgcgaaaccctagcgaggcgagcgagagagaaactagcggccatgttcggctacaggaaggctgacccggacctcgaggccggcgggtcctcgctgctgtacccgggaatgacggagagccccgagctgcggtgggcgttcgtccgcaagatctacgtcatcctagccgtccagctcgccatgacggccgcggtctccgccttcgtcgtcaaggtgcccgccgtctccaacttcttcgtctcctccaacgccggggtcgcactctacatcttcctcatcatcctgcctttcctcgtgctgtgccctctgcgctactaccaccagaagcatccggtcaatctgctgctgctcggcctcttcaccgtcgccatcagctttgccgtcggcatgacatgcgctttcactagcggaaaatcattttggaggctgccattctacagcagtggtggtgatcagcttaactgcgtacactttctgggctgcaaagagggggtctgattccaacttccctcggtcccttcctatttggcggctaccaaggggccccatggttggtttcacctaaatccgaatcctttttcccgcctgggggaaaaaatcctgggaatgaatttacgggggggttggggattcccctttatccttccgtgggggaacacccccccctaggaacaccgggacaatggttctttagaggcgcttaccccctcccggatgaataa

SEQ ID NO: 76698 - protein, 151 aa, Zea mays
  misc_feature: Ceres CLONE 1561486
MFGYRKADPDLEAGGSSLLYPGMTESPELRWAFVRKIYVILAVQLAMTAAVSAFVVKVPAVSNFFVSSNAGVALYIFLIILPFLVLCPLRYYHQKHPVNLLLLGLFTVAISFAVGMTCAFTSGKSFWRLPFYSSGGDQLNCVHFLGCKEGV

SEQ ID NO: 76699 - DNA, 863 bp, Zea mays
  misc_feature: Ceres CLONE 1561489
  misc_feature: Translation starting site: 190
  misc_feature: SWISSPROT Homolog: EC 3.1.3.16 Phosphoprotein phosphatase
  misc_feature (392)..(392): n is a, c, t, g, unknown, or other
  misc_feature (603)..(603): n is a, c, t, g, unknown, or other
  misc_feature (762)..(762): n is a, c, t, g, unknown, or other
aagctggagctccccgcggtggcggccgctctagaactagtggatcccccgggctgcaggaattcgtctcacccctagaaaaaggggttaacttccaaggaaccagttcattgctggttctgctagcaggaggttggatttcagaggcagaagctttcagccaggcgggctcagggcgcgggcacatcaatggctggcaaggaaatcctccacaaggtgaaggacaaggtgaaagatgcatttagttcatcaggaccagaaacagggaaaggcaagacaaagttatcaggcaagcgtgtcaagcatggttaccatctggtgaagggcaaatctaatcatccaatggaggattatctagtggcagagtaccggcaagttggtgaacatgattntgggattgtttgctatattcgatggtcacctgggccacactgttccagactttttgagctcccatcttttcaataacatcttgagtgagccagaattcttgagtgatccagaaactgctatccgaaacgcataccaacttacggatcagaagatattggaaaacgcagcagatgttgggaagaggtggctccacagctgttactgccatcntaataggaagtgacaagttcgtgaaaactagttgttgcaaatgttggggaattcacgggcagttattagcaaagaacggtgtagcgaagcagcttttcagttgaccatgaaccaaacatggagcgacaaacgacggagcagaagggtggctttgtatcnaacctaacgggttgatgtgcccacgtgtttgatggggcagctgggcagttgcaggggcattttggagaccggagctttgaagaacaccctcagctcctgaa

SEQ ID NO: 76700 - DNA, 827 bp, Zea mays
  misc_feature: Ceres CLONE 1561492
  misc_feature: Encodes the peptide sequence at SEQ ID NO. 76701
ctcaccgcggtggcggccgctctagaactagtggatcccccgggctgcaggaattcgtctcacccctagaaaaaaatcatcgtcaccccggagcctctccttcccggtctcctccgcccgttgccttcgtcccctccatctccggctgcgtcgccggcgagcccgacaccgcgaatcggatccgccgacaaggcgagagggaaaagatggggcttacgttcaccaagctgttcagccggctgttcgccaagaaggagatgcggatcctgatggtgggactcgacgccgccggaaagaccaccatcctctacaagctgaagctaggcgagatcgtcaccaccatccccaccatcggattcaatgttgaaactgtggagtacaagaacatcagcttcactgtctgggatgtcgggggccaggacaagatcaggccactgtggaggcattacttccagaacacccagggtctcatctttgttgtggacagcaatgatagggaccgtgttgttgaagcaagggatgagcttcaccgaatgctgaatggagatgagttacgtgatgctgtgttgcttgtggttgctaacaagcaagatcttcaaatgctatgaatgccgctgaatcactgaataggcttggactggatttcccttccccggcgtcattggtacattcaaagcccttgtgcctccaaccggtgaagggaattgatgaaaaggcctggaatgccttgtcaacaaactttgcacccaagtcctaaattggcaaggcaggggtttggaccctctagggaccttttggaaaaaaaaaaaaggggggcggaaattttg

SEQ ID NO: 76701 - protein, 133 aa, Zea mays
  misc_feature: Ceres CLONE 1561492
  misc_feature (5)..(133): Pfam Name: Arf Pfam Description: ADP-ribosylation factor family
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNGDELRDAVLLVVANKQDLQML

SEQ ID NO: 76702 - DNA, 848 bp, Zea mays
  misc_feature: Ceres CLONE 1561493
  misc_feature: Encodes the peptide sequence at SEQ ID NO. 76703
  misc_feature (616)..(616): n is a, c, t, g, unknown, or other
  misc_feature (653)..(653): n is a, c, t, g, unknown, or other
ctggagctccccgcggtggcggccgctctagaactagtggatcccccgggctgcaggaattcgtctcacccctagaaaaagactagaaccaaacttttcaatccatcgttcgcagttcagttcacacttcacaggcgagcagcgaccatggatacccaagcacgtccggttcctccccgcgtcaagctcggcatccagggattcgaggtgtccaagctggggttcgggtgcatggggctgacgggcgcgtacaactccccgctggacgacgaggccggcatcgccgtcatcgcgcacgctttcagccgcggagtcaccttgttcgacacctccgacgtatacgggcccctcaccaacgaaatcctcctcggcaaggcgctgaagcagctgccgcgggagcaggtgcaggtggccaccaagttcgggatacggcatgacgagagcggcacgcggaccgtgtgcggccggccggagtacgttcgcgcctgctgcgaggccagcctgcgccgcctcggcatcgactgcatcgacctctactaccagcaccgcattgacaccacaactcccatcgaggagacgattggcgagctcaagaagctggtggagggagggtaangtcaagtacatcggattgtcagaggcgagcccggaanccatcaggcgtgcacatgctgtgcacccgatccccggtggcagatggagtggtctctctggtctcgcgacattgagccccgaattgtgccgctctgcagagaaatgggcattggaattgtacataaggcctcttgggtcgggggttttttggtgggaaaaaagatggaaaaaaaacagtgtctgcctgatctaat

SEQ ID NO: 76703 - protein, 155 aa, Zea mays
  misc_feature: Ceres CLONE 1561493
  misc_feature: SWISSPROT Homolog: EC 1.1.1.65 Pyridoxine 4-dehydrogenase
MDTQARPVPPRVKLGIQGFEVSKLGFGCMGLTGAYNSPLDDEAGIAVIAHAFSRGVTLFDTSDVYGPLTNEILLGKALKQLPREQVQVATKFGIRHDESGTRTVCGRPEYVRACCEASLRRLGIDCIDLYYQHRIDTTTPIEETIGELKKLVEGG

SEQ ID NO: 76704 - DNA, 1013 bp, Zea mays
  misc_feature: Ceres CLONE 1561494
  misc_feature: Encodes the peptide sequence at SEQ ID NO. 76705
ctccccgcggtggcggccgctctagaactagtggatcccccgggctgcaggaattcgtctcacccctagaaaaactcccccgtgcctcacggtcgacagctacctggccgagccaccatcaaagcgccagtacaccagtacctatgcattgctagcagctagctcgagtccgctcccaccgtacccactgccagtgccacaccacgcgtacgccatggcgccgtcgccggcggcggtcgcgcacggcgagggcgcgagcgccggcggcgccgtgtgctgcatgtgcggcgaccgcggcctgccgggcgagctgttccggtgcaggtgctgccgctcccggctacagcacaggtactgcagcgacctgtacccgagggcggccgagtaccggcggcccaactggtgcctgcgggagccggggccgggggtcggccaagcgggcctgggccatgcccatgccgcggcggtatttgcggctaacaacaagcagcccgaggatgataaacggaagaccacggcggcagcgacggacgaggagcggcggcagcgccacgaccacgatggggtgctccccgaagaggttgtcgccgccgcggtcgccctgcgggagctcggacaccctgtgaagaattaagccagggcccaaagagaaatatccgccgccggccgccggggggtggcgggctaaaaaacgggcccgaagaagggaaaacggaaagaccccggccggcggccctccgaacaaagagatgggcccccggcaagccccacaaagggggtgcctccccgaaccactgaggaaattcctccccccccgtcctggtggaaccctgcatcaccctggtgaaaaaataaagcaccagggcccctaaagagaaaaacccccccagacctttcatagggaaagagggcgcgggcggtaactagggtcggccgtggaggggggatcgttaaagaaattctcccgagttaaaataacaagcgctctcgcaaaaacacatcctcgtcccctg

SEQ ID NO: 76705 - protein, 139 aa, Zea mays
  misc_feature: Ceres CLONE 1561494
MAPSPAAVAHGEGASAGGAVCCMCGDRGLPGELFRCRCCRSRLQHRYCSDLYPRAAEYRRPNWCLREPGPGVGQAGLGHAHAAAVFAANNKQPEDDKRKTTAAATDEERRQRHDHDGVLPEEVVAAAVALRELGHPVKN

SEQ ID NO: 76706 - DNA, 968 bp, Zea mays
  misc_feature: Ceres CLONE 1561496
  misc_feature: Translation starting site: 110
  misc_feature: Pfam Name: Rubredoxin Pfam Description: Rubredoxin
ctacccgcggtggcggccgctctagaactagtggatcccccgggctgcaggaattcgtctcacccctagaaaaaacccgctgccatcctcgcagtcgcagcccctcaccatggctgccacactctcctccgtggctgccccttccctccccaagcacgtctccgttaccagagctcagcagcaggcgcctccttccatcatctcggcatcaactaagactgccttccatggggtgtcgctggtggtggacaggaggtgggcggccggccaccggagaggcagcggccggcggaggctgctgcaggtgaacgcgaggaccgccgccaagaacatcgaggtggaggtcgagaagccgcttggcttagccttgggccagaagcccggtggtggcgtcgtcatcacttctgtggagtctggagggaatgcagccagagccggtctgaaaaccggggaccaggtcctgtacacaagcagcttcttcggagacgagctgtggcctgcggataagcttgggttcaccaagacagccatccaagcgaagtcagactccgtctacttcgtcgtgagcaggggtgccgaagttgacgtgaagcgcctacctaagaggcccggcgccaccccggtttggacggaagctgactgattcacaaaaggagagagcaacgcacgtctgccttgattgggggtacatatacttcctacccaagccttttgacgatcagcccgacgactactgttgcccacagtgcaacgcgccgaaaaaaccggtttggatgtacgacgctgcccacgggaaagggcatccgcgggcgctcttgcggcctatcgccggggatcgttaagtttgggggaccggcatcgctggggggtaggagccctcgctcctgtataggccggcaagtacccctggctcgttccatgttcagaaaccctctgtttttgtttttggggagggcccacagaaaccc

SEQ ID NO: 76707 - DNA, 779 bp, Zea mays
  misc_feature: Ceres CLONE 1561497
  misc_feature: Encodes the peptide sequence at SEQ ID NO. 76708
ctcaccgcggtggcggccgctctagaactagtggatcccccgggctgcaggaattcgtctcacccctagaaaaaaagtggcctgcgttcctcttccacgctccgcccacccgtcccggggcccgccgcaacccgatccctccccgcgcccaacgatgccggccggccagccgcacgcgcacgaagccgctgccgccgcctgcgtcggcagcggcgcgaaccactccaaccaccgagtgccggcgcactcgccaccgccgctccccgcggaggtggtgccggcgtacccgcccccggagtcggaggacgacgagacctgggtgtggacgcagatcaaggcggaggcccgccgcgacgcggacgcggagccggcgctcgcctccttcctctacgccaccgtgttgtcccacccgtccctgccccgctccctctccttccacctcggcaacaagctctgctcctccacgctccctctcacgctcctctacgacctcttcctcgccacgctcaccgagcaacccctttctccggggcgccgtcgtcggcgaacctcctgggggccaatcccgcggaccccgcctgcgtcggcttctcccaactgcctcctcaactacaaggggcttcctcgccattccaggccccacgcggtcccgccacgtggttcggggggcaacaagggaaagggcccctgggggcttggggcttcaatgtccggggttgcccaaaatttttcccccggttgaaaatcaacccccgcccccccttccccgcgggaaaggg

SEQ ID NO: 76708 - protein, 195 aa, Zea mays
  misc_feature: Ceres CLONE 1561497
  misc_feature (56)..(156): Pfam Name: SATase_N Pfam Description: Serine acetyltransferase, N-terminal
  misc_feature: SWISSPROT Homolog: EC 2.3.1.30 Serine O-acetyltransferase
MPAGQPHAHEAAAAACVGSGANHSNHRVPAHSPPPLPAEVVPAYPPPESEDDETWVWTQIKAEARRDADAEPALASFLYATVLSHPSLPRSLSFHLGNKLCSSTLPLTLLYDLFLATLTEQPLSPGRRRRRTSWGPIPRTPPASASPNCLLNYKGLPRHSRPHAVPPRGSGGNKGKGPWGLGASMSGVAQNFSPG

SEQ ID NO: 76709 - DNA, 833 bp, Zea mays
  misc_feature: Ceres CLONE 1561503
  misc_feature (683)..(683): n is a, c, t, g, unknown, or other
  misc_feature (714)..(714): n is a, c, t, g, unknown, or other
  misc_feature (809)..(809): n is a, c, t, g, unknown, or other
  misc_feature (813)..(813): n is a, c, t, g, unknown, or other
  misc_feature (814)..(814): n is a, c, t, g, unknown, or other
ctggagctccccgcggtggcggccgctctagaactagtggatcccccgggctgcaggaattcgtctcacccctagaaaaaaccttccctcggtcccttccatcttctagccgccgccgccgccgccgctgcccaaaaccctacctaccctcttcttccccctcactctcctttcatctccattctaatggcggcccaacccgtccggcgaagctgctagtgcttgtatctactatcttcatcaggtacttcgccatcctactgaagtattccccgccgccgctgccatggccaccctcaaccctttcgaactcctcggcgccgacgacaacgacgacccgacgcagctgattgcggcggcggcggctgctgctcagaaagccgaggcgaagaactccgccgtggcgcctgctgggaaggctgcccagcctgcggcgaccaccaagttcccgaacaagcccgctcctccctcgcagacggttcgggatgcacgcggcggtggctcatcagctcgtggaggctttggcccgtgtggaacgtggccgtggcagaggtggacggggataatggccagacccgtggcttccgtgggtgaccatggcaaagagttcccagggagggtttttggggggggggaggcttttggggggaagggggggcttaaaaaccgggggggctttcccnaaggaagaaaaaggggggaaaaaaaaaaaanccttctccccccccccccccaaggggggggggggaggggaaagaaaaaaaaaagggggggggggtgttgttttaaaaaaaaaaaaaaaaaaagantgtnntttttttttgtcttttacc

SEQ ID NO: 76710 - DNA, 858 bp, Zea mays
  misc_feature: Ceres CLONE 1561507
  misc_feature: Encodes the peptide sequence at SEQ ID NO. 76711
  misc_feature (624)..(624): n is a, c, t, g, unknown, or other
  misc_feature (663)..(663): n is a, c, t, g, unknown, or other
  misc_feature (668)..(668): n is a, c, t, g, unknown, or other
  misc_feature (718)..(718): n is a, c, t, g, unknown, or other
ctccccgcggtggcggccgctctagaactagtggatcccccgggctgcaggaattcgtctcacccctagaaaaaatcacggcggcggtggcggagcggaaggcgaaggagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatncaggccaacgacaccatcaagatcgatctggagaccaancaaantgtggacttcatcaagtttgatgttggcaacgttgtcatggtgactggcngaaggaacactggcccgtgtgggtggtatcaagaacagggagaagcacaagggcagctttgagaacatttcacgtggaggactcccctggggcaccagtttcgcacccggaatgggcaacgtgttcaccatcggcaaggg

SEQ ID NO: 76711 - protein, 205 aa, Zea mays
  misc_feature: Ceres CLONE 1561507
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (154)..(154): Xaa is any aa, unknown, or other
  misc_feature (167)..(167): Xaa is any aa, unknown, or other
  misc_feature (169)..(169): Xaa is any aa, unknown, or other
  misc_feature (186)..(186): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLXQANDTIKIDLETXQXVDFIKFDVGNVVMVTGXRNTGPCGWYQEQGEAQGQL

SEQ ID NO: 76712 - DNA, 883 bp, Zea mays
  misc_feature: Ceres CLONE 1561510
  misc_feature: Encodes the peptide sequence at SEQ ID NO. 76713
  misc_feature (883)..(883): n is a, c, t, g, unknown, or other
ctccccgcggtggcggccgctctagaactagtggagcccccgggctgcaggaattcgtctcacccctagaaaaaaggccacttacctgcagtcaccactcccaagccagtacccacagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccccccccaactgcctcaagaacgccgccaggggcgtcagcggcctcaacgccggcaacgccgccagcatcccctccaagtgcggcgtcagcatcccctacaccatcagcacctccaccgactgctccagggtgaactaaaacctagaccacgcgcgacgacggccgcctgatcgatcgaccaaccattccgccgtcgccgccggccggatcatcggtcgtcgtcatgatgatatctatcaatctacgcgtgatgatcgatggctacttgtcaactgcatagtactactaaataaaatctctcccccgtgtgaggaccccgtacccttggatggtgcaatgatagcatgtaacggtacgaacgttcgtcccatgtaataagatgttttggacccggtggtatacgggcccgaagaggagagaagaaaaccgtggattctttatctgagaggaacggggcattggttccttgttgcggctgtggttgggtgttn

SEQ ID NO: 76713 - protein, 121 aa, Zea mays
  misc_feature: Ceres CLONE 1561510
  misc_feature (32)..(117): Pfam Name: Tryp_alpha_amyl Pfam Description: Protease inhibitor/seed storage/LTP family
MARTQSAVAVAVVAAVLLLAAAATTSEAAITCGQVSSAIAPCLSYARGTGSGPSASCCSGVRNLKSAASTAADRRAPPNCLKNAARGVSGLNAGNAASIPSKCGVSIPYTISTSTDCSRVN

SEQ ID NO: 76714 - DNA, 861 bp, Zea mays
  misc_feature: Ceres CLONE 1561512
  misc_feature: Encodes the peptide sequence at SEQ ID NO. 76715
  misc_feature (654)..(654): n is a, c, t, g, unknown, or other
  misc_feature (723)..(723): n is a, c, t, g, unknown, or other
ctggagctccccgcggtggcggccgctctagaactagtggatcccccgggctgcaggaattcgtctcacccctagaaaaagcctctcaaccactcatcatcgccttcgcaggcatcgccctctcgccgggccgtccgattccgccatggcttccgatgagagcaaaaattcaaaaccagagaagccatcttcagcagctggtgcaggcctccccaatccgtttgatttttcttctatgagcaacttgctcaatgacccatcgataagagagatggctgagcaaattgcaagtgaccctgtgttcaaccagatggctgaacagcttcagaaaagtgctcagggtgctggagaacagggtattcctgcattggatcctcaacagtatatggaaacaatgcaacaagtcatgcaaaaccctcagtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgagatagagaatgggggtccatctgcaatggtgaagtattggaatggaccctgaggttcttcaaaagattggcaggncaatgggtgttaaccttcccggaagattctagtgtgtccactgtgctctctggacccgaagagactgangaggaaaggaggggattgaccgatgagtccattgttcatcacactggcaagtgttggtgaatgaaaaaaggggtttgagaaaaggctttagaaaggtggagcagaccagggatgaaagagatgcccgaggggaagacg

SEQ ID NO: 76715 - protein, 161 aa, Zea mays
  misc_feature: Ceres CLONE 1561512
MASDESKNSKPEKPSSAAGAGLPNPFDFSSMSNLLNDPSIREMAEQIASDPVFNQMAEQLQKSAQGAGEQGIPALDPQQYMETMQQVMQNPQFVSMAERLGNALMQDPAMSSMLENLTSPAHKEQLEERMARIKEDPSLKPILDEIENGGPSAMVKYWNGP

SEQ ID NO: 76716 - DNA, 820 bp, Zea mays
  misc_feature: Ceres CLONE 1561515
  misc_feature: Encodes the peptide sequence at SEQ ID NO. 76717
  misc_feature (693)..(693): n is a, c, t, g, unknown, or other
acccgcggtggcggccgctctagaactagtggatcccccgggctgcaggaattcgtctcacccctagaaaaactacagaacatctgatgagattcattaccaaggattctgagggatatgtgccaatatcagtaattgctggctttaagaaagtaaaaacttctgtgcgcaataatgtgatgcttgctgcggctctccgaacctcatcaaaacttgttgtaagcgatgacggtaagagagtcaaaaggcagcagccatttacagaatctgatttgcaggagctccagtcccggattgttgtagcagaaaatcttcctggtgatccctcctaccagaatcttaagaagatattttcagctgttggaagtttgatttcaatccgaacttgctatcctcagactccaaatggcactggtcctgcaactaatagatcttccaagttagatatgctttttgctaacaagctgcatgctttcgtggagtacgaaactcctgaggatgctgcgaaggctattttggagctcaatgatgagaaaaactggagaaatgggcttagagttcggttgctgaatacttgcacggtgaagggggcaggcaaaggaaaaaacggaatgaatgaaactgatggaaatagtgaggaagatgtctccactttgaaccattctaacgagaaacagtttgaacaatcctctncaactgtagatgtactgccggaaacacctgttttgatgagaatttcaacaaggaaagtcccaagcggcggaaaagggccccggccacggtggcaaaagggcatgggccctggccaacaatcaatata

SEQ ID NO: 76717 - protein, 244 aa, Zea mays
  misc_feature: Ceres CLONE 1561515
  misc_feature (1)..(40): Pfam Name: La Pfam Description: La domain
  misc_feature (203)..(203): Xaa is any aa, unknown, or other
MRFITKDSEGYVPISVIAGFKKVKTSVRNNVMLAAALRTSSKLVVSDDGKRVKRQQPFTESDLQELQSRIVVAENLPGDPSYQNLKKIFSAVGSLISIRTCYPQTPNGTGPATNRSSKLDMLFANKLHAFVEYETPEDAAKAILELNDEKNWRNGLRVRLLNTCTVKGAGKGKNGMNETDGNSEEDVSTLNHSNEKQFEQSSXTVDVLPETPVLMRISTRKVPSGGKGPRPRWQKGMGPGQQSI

SEQ ID NO: 76718 - DNA, 850 bp, Zea mays
  misc_feature: Ceres CLONE 1561516
  misc_feature: Encodes the peptide sequence at SEQ ID NO. 76719
  misc_feature (277)..(277): n is a, c, t, g, unknown, or other
  misc_feature (759)..(759): n is a, c, t, g, unknown, or other
ctccccgcggtggcggccgctctagaactagtggatcccccgggctgcaggaattcgtctcacccctagaaaaaatgtggtcggggagacggggactcggggtagcgactagcgagccgaggagcgcgcgcgcgcgatggcggccgctgccgtggcgaccgtggcctccccaccccccgctgcctccaggcgtatgctcccctccgccgcaccgtctttcctccggctcccgaggccgaccagccggctccggcgcgccacgcaggtcgccgcggcnggggggagaggcggacgtgctgcctggtccgggggccgagggtgaggcggcggttccggggaggctggaggagcagcgggacgagccgctggcgggaagccagctcgacatcggagggctcgccttccagggcgacgtcgggcgggggtttcaccggcggcggagcgggctccggggcctccggcggtggcggcgacggcaacaagatgctggaccggggcatcaatacggccatcgttcttgcggccagcacctacgcgctcaccaagctgctcaccgtcgaccaggactactggcatggggtggacgaatctttgagatcctgcgctatatgccggagcacacctggtccgcgtacgaggaggccctcaaagctaacccggttctagccaagatgatgatcaagtggtgtcgtctactcccttgggtgactgggattgcacagtgctacgaaggcaacccaatcttttgatttcgaccgntgctcggaatgttcccggtctgggcctttgttgggtcacgccttcatggggtcactttcacattactaactaccctattcgttgaggcact

SEQ ID NO: 76719 - protein, 224 aa, Zea mays
  misc_feature: Ceres CLONE 1561516
  misc_feature (68)..(68): Xaa is any aa, unknown, or other
MWSGRRGLGVATSEPRSARARWRPLPWRPWPPHPPLPPGVCSPPPHRLSSGSRGRPAGSGAPRRSPRXGGEADVLPGPGAEGEAAVPGRLEEQRDEPLAGSQLDIGGLAFQGDVGRGFHRRRSGLRGLRRWRRRQQDAGPGHQYGHRSCGQHLRAHQAAHRRPGLLAWGGRIFEILRYMPEHTWSAYEEALKANPVLAKMMIKWCRLLPWVTGIAQCYEGNPIF

SEQ ID NO: 76720 - DNA, 949 bp, Zea mays
  misc_feature: Ceres CLONE 1561518
  misc_feature: Encodes the peptide sequence at SEQ ID NO. 76721
ctccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcagatcttctcggagggcgggctggactacctggggaaccccaacctggtgcacgcccagagcatcctggccatctgggcgtgccagggggtgctcatgggcttcgtcaagggctaccgcgtcggcggcggccccctcggggaagggctcgacaaggtgtaccccggcggcgccttcaaccccctgggcctcgcgaaagacccggacaccgccgcccaaacccaggtgaaggagccccaaaaaggcgccttggccgggtccccaggttggcttcttcggggcaggcattcttcaccggaagggcccctttataaaacctttttaacaagttgccaaaccccgtgcccaaaaagacttggggaaaaccccaataatttttctcccggggaaataatgtatagga

SEQ ID NO: 76721 - protein, 264 aa, Zea mays
  misc_feature: Ceres CLONE 1561518
  misc_feature (59)..(216): Pfam Name: Chloroa_b-bind Pfam Description: Chlorophyll A-B binding protein
MAASALHQTTSFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQGVLMGFVKGYRVGGGPLGEGLDKVYPGGAFNPLGLAKDPDTAAQTQVKEPQKGALAGSPGWLLRGRHSSPEGPLYKTFLTSCQTPCPKRLGENPNNFSPGEIMYR

SEQ ID NO: 76722 - DNA, 848 bp, Zea mays
  misc_feature: Ceres CLONE 1561519
  misc_feature: Translation starting site: 284
  misc_feature (661)..(661): n is a, c, t, g, unknown, or other
ggagctccccgcggtggcggccgctctagaactagtggatcccccgggctgcaggaattcgtctcacccctagaaaaaataggtaccgcggtctcagatcgcgcgtcatctcccctcggccacgcttgccttcacctatccgcaagcgcagatcttccaatatctctgtcggcatgagagggagctcaatgctgctgatgaaggcgttcgccacattcgctgatttccctggggaagagatggggctctcctttggtaagctgttcagccgcactcttcgcctatgaaggagaggaagattctcttggtctggctccatgcctgcatgttcacctccttcctcttcaaactcttgctcggcgagatcgtctcctccatccccacgttcggattcaatgttgaaactgttgagcatgagaacattagctctcactgtttgggatgttggtggccaggacaagatcacgccacctgtggaggcgctactttcagacacacacgtacttatttttgtcgcatacaccacgacatgaaacgtgttgatgaatgcttgagatgactccaccgatgcggatgacgatgactgcctgacaccatgctgcttgcattttactacctacttcatcttcacaatgcgctgtatgctgctgaaattctggcnagctttgggtctgcattccctgctaacagcggtcccttgggcgtcccagaaaaccttttctggcgtaaggttggacgggttgattttcaggggaatataactgggtttccctttcagctttttcaggaaaggggggaaaaattttttctggtaggggcccccaaaacttttaggcgtgtttgaaaaa

SEQ ID NO: 76723 - DNA, 850 bp, Zea mays
  misc_feature: Ceres CLONE 1561521
  misc_feature: Encodes the peptide sequence at SEQ ID NO. 76724
  misc_feature (791)..(791): n is a, c, t, g, unknown, or other
  misc_feature (793)..(793): n is a, c, t, g, unknown, or other
  misc_feature (794)..(794): n is a, c, t, g, unknown, or other
tggagctccccgcggtggcggccgctctagaactagtggatcccccgggctgcaggaattcgtctcacccctagaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtccgcaacatcgcctccatggtcccaccctacgacaagatcaagtacgccggcaccgggtccgccatcgagtacgccgtgtgcgcgctcaaggtgcaggtcatcgtggtcattggccacagctgctgcggtggcatcagggcgctcctctccctcaaggacggcgcgcccgacaacttccacttcgtggaggactgggtcaggatcggcagccctgccaagaacaaggtgaagaaagagcacgcatcggtgccgttcgatgaccagtgctccatcctgggagaagaagccgtgaacgtgtcgcctcagaaactcaagagctaccccttcgtcaaggaagggctggncnngcgggacgctcaaactggtttggcgcccactacgacttcgttcaaaaggcaattcg

SEQ ID NO: 76724 - protein, 198 aa, Zea mays
  misc_feature: Ceres CLONE 1561521
  misc_feature (31)..(192): Pfam Name: Pro_CA Pfam Description: Carbonic anhydrase
  misc_feature: SWISSPROT Homolog: EC 4.2.1.1 Carbonate dehydratase
  misc_feature (179)..(179): Xaa is any aa, unknown, or other
  misc_feature (180)..(180): Xaa is any aa, unknown, or other
MDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFHFVEDWVRIGSPAKNKVKKEHASVPFDDQCSILGEEAVNVSPQKLKSYPFVKEGLXXRDAQTGLAPTTTSFKRQF

SEQ ID NO: 76725 - DNA, 973 bp, Zea mays
  misc_feature: Ceres CLONE 1561522
  misc_feature: Encodes the peptide sequence at SEQ ID NO. 76726
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (107)..(107): n is a, c, t, g, unknown, or other
ctccccgcggtggcggccgctctagaactagtggatcccccgggctgcaggaattcgtctcacccctagaaaaaaacacccccccccccccacannnnntcctctanaagcaacagcagcagcacaccggcctccaagaggaggagcggagaggaggaaggtgagcggttgcctccgaaagcaagccatcactggcggctaccaaatgcaggcatgcatatagcgaacaggacagaaagccgccgaggaggaagaagaaggacaagttggggcagagctcaaggacgtcaagaaacggtcgctcgctggcacgcccaccatgtcctatgatcaggggctctccgtggccgggggattcgggtggaaaggggctcaacccggggggaacccgggaacaggcaaatactccatggcccccggtgggcaccgggagaaaccacccaattttgttaactggccccctccacttattatggggaaagttccttacccgggggattatttcccgggggcggtgggggttcttcttggcccccctttttccgcgggtatggtttccttctccccccctcggggtttacccggcctttaaccctttttcgcgggggggaaaaaggggggggggaaaaattcccggggggggggaagaccccggggccccgggggggctccaagggttttgggggggaaaaataacttgggcccctttgggggccctttttctgtttcccccttggggggtgtgtttggcccccccggggggggacggggggggaaaacccgttttccccctggggcaccttcggggcgggtttttttgtttttgtttaaggggttcggcgctgggtttcccaaaagggccaagggacccccggtaccgggggggggggggggcccccggggcgggggggttgcacccactgtttcttgaagccgttgggtgccctaaaaggggtgggagcccccggggccc

SEQ ID NO: 76726 - protein, 90 aa, Zea mays
  misc_feature: Ceres CLONE 1561522
MSYDQGLSVAGGFGWKGAQPGGNPGTGKYSMAPGGHREKPPNFVNWPPPLIMGKVPYPGDYFPGAVGVLLGPPFSAGMVSFSPPRGLPGL

SEQ ID NO: 76727 - DNA, 937 bp, Zea mays
  misc_feature: Ceres CLONE 1561524
  misc_feature: Translation starting site: 310
  misc_feature: SWISSPROT Homolog: EC 2.7.7.4 Sulfate adenylyltransferase
  misc_feature (732)..(732): n is a, c, t, g, unknown, or other
acccgcggtggcggccgctctagaactagtggatcccccgggctgcaggaattcgtctcacccctagaaaaacctccccaacacgccgccgtcttctgcggtgtctgccgttgactcctccactttggcctcctcacttgcaagtttaatcttcgcctccagccatgggtaaggagaagtctcacatcaacattgtggttattggccacgtcaactctggcaagtcgacaaccaccggccacctgatctacaagcttggaggcattgacaagcgtgtcgatctagaggtttgagaacgaggccgctgaaatgaacaagcggtcctttaagtatgcttgggtgcttgacaagctcatagctgagcgtgagaggggtatcaccattgatattgctctgtggaagcttgagaccaccaagtactattgcaccggtattgatgcccctggacaccgtgactttatgcagaacatgatcactggtacctcccaagctgactgtgctgtccttatcatgtgactccaccactgggtgtctgtcaggctagtatctccaacgatggccagacacgtgagcatgctctcctttgcgtcacacttggagtgaagcacatgatttgctgctgcaacaagatggatgcgaccactcccaaaactccaatgcacgttatgatgagatcgccgaaggaagtctcatcttacctcaagaaaagtgggtacaaccctgatgagatancattgttccccatcctgggtttgaaggggacaacctggatgagaaggtccacaaccttggattggtacaaggcccaaccctgcttgaaggtctttgaccgatcaccgagcccagtaaccctcggataaacccctgcgttcgccctccggaagtttacaaaatgggggaattggaacgggtcccctgggccttttggaaacgaggt

SEQ ID NO: 76728 - DNA, 1025 bp, Zea mays
  misc_feature: Ceres CLONE 1561528
  misc_feature: Encodes the peptide sequence at SEQ ID NO. 76729
  misc_feature (67)..(67): n is a, c, t, g, unknown, or other
  misc_feature (73)..(73): n is a, c, t, g, unknown, or other
gagggagataccatcccctatccatcccaaaaacggaaaaaccgaaattaaataaaaaagagagggnaaaaanaaaaactgaagctccccgcggtggcggccgctctagaatagtggatcccccgggctgcaggaattcgtctcacccctagaaaaaaagttgtcttggcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttcgacctttggccaggaccgacaagacctaccctgctgggttcatggatgtcatttccatccctaagacaatggagaactacaggctgctttatgacaccaagggccgtcttccgtcttcacccaatccaggatgaagatgcccagttccagctctgcaagggtgaggtcctgttcagtttgggccagaaagggcatccccctaccggaaacacctattgaacggccggcacccaatccggcttacccccgacccgccttcattcaaagggcccaatggaccacccattcaaggaatcggattctgggaggactcaacaaaggatcgttgggaactttcagtccaagttttgaacgtccgggcaaaccgtggatccatggggtgaactggggcgaggagggaaacacccggggcgtgggccggggagtggactcagtgaaacctggggcgacagcaccaagggtccgggctttctaatatccgtatcccccgtcaccaaggactttccagtgggtcccaccacggttcccccacccccccatggggccaaacg

SEQ ID NO: 76729 - protein, 116 aa, Zea mays
  misc_feature: Ceres CLONE 1561528
  misc_feature (3)..(40): Pfam Name: RS4NT Pfam Description: RS4NT (NUC023) domain
MARGLKKHLKRLNAPKHWMLDKLGGAFAPKPSSGPHKSRECLPLILIIRNRLKYALNYREVISILMQRHVLVRPLARTDKTYPAGFMDVISIPKTMENYRLLYDTKGRLPSSPNPG

SEQ ID NO: 76730 - DNA, 857 bp, Zea mays
  misc_feature: Ceres CLONE 1561531
  misc_feature: Translation starting site: 143
  misc_feature (397)..(397): n is a, c, t, g, unknown, or other
ctggagctcaccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcngcccacccggagacgttcgccaagaaccgggagctggaggtcatccactcccgctgggccatgctgggcgcgttgggctgcgtgttcccggagctgctcgcccgcaacgggcgtcagttcggcgaaggcgtgtggttcaagggccgggtcgcagatcttcagcgagggtgggctggactaccctcgcaacccaaggctgatccaccgcagaggatcctcgccatctgggccctgccaggtcctgctcatgggcgccattcagggggtaccgcgtcccccggcggccccttcggaaaagggtgtcaaccccgtttaccccggggggaggtttcaacccctttgggcttccccgagaaccctgaagcctttcccggaactccaaggggaaaggagctcaaaaaacggccgcccccgccatggttctcccaggtttgggggttttttcgtccagagccaatct

SEQ ID NO: 76731 - DNA, 1285 bp, Zea mays
  misc_feature: Ceres CLONE 1561533
  misc_feature (52)..(52): n is a, c, t, g, unknown, or other
  misc_feature (53)..(53): n is a, c, t, g, unknown, or other
tcggggttggtctcctctatgacagttggaggcccaactaatatcttttttnnttttttctttttctttttttctggagctccccgcggtggcggccgctctagaactagtggatcccccgggctgcaggaattcgtctcacccctagaaaaaattgcaaatcggccggtcgcacaggcgttgaggctcctcctcccccaggtcacgaaacaccagggatatagcccgggcttgatccctatgcactgcgggggggggcctcctttcgaagccacgggggtactccgttggcggtgttgctggaggatctccgacgtccccagcgccataggggggccccccccctccggacatgtgcagaacggccgagttctgggccgctaaggtgggagcacctgaggaaaagagcgcgtaatggctctttttttgcaacgagctccgggctcgccggccgcccgccccacatgatgcccggtggggggacctcccttaggaaaattccacggggtccggcgttcgggccaagttgcgttctcccgccacaatgcaaagggtgcctgatgcttgcgaagtttccgccttatccaaacaagaagtggctgcgtccccctccggcgaggggttattggaccaaaaatgggcgggaggcccttaggccgggtttatttctctcaatgtgggctatagtgtgggcccacaacgggtgggttgggtggcacttgtacttgtaaactcgctttaacaaaaaagaggtcaccattgatacgcagggtgggtaccactctatcatagttttcccagtgttcggataatattaatgcggaaagatctacaacaaagtgtgtggccgacacttctttagtgcactcctactcaagaggccaattagtggcttgcttcttgcgagtagagtttaaccttgtaggcgtgtcttctgtaagaggtattaatatactactcccacaacatgtggattagggaggcacctcccgatgtacagattgatagatgggcagacactaacagttgagaaacagattcgcttctcgccatttatgttgttctctcccagtgatttaatatcttgtatgattattggatcaaccggaaatatcttgtcggtggagaccccgacagtcttattctccgtctataaacctgaactgtttacaccccattcgtttcattgtagcgaaatatatggtagcgaggtgcgcgcccatgcgagaatgacgatacaccactggagttgatatcatacgtgtttgcgcatatacaaacgctt

SEQ ID NO: 76732 - DNA, 1067 bp, Zea mays
  misc_feature: Ceres CLONE 1561534
  misc_feature: Encodes the peptide sequence at SEQ ID NO. 76733
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gggggattggggcaggcgcaaacccgacgggaccgcacaggnnnnnnnntttcttttttttcaaagctggagctccccgcggtggcggccgctctagaactagtggatcccccgggctgcaggaattcgtctcacccctagaaaaaatcgcgcgcaccggtcagctcagcccgtctgattcgcgtgctgccagccctccgccgatcgtgaaacacaaccgtcggtggtttgcttgcttgatcgctgatcctcgcggacgctcacggtcatggcgcctcagcctttgcgcgctccgaggctgagcgcccccgctggccacgcggcgtgcaggtgctcggccgcgccgctattcgggaagcgggcgccccccgtcgtcgcgttcccccgcgcccgtagcggcggcgccgtcgcctcgtgctcggccgtgcaggagtcgtccacctccaccactgttagcaagaagaatgatgccgcggacggggccaaggaggccacagcggaggcggcgaagccggccgcggccgccaagccaaagaaggccgcggcgctgccgctgccggagatgatgcagcaggagatcatcccaccgctgaaagatgccttggaggcggaggacgacgtgtcccaggtgcagctcgcctttccaaacaacacgctgggagggatccttcataaggaacgacgtccctttattatttttgggcctttctttccaaaaggagacctcacagggacctaagggcttttggcgctatcgctctaccagcaccgaagtgagcaccatcgagccgttccctgatcgatgaaaaagagataaacggccaagtacgtgggtgttctggggcctaacaaaaggctggctgggcaagcaatcctttccggtccggaaaaggaaaaatagggggggaaaaagaaggcccccaaaatttttagggttgtgcatggggccattcgcttatcaaataacacacggggggctgtgccggttaaccaacccttggtaaacccccgttatagagtcacctcgcgcggggaacaccaccctgttgtaaccaaatgatatctta

SEQ ID NO: 76733 - protein, 156 aa, Zea mays
  misc_feature: Ceres CLONE 1561534
MAPQPLRAPRLSAPAGHAACRCSAAPLFGKRAPPVVAFPRARSGGAVASCSAVQESSTSTTVSKKNDAADGAKEATAEAAKPAAAAKPKKAAALPLPEMMQQEIIPPLKDALEAEDDVSQVQLAFPNNTLGGILHKERRPFIIFGPFFPKGDLTGT

SEQ ID NO: 76734 - DNA, 1031 bp, Zea mays
  misc_feature: Ceres CLONE 1561536
  misc_feature: Encodes the peptide sequence at SEQ ID NO. 76735
  misc_feature (71)..(71): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
atacagaaatattactctatgaacgttttttaaggtgattgttttaagtttcaagttcaattaaaattctnttnnncaaagctggagctccccgcggtggcggccgctctagaatagtggatcccccgggctgcaggaattcgtctcacccctagaaaaatccggaagaaagggaaaaaaactcgcctttttctctctgctggttcaagaacgccatggaaaatctggagcgctcgctgtgattcctgcgagtacccaagcccaaccaaaccctagcccggcagccattctcttcgttccctctttgctctgcgcgccacaccacacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccacccggagtagctacaggcagcggcggcggcggcgggagctgtccatccgcgccacggccgcggcgccgccgccgcccgtggtctacgcggacgccggcagccgacaacgtggccctcgctgaagatcaagctccttgagcgcggttgtccgggcctgaaaccgtggccctggcagccaagcccggtagggacctggaaccgcgccggaacacggcgggcgccgggcagcctgggagggcggcccgccggggttggccccccgttccaaccctcagccaaggggaaccttcgaattaaacctggcaggggccccggttggttgggcttgcatgttaacaaacaaaccgccggttctttctttcctcgtgaacgccttcgggcgggcaagtccccacccctggcccccggccccaatccgggacggacttctctcccccaattaaaggccttggggcccaggagtggtttccaaacgcggaatctaacattgtgtgtgagccccccaaacctttcctaacacaatttctggggaaattctggaaccctccgggcc

SEQ ID NO: 76735 - protein, 74 aa, Zea mays
  misc_feature: Ceres CLONE 1561536
MAATWSSSCCAATASSSALLRHARVKSAPWVAGATRSSYRQRRRRRELSIRATAAAPPPPVVYADAGSRQRGPR

SEQ ID NO: 76736 - DNA, 818 bp, Zea mays
  misc_feature: Ceres CLONE 1561538
  misc_feature: Encodes the peptide sequence at SEQ ID NO. 76737
ctccccgcggtggcggccgctctagaactagtggatcccccgggctgcaggaattcgtctcacccctagaaaaaatcgccaccagtggccgcgtcctcttcatttccgccatccgtatcgtctccctagggtttggcactttggccgccgccatggcgtcggcgtcgcgtgcgctcctcatctctcgtgcgctccaggccggcgccgtgtctcgccgcgtccccgccctcctgcgccctgtcgctgctgccgcgagcctcctcccagcggtggcggggccggcaggggccgccctcggcgctagggtgcggtgcttcgcgacccagccggcgacgtcctcgctgcgggactcgtccccgaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgcccaagtcgtctggagtgaggaagaagctaggcaaaagatatactctgtatcgactcgtcattactttggctttggtgctcttgtatctgaagaacttttcttacaactggaagaaattcccaaggtccgctggggtcttcctgattcatacctggaatgtcaaaaacagggactatggaagccaaccccttctaaatggggcaaaacggtccctttggatccctaaattccggggggaaatggggtaaaaaaaaaatgcccggtgccaaagaaaaaaaaaccgggcccaattagaaaggccccccac

SEQ ID NO: 76737 - protein, 194 aa, Zea mays
  misc_feature: Ceres CLONE 1561538
MASASRALLISRALQAGAVSRRVPALLRPVAAAASLLPAVAGPAGAALGARVRCFATQPATSSLRDSSPNWSNRPPKETILLDGCDFEHWLVIMEPPPGDASNPDITRDEIIDSYIKTLAQVVWSEEEARQKIYSVSTRHYFGFGALVSEELFLQLEEIPKVRWGLPDSYLECQKQGLWKPTPSKWGKTVPLDP

SEQ ID NO: 76738 - DNA, 856 bp, Zea mays
  misc_feature: Ceres CLONE 1561539
  misc_feature: Encodes the peptide sequence at SEQ ID NO. 76739
  misc_feature (621)..(621): n is a, c, t, g, unknown, or other
ctccccgcggtggcggccgctctagaactagtggatcccccgggctgcaggaattcgtctcacccctagaaaaagacactcgcgcacttcagcactcagccactcagcacagccactgacccgtcgcctccccggctcgcgaccgcatctctctcgccccttccaagttcctaatcgccaccgctgtccccaaccagcaaaccctagccctcatcgccggcggccatggccgagaccgtcgacgacaagatcagttacttccaggctgtcaccggcatctccgacacggacctctgcacggaaatcctcgccgcgcacaactgggacctgcagctcgcggtgtcctccatcaccgccaacccctcctcgccctccgccccggtttccacctcctcacgcgacccggccccttccgcccctttggcagatgcggagttcgtcgcgccaccgccgccgataccgccgccgcctcagcagcagccggggatcgcgtggaagctggtgacgctccccttctacgtggtctcgggtggggccagcctcgtcgacggctccttccgccttggcgcttgggtcggcggggggcgtgctgtcccgctcccctctccctccttgggctcncgggggagggccggaagcggcgaccgcctggcttaagttgccgcccgtcagctggccgaaggggggtggacttttcttcccccaattcctagccgccaaagggggggccttggccccggcccccccctttctggggcccaagggggtttcccttaaagcccctgccaaccaagggcccaccggggaaattcaaggccttcttggttccggggtaaccccccacccccccccggaa

SEQ ID NO: 76739 - protein, 143 aa, Zea mays
  misc_feature: Ceres CLONE 1561539
MAETVDDKISYFQAVTGISDTDLCTEILAAHNWDLQLAVSSITANPSSPSAPVSTSSRDPAPSAPLADAEFVAPPPPIPPPPQQQPGIAWKLVTLPFYVVSGGASLVDGSFRLGAWVGGGRAVPLPSPSLGSRGRAGSGDRLA

SEQ ID NO: 76740 - DNA, 888 bp, Zea mays
  misc_feature: Ceres CLONE 1561540
  misc_feature: Encodes the peptide sequence at SEQ ID NO. 76741
agctccccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgcctccccttgctaaggtcattcatgacaacctccggatttgtttgagggtttgatgaacaactgtttaatgcccttcccttgccacccaaaaaaactggtttgacggaacccccccccaaggaaccggaaaaagggggcaagggcccccccaccttttaaaaaaaatttcccaaaaaaacccccggggtgtgccaaaggggtgttgggggaaaaaatctccccccccctcttcagaaggggagaccccccccggtgt

SEQ ID NO: 76741 - protein, 163 aa, Zea mays
  misc_feature: Ceres CLONE 1561540
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLASPC

SEQ ID NO: 76742 - DNA, 846 bp, Zea mays
  misc_feature: Ceres CLONE 1561541
  misc_feature: Encodes the peptide sequence at SEQ ID NO. 76743
  misc_feature (393)..(393): n is a, c, t, g, unknown, or other
  misc_feature (785)..(785): n is a, c, t, g, unknown, or other
ctggagctcaccgcggtggcggccgctctagaactagtggatcccccgggctgcaggaattcgtctcacccctagaaaaaaaaaaaccaccggtgcggtgcggccatggttggccttggcgactccaacacacttgcccaaccatccacacgcgcatggtctgatggtcctgccctttccccttgcttgtatagttagttgccaattgccatcgccaactacctcctctcctcgctcctccaaccaaacaagccaccccccacgaaacccgcaatcccagccgaagccggacgatgaagagggacggatggcagcacggcgccgtccggggcagccgcagcaaggtgctgaggacggccgccggcgacgacaactccgacgccgacgcggtcntcaaaacggcggcggcggcggcgaggaagccgacgaacgcgtcccggagcacgggcaagtgccggcgggcccggtgcgcgggctgccacgcgcacccggtctccaaggcgcgcgacaaggccaagggcgcgcgcaagctgcgcgcctgcgacgtcgcgctcaaccaccgcctcgtgtcctggcgcgtcgtcgaccagggccccgggtacagcggcgcgtccgcctcctccctgctggcgtacctggccgggtgaaacagctggcacgaggaggaagaagaccactactagggcggagcggcgtctgaacgccggctctctgaactctacgacctcttcgtcggccgcgggcaaaaggaagacggcctggatgctttaggagaaatcaggcantttaagagcaggggctgttgaatgcacagaatgccaagaagaagaaagtggaggacaacgc

SEQ ID NO: 76743 - protein, 117 aa, Zea mays
  misc_feature: Ceres CLONE 1561541
  misc_feature (34)..(34): Xaa is any aa, unknown, or other
MKRDGWQHGAVRGSRSKVLRTAAGDDNSDADAVXKTAAAAARKPTNASRSTGKCRRARCAGCHAHPVSKARDKAKGARKLRACDVALNHRLVSWRVVDQGPGYSGASASSLLAYLAG

SEQ ID NO: 76744 - DNA, 859 bp, Zea mays
  misc_feature: Ceres CLONE 1561544
acccgcggtggcggccgctctagaactagtggatcccccgggctgcaggaattcgtctcacccctagaaaaagacggcccacggcagagccaccaccagcagcagccccagaaatcgagcaaacacaagctgctccatggcctcaccaacccgaacaccatcgcctccgccggcggtcgagcccatcgcgccttctctctcttcagaacatccgcctgtcaacccctcctgtgacggatccttctcgccggagaacccagcgccagctccacctcctccccctgctactccgcatcctcatactcccggcgatagctctccttcctcaattccgcatccctcggcgccacagcctcttccatctccgcctcctcatactcccgacgagacctctccttcctcaactccgcatccctcggcgccacagcccccaccatctccgcctccgccgagcgctgatgtttctcctcccctctcgcgacagggcgaaacgtcaccgcggcgcccattgccccctccctcacccgctccagtatccccgcctactccagcgccggcgtcctcggaagccaagtcggagcaggaggagggggaatctgctagcgaatcggggagcatgacgctagccatcgttcttagcaaactggagatgcaacccgccctagggccttctcgggcgaagcgtcccccaccagatcgccccagaaagaaatcggccgtccccatcgcggagcttctcttcccccaaaaacttcccggggaagggaggcttaaagccccccccggaaaagggttacccctcccaaggcaacgctgggtccccttgccgccgcccggttactaccggttggggggagac

SEQ ID NO: 76745 - DNA, 973 bp, Zea mays
  misc_feature: Ceres CLONE 1561554
  misc_feature: Encodes the peptide sequence at SEQ ID NO. 76746
  misc_feature (973)..(973): n is a, c, t, g, unknown, or other
ctccccgcggtggcggccgctctagaactagtggatcccccgggctgcaggaattcgtctcacccctagaaaaaattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcgtctggctgtgcggtccgctgtccggcctcctcgtccagcccctcgtcggccacctctccgaccgcatcggccccgccgcttccccgctcgggcgccgcaggcccttcatcgccgccggcgccgcgtgcatcgccgcagccgtgctcaccgtcggcttctccgctgacctcggccgactcttcggcgacgacgtcaccccgggctcaacgcgcctcggcgccatctgcgtctaccttgtaggattctggctgctcgacgtgggcaacaacggcacgcaagggccctgcagggcgttcctcgccgacctcacagagaatgacccaaggaggactccgatcgctaatgcatacctttcactcttcatggccctgggaaacatacttggaatatccacccgagcatacaggggatgggattcgatatttccctttccttgttacaaatccctgcggatcaagttggggccacccttatttctgcctttcttccctgaaattatgggtcgggtcaccacaaccggaccccactggaaaattcccggtcaaaaccctcaaaccttttgggaagggatgacgcccattatcccggggactgaaacacgaaacccttccctcggggaaaattgtgtgggcccttaagaaaacttccacccccccaan

SEQ ID NO: 76746 - protein, 271 aa, Zea mays
  misc_feature: Ceres CLONE 1561554
MPPRTAPAATSTPPRKVPLRKLLRAASVACGVQFGWALQLSLLTPYVQELGIPHAFASLVWLCGPLSGLLVQPLVGHLSDRIGPAASPLGRRRPFIAAGAACIAAAVLTVGFSADLGRLFGDDVTPGSTRLGAICVYLVGFWLLDVGNNGTQGPCRAFLADLTENDPRRTPIANAYLSLFMALGNILGISTRAYRGWDSIFPFPCYKSLRIKLGPPLFLPFFPEIMGRVTTTGPHWKIPGQNPQTFWEGMTPIIPGTETRNPSLGENCVGP

SEQ ID NO: 76747 - DNA, 831 bp, Zea mays
  misc_feature: Ceres CLONE 1561556
  misc_feature: Encodes the peptide sequence at SEQ ID NO. 76748
  misc_feature (664)..(664): n is a, c, t, g, unknown, or other
  misc_feature (665)..(665): n is a, c, t, g, unknown, or other
  misc_feature (728)..(728): n is a, c, t, g, unknown, or other
  misc_feature (754)..(754): n is a, c, t, g, unknown, or other
  misc_feature (773)..(773): n is a, c, t, g, unknown, or other
ctggagctccccgcggtggcggccgctctagaactagtggatcccccgggctgcaggaattcgtctcacccctagaaaaagtgatcccctgtggttccttccgagcaagggagaaagaatgcagtcgtctcctccgcgtcgccctcctccagtgtagaaaactgcagcccgtatagtgtcctcggcgctaagggacgaggatgcaggaggcggcagcaggcgcctatccctcctacatggagccggagccggagccggagcagacgggtgcatcggcgactgtgggtgtgatgggctgccgctcgcccacgtgcccgccttggctccaagcggccattgcagacatcgatcagcgggtgcgcgcgctggcggtggacgatgccgcgccgcccacggagcactccttcgcggagcgcgccgaggagtactaccagaagcggccgcagctgctggccctcctcgccgacctccaccgccgctacctctgcctggccgaccgctactgccaccaccagcacaagcgagaagcagccctcgctgccggcgtctgcctcctccgactgcggctcgtccgacgtcgacgaccgctgctccgacgccggcagctcgctctccttccaggcccagcacgcgccgccgcgggccggactccccgccgacgaannaggagagctgctggtggcggaactggtggcccccttgggtggagcgcgacgtgctggccgacnaagcggcgcggcgccccggcggatcngccccccagatcagctgcngggacccctgtggaagtgcttgatcggaaaccctgtgctgctggcgagaccccccgcc

SEQ ID NO: 76748 - protein, 210 aa, Zea mays
  misc_feature: Ceres CLONE 1561556
  misc_feature (30)..(102): Pfam Name: KIP1 Pfam Description: KIP1-like protein
  misc_feature (155)..(155): Xaa is any aa, unknown, or other
  misc_feature (185)..(185): Xaa is any aa, unknown, or other
MQEAAAGAYPSYMEPEPEPEQTGASATVGVMGCRSPTCPPWLQAAIADIDQRVRALAVDDAAPPTEHSFAERAEEYYQKRPQLLALLADLHRRYLCLADRYCHHQHKREAALAAGVCLLRLRLVRRRRPLLRRRQLALLPGPARAAAGRTPRRRXRRAAGGGTGGPLGWSATCWPTKRRGAPADXPPRSAAGTPVEVLDRKPCAAGETPR

SEQ ID NO: 76749 - DNA, 1333 bp, Zea mays
  misc_feature: Ceres CLONE 1561557
  misc_feature: Encodes the peptide sequence at SEQ ID NO. 76750
  misc_feature (1210)..(1210): n is a, c, t, g, unknown, or other
ccggattcccttttgcgttgtttttatttctttggcgtctttgtgcgtggtacgcctccgtggatagctggaactacccgcggtggcggccgctctagaactagtggatcccccgggctgcaggaattcgtctcacccctagaaaaagattgtggctcctcacttctgcgccgccacccactacaggtaaggaagaggaggagggcaggatgtcgcaccgtaagttcgagcacccgaggcacggctccctcggcttccttcccaggaagcgctcctcccgccaccgcggcaaggtgaagtcatttcccagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcatccccccgctcgtggcatatgtgatgactcctcgtgggcctccgcacactcaactctgtttgggcccaaccatcttagccgaagaagtggaggaagaagggttctaccataatctggtgcataaagccaaaaagaaggggcttctcccaaaggttttgctcctcaaaattcttgaaaattgaatgcctcgggaaagaaaaggaaaaattctttgctggcactccctttgagtaaaaaaggaaaaaataatcttggcgttccttggttttatcccggggtgccattttgggttgcatgtacgccgcggatttcgcgggtaaaacaatgtaaggggtggtttggacaaagccgctttataccataaggggctctcctcccctcgtgataggttgatagtagattgccctaaggggtcaccaacgtgaggggggtgtgtgaaacccactcttgagagctttgacgaacactaattgtggggggagcttctgcgtggcgcgcgctatatactacactgtctttttgtttgatacgaatataggaaaggagtccacccgcgtgttttgagagagagcgtttaatcctctcctcccctcaaggttgtgatctaacactcatatctttgctgcatcccccactctcgttcgggtgtgtgctatcacgcaacatcgtcttatacggttcattttatcataaggtggtctcgtgtggcctccacctctctggtgggcggtgggaggatcgcaanctacgctcctcttctccggttagaaatgaacctatctgtggagggtgtctccacactatatgtattgctccccgcacattcatcctgctcgcgtctggaacactccggcttcatagaggggac

SEQ ID NO: 76750 - protein, 145 aa, Zea mays
  misc_feature: Ceres CLONE 1561557
MSHRKFEHPRHGSLGFLPRKRSSRHRGKVKSFPRDDPKKPCHLTAFLGYKAGMTHIVREVEKPGSKLHKKETCEAVTIIETPPLVIPPLVAYVMTPRGPPHTQLCLGPTILAEEVEEEGFYHNLVHKAKKKGLLPKVLLLKILEN

SEQ ID NO: 76751 - DNA, 989 bp, Zea mays
  misc_feature: Ceres CLONE 1561561
  misc_feature: Encodes the peptide sequence at SEQ ID NO. 76752
gagctccccgcggtggcggccgctctagaactagtggatcccccgggctgcaggaattcgtctcacccctagaaaaactccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcgcacctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggtgggtggagtcgaaacggtgggtggacttcttcaacccggactcccaggccgtggagtgggccacgccgtggtcgcgcacctctgagaacttcgccaacttcaccggcgagcagggctacccgggccggaaagttcttcgaaccggctcggcctcgccgggaccggtcaaggaaggggttctacatcccccaacgtcgaaaaagcctgaagcgggtcacagctggcccgaaaacaagtaaagccccgcatttgccctggttttgccatgtctcgcccttcttactttctaaggccgcggcaggggaaaaaaagcccgcctcgggggcgccttcggcccttagaattaggtatggcgtgcccggggaacccaaatcaaggttctctcaaatatgctaccggggttgggggggagaccttcccttagggaag

SEQ ID NO: 76752 - protein, 219 aa, Zea mays
  misc_feature: Ceres CLONE 1561561
  misc_feature (54)..(192): Pfam Name: Chloroa_b-bind Pfam Description: Chlorophyll A-B binding protein
MALAPTSAAVLKTPFLGARRALAKPAPRRALVIAAAAAAKKSWIPAIKSDAEIVNPPWLDGSLPGDFGFDPLGLGKDPAFLKWYREAHLIHGRWAMAAVLGIFVGQAWSGIPWFEAGADPSAIAPFSFGSLLGTQLLLMGWVESKRWVDFFNPDSQAVEWATPWSRTSENFANFTGEQGYPGRKVLRTGSASPGPVKEGVLHPPTSKKPEAGHSWPENK

SEQ ID NO: 76753 - DNA, 870 bp, Zea mays
  misc_feature: Ceres CLONE 1561562
  misc_feature: Encodes the peptide sequence at SEQ ID NO. 76754
ctccccgcggtggcggccgctctagaactagtggatcccccgggctgcaggaattcgtctcacccctagaaaaaccggtggcagggtaaaacagtacttgtcccgccccacgtcgcagcgccgtgtccctctcgccttcttccccaccccaccctaccctggcacccacgcgctcttcagatcagatcggcaaggccaatcccgagcagtggtgcgaaacctcgagcgctcgcgccggtgaccataacaaagaggaagccgcggtagcactggtagcggcagcagtaaggggaagatgtcgtcggcgttcagcggcgatgagaccgcccctttcttcggcttccttggcgcctccgctgcgctcgtcttctcatgcatgggggcggcgtacgggacagccaagagtgggcgtggcgtggcgtccatgggtgtcatgcgcccagagctcgtcatgaagtccatcgtgccccgtggtcatggctggtgtgcttcgaatctacggcctcatcatcgccgtcatcatcagcactgggatcaacccaaggcccaggcctactacctcctttgacggctatgccccactggccgttgggctttgcttggggtcttgcctgggcttggttcaggaatgccattggccacctttgggaaacctgggggtcaggggaaaacctctacaaccaaaaatttttttggggggggaacccccccccctattttggctaaaagcctgcccccctaggggcccaccggggggtttttcttcttttttttggggggggcattccccccgaaaaaaagggggttttttaaatagtaaacccggcccccaaaaaatttccgcggggaaagggggggggtgtttttaat

SEQ ID NO: 76754 - protein, 90 aa, Zea mays
  misc_feature: Ceres CLONE 1561562
  misc_feature: SWISSPROT Homolog: EC 3.6.3.14 H(+)-transporting two-sector ATPase
MSSAFSGDETAPFFGFLGASAALVFSCMGAAYGTAKSGRGVASMGVMRPELVMKSIVPRGHGWCASNLRPHHRRHHQHWDQPKAQAYYLL

SEQ ID NO: 76755 - DNA, 849 bp, Zea mays
  misc_feature: Ceres CLONE 1561563
  misc_feature: Encodes the peptide sequence at SEQ ID NO. 76756
  misc_feature (683)..(683): n is a, c, t, g, unknown, or other
  misc_feature (693)..(693): n is a, c, t, g, unknown, or other
tggagctccccgcggtggcggccgctctagaactagtggatcccccgggctgcttgaattcgtctcacccctagaaaaaggggagcgtggcgaccatttgcccccagcagatcttgtgaccctccctcagccgcgtcgcgtcgcatcctacgatccaaagctctctctggtcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcagcccccacctgagggccgccttcctgatgccactaagggttctggacacctggaggaagtttttggcaagcagatgggcttgagcgaatcaggacattgttgccctctctgggtggcacaccttggngaagggggcncaaaaaggggggcgggtttcgaagggggccgggaactacaaaccctttggggctttggaaactccttccttcaagggaacttctttaattggtgataaaggaggggccttcggggagctgccaaggggaaaaaagaccttgcaggagggggggctg

SEQ ID NO: 76756 - protein, 200 aa, Zea mays
  misc_feature: Ceres CLONE 1561563
  misc_feature (19)..(195): Pfam Name: peroxidase Pfam Description: Peroxidase
  misc_feature: SWISSPROT Homolog: EC 1.11.1.11 L-ascorbate peroxidase
  misc_feature (170)..(170): Xaa is any aa, unknown, or other
MAKNYPTVSAEYSEAVDKARRKLRALIAEKSCAPLMLRLAWHSAGTFDVSSRTGGPFGTMKHQSELAHGANAGLDIAVRLLEPIKEEFPILSYADFYQLAGVVAVEVTGGPEIPFHPGREDKPQPPPEGRLPDATKGSGHLEEVFGKQMGLSESGHCCPLWVAHLGEGGXKRGAGFEGGRELQTLWGFGNSFLQGNFFNW

SEQ ID NO: 76757 - DNA, 854 bp, Zea mays
  misc_feature: Ceres CLONE 1561565
tggagctccccgcggtggcggccgctctagaactagtggatcccccgggctgcaggaattcgtctcacccctagaaaaatgactgaattgcacaattatgcgacaacaacgactaaccttttattcccaagcaagttggggtaggatagagttgaaacccgacgagatgtcaccgaaaagagaacagcgagaggaaacgggaggggaaaaagcttttgagagcactaaaagggaaaaagccataatcacggttcgggcacatggatagcttttttctaagcatttctatccgaacatagctctattgggatatttcattccttcgagacccttttgattgtctcctctcatgtcaagtgagagctgtcctctacctctcttcacattattgtcccgtcttacaatccccgatgggatattctattcctccaagtccgtatagaattgcacaattatgcaatgctgcgagattaaatttgagagctgttctgctgcgtgtatatgatcagacgagacgtagcctttgttgtagacattagaccaacgtctgattaactggctctcatgtggacatgtcatacaggctctctgctacagtaatgtcttctagaagctaatgtctcacgccggatgcaaatctaagaattgcgttagcccaacggctccttggggtgcaagctcacctaggatggacttttttctccacttccaaaatttgcaacaaaggagatcttctggataggaaaccaagtgaaaggttcccaacgtgggagggtagttaaaaaacaccaaaaagctgggggttttttgggcctttttttttgaaaaaccccggggaattgaaaaaccggaat

SEQ ID NO: 76758 - DNA, 792 bp, Zea mays
  misc_feature: Ceres CLONE 1561566
  misc_feature: Encodes the peptide sequence at SEQ ID NO. 76759
ggagctccccgcggtggcggccgctctagaactagtggatcccccgggctgcaggaattcgtctcacccctagaaaaaaggcgtccaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaagatcggcttccctgccaagattaaggtgaagaaagaccacgcatcggtgccgttcgatgaccagtgctctattctagagaaggaggccgtgaacctgtccctggagaacctcaagaactaccccttcgtcaaggaaagggctgggcaaacgggtacgcctcaagctgggtcggcggcccactacaaccttcgtggtcaggggggagtttcctcccaatgggaacaattaagcaaggcccttgc

SEQ ID NO: 76759 - protein, 211 aa, Zea mays
  misc_feature: Ceres CLONE 1561566
  misc_feature (31)..(188): Pfam Name: Pro_CA Pfam Description: Carbonic anhydrase
  misc_feature: SWISSPROT Homolog: EC 4.2.1.1 Carbonate dehydratase
MDDPVERLKDGFHKFKTEVYDKKPELFEPLKAGQAPKYVVFACSDSRVCPSVTLGLQPGEAFTVRNIAAMVPAYDKTKYTGIGSAIEYAVCALKVEVLVVIGHSCCGGIRALLSLQDGAPDNFHFVENWVKIGFPAKIKVKKDHASVPFDDQCSILEKEAVNLSLENLKNYPFVKERAGQTGTPQAGSAAHYNLRGQGGVSSQWEQLSKAL

SEQ ID NO: 76760 - DNA, 832 bp, Zea mays
  misc_feature: Ceres CLONE 1561568
  misc_feature: Encodes the peptide sequence at SEQ ID NO. 76761
  misc_feature (394)..(394): n is a, c, t, g, unknown, or other
  misc_feature (415)..(415): n is a, c, t, g, unknown, or other
  misc_feature (620)..(620): n is a, c, t, g, unknown, or other
  misc_feature (764)..(764): n is a, c, t, g, unknown, or other
  misc_feature (797)..(797): n is a, c, t, g, unknown, or other
ctccccgcggtggcggccgctctagaactagtggatcccccgggctgcaggaattcgtctcacccctagaaaaaaccttccctcggtcccttccatcttctagccgccgccgccgccgccgctgcccaaaaccctacctaccctcttcttccccctcactctcctttcatctccattctaatggcggcccaacccgtccggcgaagctgctagtgcttgtatctactatcttcatcaggtacttcgccatcctactgaagtattccccgccgccgctgccatggccaccctcaaccctttcgaactcctcggcgccgacgacaacgacgacccgacgcagctgattgcggcggcggcggctgctgctcagaagccgaggcgaagaagtcccccntggcgcctgctgggaaggctngccagcctgcggcgaccaccaagttcccgaacaagcccgctcctccctcgcagacggttcgggaatgcacgcggcggtggctcatcagctcgtggaggctttggccgtggtgaacgtggccgtggcagaggtggacggggatatggccagaaccgtggcttcagtggtgacaatgggcatgagtttcagggaggttatggtggcngaggctatggggggatgtgctgtaactgggtgatctgaaggagaaagggaagagagactcgtcccccgtacgtggcggaggcagacgtgtggttacaggaaatgtgaatttgctgatgatctgagagccaccacgagaacttgnacccacagcgggactggcatgctattaaataanctgatgcccaggcgtgggactgggcctggcctgat

SEQ ID NO: 76761 - protein, 125 aa, Zea mays
  misc_feature: Ceres CLONE 1561568
  misc_feature (114)..(114): Xaa is any aa, unknown, or other
MATLNPFELLGADDNDDPTQLIAAAAAAAQKPRRRSPPWRLLGRLASLRRPPSSRTSPLLPRRRFGNARGGGSSARGGFGRGERGRGRGGRGYGQNRGFSGDNGHEFQGGYGGXGYGGMCCNWVI

SEQ ID NO: 76762 - DNA, 874 bp, Zea mays
  misc_feature: Ceres CLONE 1561570
  misc_feature: Encodes the peptide sequence at SEQ ID NO. 76763
  misc_feature (628)..(628): n is a, c, t, g, unknown, or other
  misc_feature (683)..(683): n is a, c, t, g, unknown, or other
ctccccgcggtggcggccgctctagaactagtggatcccccgggctgcaggaattcgtctcacccctagaaaaaagcctcatcaacctcgacgaaggaggaacgaacggacaggttgttgcacagaagcgacatggctttcgcgcccaaaacgtcctcctcctcctcgctgtcctcggcgttgcaggcagctcagtcgccgccgctgctcctgaggcggatgtcgtcgaccgcaacaccgagacggaggtacgacgcggccgtcgtcgtcactaccaccaccactgctagagctgcggcggctgctgtcacggttcccgccgccccgccgcaggcgccggcgccggcgccggtgccaccaaagcaagcggcggcacccgccgagaggaggagccgtccggtgtcggacaccatggcggcgctcatggccaagggcaagacggcgttcatcccgtacatcaccgccggcgacccggacctagcgacgacggccgaggcgctgcgtctgctggacggctgtgggcgccgacgtcatcgagctgggggtaccctggctcggaacccctacatcgacgggcccatcatccaaggcgtccggtggcgcggggctctggccagcggcaccaccnatgggacgcccgtgctgggaatgcctcaggggaggtgaacgcccggacctgtcgntggcccccgtgggtgcctcctcctcctactacaagccccatcatggtctccgcagctttggccgaagatgaaaaaaagcgggggggtccaacgggtcctaatagtggctggaaacctccccgtaacgtggccgccgcaccttccgcctggtgggagtgaaagccaaagacaaccaaacccctgggaacctg

SEQ ID NO: 76763 - protein, 177 aa, Zea mays
  misc_feature: Ceres CLONE 1561570
  misc_feature: SWISSPROT Homolog: EC 4.2.1.20 Tryptophan synthase
  misc_feature (166)..(166): Xaa is any aa, unknown, or other
MAFAPKTSSSSSLSSALQAAQSPPLLLRRMSSTATPRRRYDAAVVVTTTTTARAAAAAVTVPAAPPQAPAPAPVPPKQAAAPAERRSRPVSDTMAALMAKGKTAFIPYITAGDPDLATTAEALRLLDGCGRRRHRAGGTLARNPYIDGPIIQGVRWRGALASGTTXGTPVLGMPQGR

SEQ ID NO: 76764 - DNA, 840 bp, Zea mays
  misc_feature: Ceres CLONE 1561576
  misc_feature: Encodes the peptide sequence at SEQ ID NO. 76765
  misc_feature (585)..(585): n is a, c, t, g, unknown, or other
  misc_feature (603)..(603): n is a, c, t, g, unknown, or other
agctccccgcggtggcggccgctctagaactagtggatcccccgggctgcaggaattcgtctcacccctagaaaaactcatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccggcccgctccgccccggggtcgatcaggtcgagggcaccgtgaaggccgtcgtcggccccgtctacgaccgtttccacgccgtcccgctcgacctcctcaagttcatcgaccgcaagggtggtgagtccgttgaggagatagaccgccgcgtcccctcagtgggtgaaggaagccccaacctggccccgctcgctgcnaaaggaggttcgcagggncggcctggtgggcacgggcacctggccttgccaaagtcaagcatcgcccgcgccgagccaaaaggccggggagctctacccccggctaccaaactgtgggcaaaaacggcctgccccccaaaggcctgggtggggccttgaccggcttcccttctgggggccctgggtcccaaggggccgtcctccccaggggcgggaaaaatttttggccgggtcaaaatcgggggggggcgggag

SEQ ID NO: 76765 - protein, 184 aa, Zea mays
  misc_feature: Ceres CLONE 1561576
  misc_feature (29)..(175): Pfam Name: REF Pfam Description: Rubber elongation factor protein (REF)
MADSATNDAPLVASNQPTEEEVTVERAAATEEQEEERLRYLEFVQQAAAQALVLAAAAYAYAKQGAGPLRPGVDQVEGTVKAVVGPVYDRFHAVPLDLLKFIDRKGGESVEEIDRRVPSVGEGSPNLAPLAAKGGSQGRPGGHGHLALPKSSIARAEPKGRGALPPATKLWAKTACPPKAWVGP

SEQ ID NO: 76766 - DNA, 882 bp, Zea mays
  misc_feature: Ceres CLONE 1561577
  misc_feature: Encodes the peptide sequence at SEQ ID NO. 76767
ctggagctccccgcggtggcggccgctctagaactagtggatcccccgggctgcaggaattcgtctcacccctagaaaaaatgtgataatgacaaggatggtgctctcagtgacgtggagctcaatgaattccaggtccggtgttttagtgctcctctccagcctactgaaatttcaggagttaagagagttgttcaggagaagatgcctgaaggcgtaaatgaaactggccttactttgactgggttcctttttctgcatgccctatttattgaaaaaggtcgtttggaaactacatggactgtattgaggaaatttggttacgacaatgacatcaagcctagggatgatctcattgcagtgccaatttaaaagagctcctgatcaaactctggaattcaccagtggagtgggtccattttcttgagagggaatattcaacactgttttgaactttgataaaccaaggggagcttttactaccttgctgaggctgggagggaccttttttttcaaccgccaccctgaaaaaaccccaggggtctttgcgaactccattaaaaaaagaactgtggctttaaaaaaaaaagttgttttgggggggggcttgtttcccctttgaaagggggttttttcttcccaaagaggggggccttctttttttaaaccctgggctttaaaccccccaaaaaaatattttatttgccccaccccctctggaaaaaacccttgggggggtaaaccctggggggggagaatttaacattttctccgccctttttacgccccccacaaaggagaaaaaaaaaaccccgggggtttttctttaaaaaagcccccctccaccccccgaggaaaaaccttttttctcccgggggtttg

SEQ ID NO: 76767 - protein, 55 aa, Zea mays
  misc_feature: Ceres CLONE 1561577
  misc_feature (1)..(53): Pfam Name: EF_assoc_2 Pfam Description: EF hand associated
MPEGVNETGLTLTGFLFLHALFIEKGRLETTWTVLRKFGYDNDIKPRDDLIAVPI

SEQ ID NO: 76768 - DNA, 798 bp, Zea mays
  misc_feature: Ceres CLONE 1561579
  misc_feature: Translation starting site: 122
  misc_feature: SWISSPROT Homolog: EC 1.10.99.1 Plastoquinol--plastocyanin reductase
  misc_feature (635)..(635): n is a, c, t, g, unknown, or other
ctccccgcggtggcggccgctctagaactagtggatcccccgggctgcaggaattcgtctcacccctagaaaaaaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggccccgagaacaagtcatctngccatgccacggatcccagtacacaaccagggcaaagtggtccgtggaaccggcgcctctgtcgctgggcctggttcacgccaacctccaaaacgggaaggtctccttcgtcccgtgggtgggaaaccgacttcggacccggaaagaacccgtggtgaaagga

SEQ ID NO: 76769 - DNA, 891 bp, Zea mays
  misc_feature: Ceres CLONE 1561582
  misc_feature: Encodes the peptide sequence at SEQ ID NO. 76770
  misc_feature (405)..(405): n is a, c, t, g, unknown, or other
ctccccgcggtggcggccgctctagaactagtggatcccccgggctgcaggaattcgtctcacccctagaaaaaaacgatacctacgacgacctacccccctttccctgctctctccttccaactcttgtttctgcaacgccagggcgcaaccatggatcagcagcagcaagggccggcggccaggcggatggccacgctcgcctcccacctgcgccatccctccgtctctcaccctcagatggaagatgttcccctcttgaggggatccaattgccgtgcaaaaggtgcggcgccaggcttcaaagtcgcgatcttgggtgcagcaggtgggatcgggcagccacttgcgctattgatgaagatgaaccctcttgtttcggtgctccatctatacaatgtcgtncacgcacctggtgtcacagccgacatcagccacatgaacactggtgcttgtggtacgtggcttccttggccagccacagttggaaaatgccctggctgggaatggatctttgtaatatttccctgccggtgtccctcggaaaccctgggatgacaaggggatgatttgtttcacataaatggcgggataatcccgaaccctggggtgaaagaaatgcaaaaggctgcccctaaggcaaattgggaaaaggaatccagaaaaccgggtaaactctaccgttcccaattggtgggcaaaatttttcaaaaaaaactgggaacttataaccctaaacggggttttttaggggtgacccccccctctggcctaatggaaaagaaaaaaacttttttgggggggaaaggttttctggacttttacccccccaaaaagggaaaaaagttcccccccctttttgggggggcacatccggaaaattccacaaac

SEQ ID NO: 76770 - protein, 134 aa, Zea mays
  misc_feature: Ceres CLONE 1561582
  misc_feature (50)..(135): Pfam Name: Ldh_1_N Pfam Description: lactate/malate dehydrogenase, NAD binding domain
  misc_feature: SWISSPROT Homolog: EC 1.1.1.37 Malate dehydrogenase
MDQQQQGPAARRMATLASHLRHPSVSHPQMEDVPLLRGSNCRAKGAAPGFKVAILGAAGGIGQPLALLMKMNPLVSVLHLYNVVHAPGVTADISHMNTGACGTWLPWPATVGKCPGWEWIFVIFPCRCPSETLG

SEQ ID NO: 76771 - DNA, 939 bp, Zea mays
  misc_feature: Ceres CLONE 1561583
  misc_feature: Encodes the peptide sequence at SEQ ID NO. 76772
ctccccgcggtggcggccgctctagaactagtggatcccccgggctgcaggaattcgtctcacccctagaaaaaaaaacgtctgtttctccccagctccaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagccccccaattactcgatcaagaagctcaccgcgtcgctgaagaagtacgcgcccgacagcgcccccgcgctcgccatcaacgccaccatcgagaagaccaagcgccggttcgagaactacggcaaattcgggctgctgtgcggcgccaacggcctgccgcacctcatcggtcgcggcgaccagggggactgggggcgaagtcgtcaccccggggctgctcttcctctacatcgcccgcctggatcgggtgggtcggcagggagctaccccctcggcatcaggggggagaaaaaccccgccctggagggaaacctgcttggacgtggagagtggccaccgccttcctcccccggggggttcttctgtgccccgtcgcccccctaccgcggggcctcttaacgggggaccctcgtcggtcaaaaaaagggaaatcgggctactacttggcgggccgtggttcaccgggtgggcccggggcatatttttgccgtccgccaaacggtgccctctggaaataaccggggggaaaacaggagagcgctttgtgggg

SEQ ID NO: 76772 - protein, 214 aa, Zea mays
  misc_feature: Ceres CLONE 1561583
  misc_feature (42)..(192): Pfam Name: PSI_PsaF Pfam Description: Photosystem I reaction centre subunit III
MAALAAASTAAFAAKPRARLSVACSAATGDSSSVSLASSVKTFSAALALSSVLLSSAATSPPPAAADIAGLTPCKESKAFAKPPNYSIKKLTASLKKYAPDSAPALAINATIEKTKRRFENYGKFGLLCGANGLPHLIGRGDQGDWGRSRHPGAALPLHRPPGSGGSAGSYPLGIRGEKNPALEGNLLGRGEWPPPSSPGGFFCAPSPPYRGAS

SEQ ID NO: 76773 - DNA, 858 bp, Zea mays
  misc_feature: Ceres CLONE 1561584
  misc_feature: Translation starting site: 125
  misc_feature: Pfam Name: Mpv17_PMP22 Pfam Description: Mpv17 / PMP22 family
  misc_feature (523)..(523): n is a, c, t, g, unknown, or other
  misc_feature (715)..(715): n is a, c, t, g, unknown, or other
  misc_feature (829)..(829): n is a, c, t, g, unknown, or other
  misc_feature (841)..(841): n is a, c, t, g, unknown, or other
ctggagctccccgcggtggcggccgctctagaactagtggatcccccgggctgcaggaattcgtctcacccctagaaaaaggaataggtgggtcgaacttcgaaggggttcgaggacttcagctatggcatctgtgggacgtgcaggacgaggagggaaaggagatggagggaagggagaagggtcgctggctcgcagggcgtggaggcagtacctgctccagctccagcaacatcctctccgcacaaagatgatcacggcggggtgcctcgccggcgtcagtgactccgtggcgcagaagctctctgggttccagaagattgagaaacgcagactcctgctcaagatgctctttggttttgcatatggtggcccatttggacatttcttgcacaaaattttggattacatcttccaagggaagaaggataccaaaaccatagcaaagaaggtgttattggagcaagtgacatcttctccctggaataacatattgttcttgttctattatggatatgttgtntgagaggaggcctttgaaggaggtgacgaccagggtgaagaaacaatacccttctgtgcaactcagcgcttggatgttttggccgatagttggttggataaaccaccagtacatgcctttacaattccgagtgatcttccacagctttgtcgcatgttggtttgggggattttccctgaaccttcgtgcaangggctatgtctctgaagcagggcctagatggttttagaaggaacgtatagcagcaaaagctcctgccccggtgctaactaaagcagccgaaagaaggagatgctgggaagctgntatcctgccggntacaaaaaaccggtgtt

SEQ ID NO: 76774 - DNA, 938 bp, Zea mays
  misc_feature: Ceres CLONE 1561586
  misc_feature: Encodes the peptide sequence at SEQ ID NO. 76775
ggagctccccgcggtggcggccgctctagaactagtggatcccccgggctgcaggaattcgtctcacccctagaaaaaaatcgtgcaatccggccgctggccgcatgccgcgacccgaagtgataagccaccgcccaccgccgctggcatgagcccgatggcgctgctcacaccactgcccattccccttctctcgccgtattgccaacgcgtctcgtctccgtcgcttctggcggccggggcagttatcagacctctcatttgtctttccccccacaatcaccgccaccacgatgcactctacccctctgtccccaatgtgtggccacgccaccggcgccgccgcaggggcgcagttgcttccgtcgaccaggaggagtctagtgcctcggaaaccgcagtcgctcccgaggaagacctggggccaccggtatcctctgatgcggctgccgaggacggggtcgcgacttctgcccagccggcggaggcgagcccggaggacctggagaacatccgcgaaattaaaagggtcccgctgcttccagccttcgttgtctcgttttgcgtcactgggattagtgcatattgactttgcttttcgtttgcttccgttgctaggtactggagctgctgaagaagacagagacatgacttttggcgaagttagcttacatcatggatgaagacccttgagatttaggaagaaagaaacactcggggatagagatcctgatgaaattcctaggaatgatttagctgaccctttggctgaggtttacgaaggaaaatttccagaaatcgggttgcacttcagttgcttgcccaagagatggcaaaaagcccgaacatggaaaagaagctccaaaagaagagcaaactgggaaactgtctagcaaagcccacaaacctgcatcgatctgaaaagctgctaaaaactt

SEQ ID NO: 76775 - protein, 143 aa, Zea mays
  misc_feature: Ceres CLONE 1561586
MALLTPLPIPLLSPYCQRVSSPSLLAAGAVIRPLICLSPHNHRHHDALYPSVPNVWPRHRRRRRGAVASVDQEESSASETAVAPEEDLGPPVSSDAAAEDGVATSAQPAEASPEDLENIREIKRVPLLPAFVVSFCVTGISAY

SEQ ID NO: 76776 - DNA, 771 bp, Zea mays
  misc_feature: Ceres CLONE 1561587
  misc_feature: Encodes the peptide sequence at SEQ ID NO. 76777
ctccccgcggtggcggccgctctagaactagtggatcccccgggctgcaggaattcgtctcacccctagaaaaaaacctatcctacaacacacctcccgcaacagaagcatacgccgtgcccagctatctatagctagcactagcagtggtgcacactgaaatggacagcgccagcagcctcgtggacgacaccagcagcggtggcgggcggcggcggccggcggcgcgtccacggacaagctaagggctttggccgtcttcgccgccgcctcggggacgccgctggagcgcatgggcagcggcgccagcgcggtcgtggacgcggccgagccgggcgccgaggcggactccggctccggtgccgccgcggtgagcgttggcgggaagctgccgtcgtcaaggtacaagggcgtggtgccgcagcccaacgggcggtggggcgcgcagatctacgagcgccaccagcgcgtgtggctcggcaccttcgcgggcgaggccgacgcggcgctgcgcctacgacgtcgcgggcgcagcggttccgcggcccgcgacgcggtcaccaacttccgcccggtcgcggacgccgtacccggacgcggccgcccgagctccgggttcctggcgtcccgctcccaaggccgaaaggtcgtcgaactgcttccgaaaggaccaataccttcgaaaaagtctcgcgcaaaaaaaagggccgccctttcccccgccccgtttccggggggccaaccgccctctgtgccgggggcaaaaaaacc

SEQ ID NO: 76777 - protein, 159 aa, Zea mays
  misc_feature: Ceres CLONE 1561587
MGSGASAVVDAAEPGAEADSGSGAAAVSVGGKLPSSRYKGVVPQPNGRWGAQIYERHQRVWLGTFAGEADAALRLRRRGRSGSAARDAVTNFRPVADAVPGRGRPSSGFLASRSQGRKVVELLPKGPIPSKKSRAKKRAALSPAPFPGGQPPSVPGAKK

SEQ ID NO: 76778 - DNA, 884 bp, Zea mays
  misc_feature: Ceres CLONE 1561588
  misc_feature: Pfam Name: AA_kinase Pfam Description: Amino acid kinase family
  misc_feature: SWISSPROT Homolog: EC 2.7.2.4 Aspartate kinase
acccgcggtggcggccgctctagaactagtggatcccccgggctgcaggaattcgtctcacccctagaaaaaagtaaaagctcggcagtatgatgcatttgatcttggctttataactaccgatgatttcacaaatgcggatattctggaagcaacttatcctgctgttgcaaggaggctacatgtggaatggattaatgatcctgctatacctatagtcactggctttcttggcaagggatggagatctggtgcaataactaccttgggcaggggtggaagcgacttgacagctacaaccattggcaaagccttgggattaagagaaattcaggtttggaaagatgttgatggtgttttaacatgtgacccaaatatccatcctaaggcaaaacctgtgccatacttgacatttgatgaggcagctgaacttgcctattttggagcgcaggttttgcatccacaatccatgcggccagcttgagaaagcgatgtaccctgtgaggggttaagaaatttttttaaaccgtcgaggccccctggtacccctttttccctaaaaccagaaagattttaagttaaaaaccggtttttgaccaaaccattggtttttgaaaaccccaatttttcccaaggcgttggaaaataagccccgccccccacccatggttttgggccacaataaggggttttttccaacccaaagggggtttttttccgaaaattttgaaaaaaagatgggggggaaccccccgcgttgaaaaatgagggggcgcccccccccgggaaagagaccgccccaaatttccttttaacaaccagggggcgcccccccctcgcaaaaacatataggggggggatgtgttaatattttgtgctacccc

SEQ ID NO: 76779 - DNA, 967 bp, Zea mays
  misc_feature: Ceres CLONE 1561589
  misc_feature: Encodes the peptide sequence at SEQ ID NO. 76780
acccgcggtggcggccgctctagaactagtggatcccccgggctgcaggaattcgtctcacccctagaaaaaactcgccgtctgccttctgcgcctccatttcggcctctgtcccttgcaagttcaatctctacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgttgagagaggtatcaccattgatattgctcttggtggagtttgagaccaccaagtactactgcacggtcattgatgccccctggacacccgtgacttcatcaagaacattgatcactggtacctcccaaggctgacctgtgctgtcctttatcattgactccacccactgggtggttttggaagcttgtatcctccaaggatggggcagaacccgtgaacatgcttcttctttgcggtcaccccttggaagtgaaacccaatgaatttgctgcctgcaacaagaatgggatgccaacccctccccaaatactcccaaagcacgttaatgaagagatttgttgaaagaaaatctcatcctaccctcaagaaaagtttgggtacaaccctgaataggattggctcttgttccccatttctggggtttttaaggggacaacatgatttgaagggccccccaaccctgactgggtaaaaagccccaaccctgcttgtaggtcctgaacaaataacccaagcccaaaggctttaaaaaaagcccgtggtcggccccttcagaatgggtacaaaattggtgggttgggaacgttcaccgttgggccctgtggagaacgggtcatctaaccc

SEQ ID NO: 76780 - protein, 67 aa, Zea mays
  misc_feature: Ceres CLONE 1561589
MGKEKSHINIVVIGHVDSGKSTTTGHLIYKLGGIDKRVIERFEKEAAEMNKRSFKYAWVLDKLKAER

SEQ ID NO: 76781 - DNA, 875 bp, Zea mays
  misc_feature: Ceres CLONE 1561590
  misc_feature: Encodes the peptide sequence at SEQ ID NO. 76782
  misc_feature (391)..(391): n is a, c, t, g, unknown, or other
  misc_feature (393)..(393): n is a, c, t, g, unknown, or other
ctccccgcggtggcggccgctctagaactagtggatcccccgggctgcaggaattcgtctcacccctagaaaaagtaccagaacaccaaaagccatctgatctccactcctgcgaagagatctagcacatcgccacatccacacacacttccagctcctccaaatatttcgcgccacttgcgggctctgacggtttagctccactccagccatgagctcccgaatggccggagcagcgctcctgcgccacctaggcccccgcctcttcgcggccgagccggtgaccgggctcgcggcgaggggcgtcatgcccgcggccgcgaggattctccccgcacggatgtccagcacggccgcggaggccgccaaagaagctgccgcgccacaacancnccaaaagcccgagggcgcggccgcggcgccggaggggcaggacaaaaaaggccgttcgtcagctactgggggaatcgagcccccaaaagctcttgaaagaaggaaccgccccgaaatggaagggggggtctgccttcagggccaggggaacaccgtaacgaagggggaaaccctcgattccaacttgaaaaaaagccctccctaaaccccaaaagggccttccccgaaaaaaaacgggggccaacggggggggggaaaaaaaccgcggggggggggcccaaaagagggtttttttttttaagcgcggggaaacccaaaccacaacgttctttttttttataaaaaaaaggggggggccgcccccccccggaaagagagtgggggggggggaaaataattattccacacgggtagttatctgagcggccccatctttttaaaaaaaacaacgagaggggggggtaatctcaccaccccccccc

SEQ ID NO: 76782 - protein, 128 aa, Zea mays
  misc_feature: Ceres CLONE 1561590
  misc_feature (60)..(60): Xaa is any aa, unknown, or other
  misc_feature (61)..(61): Xaa is any aa, unknown, or other
MSSRMAGAALLRHLGPRLFAAEPVTGLAARGVMPAAARILPARMSSTAAEAAKEAAAPQXXQKPEGAAAAPEGQDKKGRSSATGGIEPPKALERRNRPEMEGGVCLQGQGNTVTKGETLDSNLKKSPP

SEQ ID NO: 76783 - DNA, 941 bp, Zea mays
  misc_feature: Ceres CLONE 1561594
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (603)..(603): n is a, c, t, g, unknown, or other
  misc_feature (736)..(736): n is a, c, t, g, unknown, or other
ctccccgcggtggcggccgctctagaactagtggatcccccgggctgcaggaattcgtctcacccctagaaaagcgtcagggcctcttgatcatcagtcgccagaggagctgttgatcgaggtgagtgaggttgaaaaacaggcggcggacaaaggcaccatcgtcatggacggcggatattctcgggggccgcgatcagcgctacagcggcgggtactacggcggcggtggcatcgccacgccggggtacctccggccgtcccttacgggatgtcccaggtaaacatcagggcaacgggggggggggggggcttccccccctccaaccgtgaaagtgtactgccacgccaaccccactacccccttaaggtcccctacgggaaaggggggtttgggccccgcaaaccccccggggaaattcccccccttggttaaaggaattgggggggaaccccacctcccgggccaagaaaggtttccccggggtttcccccttgggaaaaaggggacccgggagggccctcaacccctcctggggggatcnnnnttcccccccctggggggcctgggggcccccaaaaaacccgaatttttttttgtgnaaaaaaatggccctttttttgaaagaaaaaaacccccaccctctggaaaagtttttctcccgggggttcccccgggtgtaaaaaaaaattcccccacattttttggccccccccccggaaaaaaaggggtttngggggggtccctttaaaggccccacaactttgtttcccttaaaaaggggggggggggacacccccccccgggaaaaaaacccccctcctttgtccccgggtttttttattttttgccccccccctttggggcggggggggtcccttttttgaaaaaaaagagggtttttttcccccggggctttttttttttccccccatttatt

SEQ ID NO: 76784 - DNA, 760 bp, Zea mays
  misc_feature: Ceres CLONE 1561599
  misc_feature: Encodes the peptide sequence at SEQ ID NO. 76785
  misc_feature (46)..(46): n is a, c, t, g, unknown, or other
  misc_feature (55)..(55): n is a, c, t, g, unknown, or other
  misc_feature (474)..(474): n is a, c, t, g, unknown, or other
ggagctccccgcggtggcggccgctctagaactagtggatcccccngggctgcanggaattcgtctcacccctagaaaaatcgccgcaacgaattcccggtctccaaccagccggccagccaccgcagacgacccctagttccgcgtccccgacccgaaccctcgagttcgcacgggctccggccagattcgcgcggtctaagcttcgaatcggcgcatggaggcagcagtagccgcggcactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaggcgaagcagtgtggtcagggcctccctggtcccccctcgagtctctgcccacgtcctcgtcgatggcgccgctcaggatggaatcgcccngcgggcagctactctcccagatcttcaaacgcacccgcacctactgcctgccgccgccgaagaacaactcgagctggtccagaacgaccgcgggggcaaaaagggtaaggttatggagacgcttcctgggcaccaacttggctccaaaaagggggggacctctttgggtgttaaggggggattggtctaggttaaggggaaaggaacggggggaagatttttgggggaaaaaaccccttgggccccggggggtttaggaaaaatttttttttaaaaaccgcgcttt

SEQ ID NO: 76785 - protein, 148 aa, Zea mays
  misc_feature: Ceres CLONE 1561599
  misc_feature (86)..(86): Xaa is any aa, unknown, or other
MEAAVAAALKSPTAARPSWRPAAPGATSLPFDRRRSFAFGSIKGLGRQQLTSRTRRRSSVVRASLVPPRVSAHVLVDGAAQDGIAXRAATLPDLQTHPHLLPAAAEEQLELVQNDRGGKKGKVMETLPGHQLGSKKGGTSLGVKGGLV

SEQ ID NO: 76786 - DNA, 828 bp, Zea mays
  misc_feature: Ceres CLONE 1561602
  misc_feature: Translation starting site: 153
  misc_feature: SWISSPROT Homolog: EC 1.10.99.1 Plastoquinol--plastocyanin reductase
  misc_feature (635)..(635): n is a, c, t, g, unknown, or other
tggagctccccgcggtggcggccgctctagaactagtggatcccccgggctgcaggaattcgtctcacccctagaaaaaaagcctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacgggtggaagcgtggctcaacacgcacggtcccaacgaccgcacgctcgcgcaggggcttcaagggtgaccccacgtacctggtggtgggagcaggaacaaacgctggccacctacgggatcaacggcggggtgcactcacctcggctgccntcgggccctgggaacggcccccaaaaaaaaagtccatctggcccttggcccggattccccgtacaaaacccaggggaaagggtgggcccgggaaaccgggccccctttttccgggcccctggtttcacccccaaattttaaaaaaaggaagaggcccctttctctcccccggggggggggacccaaccttcct

SEQ ID NO: 76787 - DNA, 972 bp, Zea mays
  misc_feature: Ceres CLONE 1561603
  misc_feature: Encodes the peptide sequence at SEQ ID NO. 76788
ctccccgcggtggcggccgctctagaactagtggatcccccgggctgcaggaattcgtctcacccctagaaaaaaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacaactatggcgttgacaagtatgacattggaacgggctttgggcatttcgcaattgctaatgatgatgtgtacaagttagctgagaatatcaaatccaagggtggtaagatcacccgcgaacctggtcctgtcaagggaggatccactgttattgccttcgcacaggattctgatggctacatgtttgagcttatccagaagggctgacacacctgtagcctctttgccaggtcatgccttcgtgtggtggaaccttgagcggttctatcaagtttttatagaaggccctaggggatgagcctcctaaagaagaaagatgtccctgattacagttttcccattgccatggtggggccttgcttgaagaagacaaagacactgttttggaacctgacgttcaactttggaagccccgaatacccgcaagggcaatgccaatgcctccgggttgccttgggcccccaatgtattggtacaaaacacccaagagcggttgatcctggccaaccatgaaaa

SEQ ID NO: 76788 - protein, 149 aa, Zea mays
  misc_feature: Ceres CLONE 1561603
  misc_feature (24)..(145): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
MATGSEASKAAEAVVDWHKHDSKRMLHAVYRVGDLDRTIKYYTECFGMKLLRKRDVPDEKYTNAFLGFGPENTNFAVELTYNYGVDKYDIGTGFGHFAIANDDVYKLAENIKSKGGKITREPGPVKGGSTVIAFAQDSDGYMFELIQKG

SEQ ID NO: 76789 - DNA, 845 bp, Zea mays
  misc_feature: Ceres CLONE 1561604
  misc_feature: Encodes the peptide sequence at SEQ ID NO. 76790
  misc_feature (284)..(284): n is a, c, t, g, unknown, or other
ggagctccccgcggtggcggccgctctagaactagtggatcccccgggctgcaggaattcgtctcacccctagaaaaactccctttctcttctccccttgtgtcgcgctcgcgcatctgaagcaagggggggaagggccaagggggatcggtcttgttctcggagagggttgagctgcttgacggttttgactcggatcatggtgtgcagctctatcagatagagagctgacgtgaggtgtgagacgcggatcgtggagtactactcagtaggagatcaaaagnaagaggtggggaaaagggggaaaaaaagcgatagccgggggaggatgggtgcttgtgcttgcgctgggggatctgcacatcccgcaccgggcgcccgacctccccgccaaattcaagtccatgctcgtgcccggcaagatccaacacatcatctgcactggcaatctctgcatcaaggaagtccatgactacctgaaaagcctttgccctgatctccatattaccagaggtgaacatgatgaggatgctcgatacccagagactaagacacttacaattggtcagtttaagcttgggctgtgccatggccatcaggttggtccatgggggcgacctggactccctggcgatgctccagcggccactggacgtggacatccctggtgaccggggcaccgcccccattccagggcctttaaccccaagggaagcctgggtgatcaaacctgggtttgccccggggcgccttaaagcaacatttcttttaaaacgtgaaccccagcttttggcctgatgggaaaaccaacgggctccccggggggggggggtaaccccccccct

SEQ ID NO: 76790 - protein, 88 aa, Zea mays
  misc_feature: Ceres CLONE 1561604
MLVPGKIQHIICTGNLCIKEVHDYLKSLCPDLHITRGEHDEDARYPETKTLTIGQFKLGLCHGHQVGPWGRPGLPGDAPAATGRGHPW

SEQ ID NO: 76791 - DNA, 764 bp, Zea mays
  misc_feature: Ceres CLONE 1561607
  misc_feature: Translation starting site: 99
  misc_feature: SWISSPROT Homolog: EC 3.4.16.6 Carboxypeptidase D
  misc_feature (242)..(242): n is a, c, t, g, unknown, or other
  misc_feature (262)..(262): n is a, c, t, g, unknown, or other
  misc_feature (438)..(438): n is a, c, t, g, unknown, or other
  misc_feature (495)..(495): n is a, c, t, g, unknown, or other
ctcccgcggtggcggccgctctagactagtggatcccccgggctgcaggaattcgtctcacccctagaaaaaacagacagatagatagattgttggctatggcgtcgtcgagggggcctctcgccgcgctgctactgctggccgcctgcgccgccttcttccctgccgccggagccgccggcacgccggacgggtcggaggagtggggctacgtggaagtccggcccaaggcgcacatgttnctggtggctgtaccacagcnccgcagcgcgtggacaacggcaagacgccatggccgacagtgctgtggctacagggagggccgggcgcgtccggcgtcgggtacggcaacttcatggagatcgggccgctggacgagaagcttaagcccccgcgcaccacatggctcgccaaggccgacctcctcttcgtgggacnacccggttggcacggggttcagctacgtggacggcggcgactagagcctgatggcgncacacggacgccgaggcggcgcgcgacctcgtcacgctgctctgcgcgctgtaccgcgacagcccgcggctccgtgccagcccgctctacatccgtcgccgaatcctacgggcggcaagtttccggtcaccacggggctcgcggcgcctcagggcgtcaaccaagggccgcctcggggtcacccttcgcggggtcgccctcggggaaagctgggatctcccccctcgacttcgggttttccctgggggcccttttcttttcccgggggc

SEQ ID NO: 76792 - DNA, 916 bp, Zea mays
  misc_feature: Ceres CLONE 1561608
  misc_feature: Encodes the peptide sequence at SEQ ID NO. 76793
  misc_feature (916)..(916): n is a, c, t, g, unknown, or other
ggagctccccgcggtggcggccgctctagaactagtggatcccccgggctgcaggaattcgtctcacccctagaaaaaaattcgcttctctgtcaacttcacttcctcgtcgacgcctccggcccaccaaccatgccggcggctgcggcggcgcagaggctcctcgcggcgagcacgaaaatcatcggcgttgggcgcaactacatagcccactccaaggagctcggcaatccggtccccaaggagcccgtcctgttcctgaagccgacctcgtcgtttctccacgctggtgtggccaccgccgccgttgagatcccggagccgctcgagtcgctacaccacgaggtcgagctcgccgtcgtcatttcccggcgcctcctgtcgccgccgtccaccaccgcggcacgctcggcggggccgcggccagttggccgcttgaggcctgttttccagccgggggggggggcggtccccctaacctaagggggggggtcccccggggtaacgggccaaccgaatggaagtgggaaccggccccagggttcccccttggggtccaaaggggttctgccccccttggaagaaaaagaaatgaaacaggggccccttaagggaaaaaaattttgaaaaaaaaattttggggggggaatttggaaaaaaaattttttcctaggaaaacgggcggggcccaaattggggtacccaaatttctttttccaaaaaaggggggggaaaaccccgggtttaaaaaaaaatatatccccgttttgtgggggtaaaaagagaacctctcgttttacaacggggggagggggggcgcttccccccgttatgccgcgggtttttgcgcggcgggggtggccccacaaaaaaaaaaaaagaaggggggagtaaaaaatagagggggagcctcacn

SEQ ID NO: 76793 - protein, 116 aa, Zea mays
  misc_feature: Ceres CLONE 1561608
MPAAAAAQRLLAASTKIIGVGRNYIAHSKELGNPVPKEPVLFLKPTSSFLHAGVATAAVEIPEPLESLHHEVELAVVISRRLLSPPSTTAARSAGPRPVGRLRPVFQPGGGAVPLT

SEQ ID NO: 76794 - DNA, 937 bp, Zea mays
  misc_feature: Ceres CLONE 1561609
  misc_feature: Encodes the peptide sequence at SEQ ID NO. 76795
  misc_feature (773)..(773): n is a, c, t, g, unknown, or other
  misc_feature (883)..(883): n is a, c, t, g, unknown, or other
acccgcggtggcggccgctctagaactagtggatcccccgggctgcaggaattcgtctcacccctagaaaaaacacgctcgcgattcaacaaagacgtacgtacatgcacaaaactagagcgagctgtgtgtgtgtgtgttcgtcatttcctcgatcatggcgaaggcgcaggcgcaggtggcggcgaggttcatgatggaggcgccgccgccgcaggtggtgtcggtcatgcggcggaggaaggcgccgaggagcctgagcaccatcgccgaggacgacagggagatgctggcgccgtgcgggtcaccgtcggaccacggccacgtacatacacataactagagcgagtagagataccgtctcttactgtgtgtgtagtgtgtgtgtttatcaactcctcgatgcatggcgaaggcgcaggcgcaggtggcggcgaggttcacgacggaggtggcgccgccgcaggtggtgtcggtcatgcgacgaaggaaggggccgaggagcctggacaccatcgccgaggacgacagggagcagcagctggcgtgcgggtcgccatcggaccacggcctcgcgacgggcgtggtcgtcgctccagaggataccgacgccaccgcagccgccgcgggagcgcgcaggtgggtccgtgacgagggacctcagcaagaacttcttggactcccacggctggcagcagccagcgggctgggaaggtggacacatgctaggccacccggcgagccgtgcatgcgctggaagctcacaaggtcgnaagctgttttgagaagggagaagagaaaatctagctagctgcagtgagcttgttcgggagaaatatatttgtaccacttccacacgtgcgctcatgcatgaatacttccntccgttttttattttacacattttagtaaaaaatgactaagcgctgattaattt

SEQ ID NO: 76795 - protein, 134 aa, Zea mays
  misc_feature: Ceres CLONE 1561609
  misc_feature (123)..(123): Xaa is any aa, unknown, or other
MAKAQAQVAARFTTEVAPPQVVSVMRRRKGPRSLDTIAEDDREQQLACGSPSDHGLATGVVVAPEDTDATAAAAGARRWVRDEGPQQELLGLPRLAAASGLGRWTHARPPGEPCMRWKLTRSXAVLRREKRKSS

SEQ ID NO: 76796 - DNA, 941 bp, Zea mays
  misc_feature: Ceres CLONE 1561610
  misc_feature: Encodes the peptide sequence at SEQ ID NO. 76797
aaagctggagctccccgcggtggcggccgcttcagactagtggatcccccgggctgcttgcaattcgtctcacccctagaaaaagcattgtggctcctcacttctgcgccgccacccactacaggtaaggaagaggaggagggcaggatgtcgcaccgtaagttcgagcacccgaggcacggctccctcggcttccttcccaggaagcgctcctcccgccaccgcggcaaggtgaagtcatttcccagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagcgaagaagtgaggagaaggttctacaagaactggtgcaagagcaagaagaaggctttcacaaagtatgctctcaaatatgaaaatgatgctggcaagaaggaaattcagctgcagcttgagaagatgaagaaatatgcttctgttatcccggtcattgctcatacccagattaggaagatgaagggtttgaagcagaagaaggctcacctgatggagattcaggtcatggggggtcccattgctgaccaggtggactacggctattaattctttggaaaaaaaagcccctgttgtagccggcctcccgaatggttgagatgtttgactccctgtgggcggcccaagggtaaagggtttgaggggggggtcaccctaggggggtggcaccctgtcttccccgcatatacccaaagggagggtcccgcaagggtgccttggcttcggctaatagcactacagta

SEQ ID NO: 76797 - protein, 199 aa, Zea mays
  misc_feature: Ceres CLONE 1561610
  misc_feature (50)..(197): Pfam Name: Ribosomal_L3 Pfam Description: Ribosomal protein L3
MSHRKFEHPRHGSLGFLPRKRSSRHRGKVKSFPRDDPKKPCHLTAFLGYKAGMTHIVREVEKPGSKLHKKETCEAVTIIETPPLVIVGLVAYVKTPRGLRTLNSVWAQHLSEEVRRRFYKNWCKSKKKAFTKYALKYENDAGKKEIQLQLEKMKKYASVIPVIAHTQIRKMKGLKQKKAHLMEIQVMGGPIADQVDYGY

SEQ ID NO: 76798 - DNA, 834 bp, Zea mays
  misc_feature: Ceres CLONE 1561611
  misc_feature: SWISSPROT Homolog: EC 1.11.1.7 Peroxidase
  misc_feature (728)..(728): n is a, c, t, g, unknown, or other
ctccccgcggtggcggccgctctagaactagtggatcccccgggctgcaggaattcgtctcacccctagaaaaagcaagggtttcccagccaaagaaccagcatcctggttgtgaaaatggggggtgtgcgtagctacttcttcatcatcgccgccgcggtcgttgccgtcgtcctcgcgcttctcccggccggcgccacaggtgccggcctcaaggtcggcttctacagcaagacatgcccgtcggcggagtccctggtgcagcaggcggtggctgccgccttcaagaacaacagcggcatcgccgccggcctcatccgcctgcacttccatgactgcttcgtcaggggctgcgacggctcggtgctgatcgactcgacggcgaaacacacggcggagaaaggacgcggtcccgaacaaaccgagcttgcgggggcttcgaggtcatcgacgccgccaagaagggcggtgggagggcacggtgccccaaggacggtgttcctggcgcccaaaatccttgggcgtttcccgggggcggggaaaaaaaaatcccgccttggggggggaaaaaaaccctggaacttaaaaagggtccccccccccggggggggcgcggccccaaacacggggggggggggggttccctccgggggaaaaaaaggaaccccccaacaaaaaaaaaacaaacaccccccccgcgcgggggggtttttttttaccccggaccngggcccaaaaaaaaaaattttttggggggtgtattttttttttttcgtgaaaaaaaaaaaaaaaaacccccccccccccccccaaaaaaaaaaaaaaaaggtgtgg

SEQ ID NO: 76799 - DNA, 915 bp, Zea mays
  misc_feature: Ceres CLONE 1561612
  misc_feature: Translation starting site: 137
  misc_feature (784)..(784): n is a, c, t, g, unknown, or other
ctccccgcggtggcggccgctctagaactagtggatcccccgggctgcaggaattcgtctcacccctagaaaaagattgtggctcctcacttctgcgccgccacccactacaggtaaggaagaggaggagggcaggatgtcgcaccgtaagttcgagcacccgaggcacggctccctcggcttccttcccaggaagcgctcctcccgccaccgcggcaaggtgaagtcatttcccagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagcgaagaagtgaggagaaggttctacaagaactggtgcaagagcaagaagaaggctttcacaaagtatgctctcaaatatgaaaatgatgctggcaagaaggaaattcagctgcagcttgagaagatgaagaaatatgcttctgttatccgtgtcattgctcatacccagattaggaagatgaagggcttgaagcagaagaaggctcacctgatggagattcatgtcaatggtggtaccattgctgacaaagtggactacagctatgaatttttgagaaagaggtccctgttgatgctgtcttccagaaggatgagnatgatgacatcattggtgtgacaaaggtaatggttatgtaggtgtggtcacctcgttggggtgtcacccgccttcccgcaagaccaaaggggtctcgcaaggtgccctgtatcgtgcatgcatccggctag

SEQ ID NO: 76800 - DNA, 946 bp, Zea mays
  misc_feature: Ceres CLONE 1561614
  misc_feature: Encodes the peptide sequence at SEQ ID NO. 76801
  misc_feature (770)..(770): n is a, c, t, g, unknown, or other
  misc_feature (840)..(840): n is a, c, t, g, unknown, or other
  misc_feature (923)..(923): n is a, c, t, g, unknown, or other
tggagctccccgcggtggcggccgctctagaactagtggatcccccgggctgcaggaattcgtctcacccctagaaaaacgcgtctccagtgggctctgctcctcctcttcaatcccactcccgccccgatggccacctcttccgtgctcccgctccacctcctgtcctgcgcgcgccgggccagcaccgccgcgcgcgcctccgcggccccggcggtggcggcgacgaccgcgcagtccctggaggagtcgttcggacggaagggcctgcggttcgtggccgacccggccggcgggcccctcgccgcggagctcagcgtgcggaacggcagctcgctgcatctccgcctcggcgacggcctcgtcacgtcctaccggcccaaggtgtactggaaggacgacgggtgccgggaggtgctgcacaccgtggcgggcaagggcggcgtcggcctcgtcctcaacgacgcgacgtcctcgtccgcccagccgtcgctggtcgacggcgccgagtgggccgtcagggacgccgactccgactcctacgacgccgtgcaggtggagctcgggtgcaccatagggaagctggacatctcgtacgtggtgacgctgtactcgctgagcatggcgacggcggtgatcgtccggaacacgggcagcaagccggtggcgctgacaggcgcggtgctgagccacatcaagttcgacaagcgatgcggcacggccgtggaaggccttcgtggctgcccctactgctccctaccgccgccggncgcagccttcagcctcctgtccccggccgaagccatgaaagcggaggaccccgctgggtcggcggcgccnaagaactgcgccagggcgtctggaccgtcgagtaggactctacacacgctcaaaaagaagtgagccgggtgtaccccccgccnccgggaggaaagaataatcccgc

SEQ ID NO: 76801 - protein, 257 aa, Zea mays
  misc_feature: Ceres CLONE 1561614
  misc_feature (214)..(214): Xaa is any aa, unknown, or other
MATSSVLPLHLLSCARRASTAARASAAPAVAATTAQSLEESFGRKGLRFVADPAGGPLAAELSVRNGSSLHLRLGDGLVTSYRPKVYWKDDGCREVLHTVAGKGGVGLVLNDATSSSAQPSLVDGAEWAVRDADSDSYDAVQVELGCTIGKLDISYVVTLYSLSMATAVIVRNTGSKPVALTGAVLSHIKFDKRCGTAVEGLRGCPYCSLPPPXAAFSLLSPAEAMKAEDPAGSAAPKNCARASGPSSRTLHTLKKK

SEQ ID NO: 76802 - DNA, 970 bp, Zea mays
  misc_feature: Ceres CLONE 1561615
  misc_feature (57)..(57): n is a, c, t, g, unknown, or other
  misc_feature (68)..(68): n is a, c, t, g, unknown, or other
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (877)..(877): n is a, c, t, g, unknown, or other
gagcgcatgttaattaatatgcgtatgtttggttttttgttgtggcgtgggaggggnatattcatccnaaattccccncnnnnnnnnnaagaannnnnnaaaaactggagctccccgcggtggcggccgctctagaactagtggatcccccgggctgcaggaattcgtctcacccctagaaaaaggccacttacctgcagtcaccactcccaagccagtacccacagtcctacgagcagtcgcacgcaagtgtcaagagacgaaacggtcgacatggctcgcacgcaatctgccgtagcgggtcgccgtggtggccgcggtgcttctgcctgcaccggcggcgaaccaccttcggaggccccccttccccctggggggccggggtgaactttccccccatttggggccccctggccttttccctaaaacccccccgggggaaaggggggttccggggcccccctcccccggtttccttgggttgaaaagcgggccctttccgggaaaaaccccttaagaaaagggccgccccccccccaaaaaacccccccccccccccccaaaaaaaaaaggggggccccccccccccccccccccccaaaaaaaaatttttttttcttttataaaaaaaaaaaacacccccccccccccccccggggaggggggggggggtttttttataaaaaaagggggggggctctttcttaaaaataaaaaaacccccgcggcggggaaaaaaaaaaaaaacccccccccccccccgcaaaaaaaaaaagaacacccccccccccctccccctcccaaaaaaaaaagaaagggggggagggggtggtgggtataataaataaaaaaaaaaaaaatcccccccccccgtcgnggaaaaaatgattgtattgtttgtgtggggaggaggggttctttttccttttttccctcgaagaaacataaaagtgtgtgtgttctctctcac

SEQ ID NO: 76803 - DNA, 957 bp, Zea mays
  misc_feature: Ceres CLONE 1561616
  misc_feature: Translation starting site: 122
ctccccgcggtggcggccgctctagaactagtggatcccccgggctgcaggaattcgtctcacccctagaaaaaaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggtatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgttgggctgacatcatcaagcccggaagcgtcaacaccgatcccatcttgccccagcacaagctcaccggcaccgacgtcgggtaccctggtgggctggtgggttgaccccgtcggctggggcttccgctcgccggataagaaccaaggactgcgcaccaaggagatcaagaaacggaccctccccctggtcgccgtcctgggcgcttggtttccaggccaagtaacggggcaccggccccattgaaaactcttttccccactcggctgaccctgtggccagcccccgtgttgccagggccttcacccccaaatggaggaaccctgaagtaaat

SEQ ID NO: 76804 - DNA, 939 bp, Zea mays
  misc_feature: Ceres CLONE 1561618
  misc_feature: Encodes the peptide sequence at SEQ ID NO. 76805
ctccccgcggtggcggccgctctagaactagtggatcccccgggctgcaggaattcgtctcacccctagaaaaaaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggtatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgttgggctgacatcatcaagcccggaagcgtcaacaccgatcccatcttccccagcaacaagctcaccggcaccgacgtcgggtaccctggtggcctgtggtttgacccgctcggctggagctccggctcgccggagaagataatggagctgcgcacctaggagatcaagaacggacgcctcgccatgctcgccgtcatgggcgcttggttcagggccaagtaaccgggaccgggcccattcgataacctctttggccaacttcggcggaccttggccacgccaccattcttccggggcttcaccccaaatggaga

SEQ ID NO: 76805 - protein, 220 aa, Zea mays
  misc_feature: Ceres CLONE 1561618
  misc_feature (73)..(221): Pfam Name: Chloroa_b-bind Pfam Description: Chlorophyll A-B binding protein
MALVSASSSSTTAVAALPRNGQQRASSSLFSSSSSSSFLVGKTLLRQAEAARPSFAVRAAADSDRPIWFPGSTPPPWLDGSLPGDFGFDPWGLGSDPESLRWNVQAELVHCRWAMLGAAGIFIPEFLTKIGVLNTPFWYTAGEQQYFTDTTTLFIIELILIGWAEGRRWADIIKPGSVNTDPIFPSNKLTGTDVGYPGGLWFDPLGWSSGSPEKIMELRT

SEQ ID NO: 76806 - DNA, 912 bp, Zea mays
  misc_feature: Ceres CLONE 1561619
  misc_feature: Encodes the peptide sequence at SEQ ID NO. 76807
  misc_feature (725)..(725): n is a, c, t, g, unknown, or other
  misc_feature (899)..(899): n is a, c, t, g, unknown, or other
ctccccgcggtggcggccgctctagaactagtggatcccccgggctgcaggaattcgtctcacccctagaaaaaaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggtatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgttgggctgacatcatcaagcccggaagcgtcaacaccgatcccatcttccccagcaacaagctcaccggcaccgacgtcgggtaccctggtgggctgtggntttgaccgctcggctggggctccggctcgccggagaagatcaggagctgcgcaccaagagatcaggaacgacgcctcgccatgctcgccgtcatgggcgcttggttcaaggccgagtacaccggaacgggcccatcggacacctctttcgccactcggcgacccgggcacgcancaatcttcaggct

SEQ ID NO: 76807 - protein, 201 aa, Zea mays
  misc_feature: Ceres CLONE 1561619
  misc_feature (73)..(203): Pfam Name: Chloroa_b-bind Pfam Description: Chlorophyll A-B binding protein
MALVSASSSSTTAVAALPRNGQQRASSSLFSSSSSSSFLVGKTLLRQAEAARPSFAVRAAADSDRPIWFPGSTPPPWLDGSLPGDFGFDPWGLGSDPESLRWNVQAELVHCRWAMLGAAGIFIPEFLTKIGVLNTPFWYTAGEQQYFTDTTTLFIIELILIGWAEGRRWADIIKPGSVNTDPIFPSNKLTGTDVGYPGGLW

SEQ ID NO: 76808 - DNA, 679 bp, Zea mays
  misc_feature: Ceres CLONE 1561620
  misc_feature: Translation starting site: 122
  misc_feature (381)..(381): n is a, c, t, g, unknown, or other
ctccccgcggtggcggccgctctagaactagtggatcccccgggctgcaggaattcgtctcacccctagaaaaaaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtggcgcgccgcggcggattccgacaggccgatctggttccccggcagcacccctccgccgtggctcgacggcagccttcccggcgacttcngctttgatccctggggcctcggatctgacccggagagcctgccggtggaacgtgcaggcgggagctggtgccactgcccggtgggcgatgctcgggcgcgggcggggtatcttcattcccggaagtcctggaaccaagattgggggtcctccaaaaacgccccttttggggaacaaccggccgggggaaacacaggaagtttctttacccggaaaaaccccccaaccccttttttaaataaagggaagcttaattcgccccattggggttgggggccccaaagggggcccccccccta

SEQ ID NO: 76809 - DNA, 1278 bp, Zea mays
  misc_feature: Ceres CLONE 1561621
  misc_feature: Encodes the peptide sequence at SEQ ID NO. 76810
  misc_feature (65)..(65): n is a, c, t, g, unknown, or other
  misc_feature (71)..(71): n is a, c, t, g, unknown, or other
  misc_feature (997)..(997): n is a, c, t, g, unknown, or other
gtttggtgggtaccattactccaatctccaacacgatcaaaacagacagaggaaaaacataattncccttntaaaaatttggactccccgcggtggcggccgctctagaatagtggatcccccgggctgcaggaattcgtctcacccctagaaaaagttatacctcctcaaggcacgttcaccacagtcctctctttccccggcaccaccaccaccacccaggctaagtggctaaccggactggaccgagtgttgaacaacactgcagtgagcgacggcaggcatggtgagccgtgaaaatttgcacctggtgctggacccgacgtctctgggcgctccgtgggccgacccgtccgccgtaaagatccaaccacaactcctcccccgcgctgggaaagtacactctcctccgtccgcggcgacgtccaagacggaggccgcacgaggtagtttcatgatgcaacgagtttaaaggggttcccccccgcgggggagaggcgttaaatctacataacgggaagggaggtgatccctaacagcggatctccaggggggaaaggtctcgtcggaggggatgtgaaactccatacaccctagatgggccccaacacccaggggggaaagccttttgcaccccggagatattaccgcggggcacgacttgcctcacagccgccccaacaagagacaacgacttcataagagtccacacacccacgccggaggggataaccaacacagtgtgttgttctcccgcctcccggcaacggaacaacgcagagagtggtacgtcccatggttgtaaatcaccaccctttgtgttgagaagggtaggtttgcgcacccactcactatctgctgaatatgcaacgctcgagtgtgattatccccaaccgaggacagaagccgaagccgccccagcactttgtatatacccaccgccttcctctaggtgtgcacagcaggatgtattgtatctatgagggatagctggcgntgtacacccgccacgccggatagacgagcacgcggagataatatctcactcatttatatgcagaaccatacatcgagcctctcctcactccgcgtaacgatagcactgatagtttgtgttctgccgatactagcccgcgctaatcaacacaacaggggtaatatcacgctcgccgcaataaatgaaagaaagaatcgtgcatatttgagagtaatctgacgaagcgcgaatctcgaggttacaccgatgatggaatcttacatccgctttaatcatcgccg

SEQ ID NO: 76810 - protein, 62 aa, Zea mays
  misc_feature: Ceres CLONE 1561621
MVSRENLHLVLDPTSLGAPWADPSAVKIQPQLLPRAGKVHSPPSAATSKTEAARGSFMMQRV

SEQ ID NO: 76811 - DNA, 1017 bp, Zea mays
  misc_feature: Ceres CLONE 1561623
  misc_feature: Encodes the peptide sequence at SEQ ID NO. 76812
aggggttgcaagtgttgccgcgctgctcgtgcacggccggcaccccccgccgatcgaggatcagtctagctactaaccagtcaggcgggcgtgcggccgatcgatctagcaacaatggtgggcgcgggcgcggcgacggacgcggccagggcgctggcggcgcgggaggtgtgcgcggcgtcggcggcgttcgcgtcctgcacgcaccaccgccgccgccggtcatccccgcgcggcccgcacttcgtcgactggtacctcgtcctctccatcggcgaggccgcgtcggaggacgccgtgcggaggcggtaccggcagctcgcgctgcagctgcacccggacaagaacaggcaccccaaggcggaggtcgcgttcaagatcgtctccgaggcgcacgcgtgcctgacggaccaggcgaggcggcgggccttcgacctggagcggcggggcagcttctgcgccgcgtgccactaccgccacgccgccaggtggtcccagccggcgtccggccaccaggcgccggcgccggcggcgtccaggagcaaggcggcgcgggaaacgatccagagccggctgtgggacgagtgccgggtcatcgacggctgcctgcgggccaacgacgccgcggcctgcgcgcgccgccgccagtcgttcccgatcttcgatccctctgacggccgtcgcttcccagactacccgcacgtccgcccgccgccgttcgagctccggcactccgaggactggcttggccgcgcggcggtggatcggcaggccctgaaccggaggtggtgcaggggcggcggcgagtcgcctgtctaccagatcaggacggtggcgacagagtgcaccgataggcgtgcatggtgaactcggcacgccatcagcaatcagcatatgagcaacagagctctctctctctctctctctctagtttttcagctcgaaaaggaaaggatgtaccgaacaatctttctagagatcagaaattctccttaggatgaaaaaaaaaaaaaaaaa

SEQ ID NO: 76812 - protein, 250 aa, Zea mays
  misc_feature: Ceres CLONE 1561623
  misc_feature (46)..(107): Pfam Name: DnaJ Pfam Description: DnaJ domain
MVGAGAATDAARALAAREVCAASAAFASCTHHRRRRSSPRGPHFVDWYLVLSIGEAASEDAVRRRYRQLALQLHPDKNRHPKAEVAFKIVSEAHACLTDQARRRAFDLERRGSFCAACHYRHAARWSQPASGHQAPAPAASRSKAARETIQSRLWDECRVIDGCLRANDAAACARRRQSFPIFDPSDGRRFPDYPHVRPPPFELRHSEDWLGRAAVDRQALNRRWCRGGGESPVYQIRTVATECTDRRAW

SEQ ID NO: 76813 - DNA, 842 bp, Zea mays
  misc_feature: Ceres CLONE 1561624
  misc_feature: Encodes the peptide sequence at SEQ ID NO. 76814
  misc_feature (724)..(724): n is a, c, t, g, unknown, or other
ctccccgcggtggcggccgctctagaactagtggatcccccgggctgcaggaattcgtctcacccctagaaaaaagacggagccgcacgtggtggaggactgccgcggcgtgctgcagctgatgagcgacggcacggtgcggcgcagcgcggagcctccggcgctgttctcggcggtggacgtctcggaagacgagtgcggcgtggagtggaaggacgtgacgtgggacccggcgcacggcctgaacgcgcgcctgtaccggccgcggcacctgggcgcggccaacgacgcgcggatccccgtggtggcctacttccacggcggcggcttctgcatcgggtccgggcggtggcccaacttccacgcctggtgcctccgcctgtgctccgagctccccgccgtggtgctctccttcgactaccgcctggcgcccgagcaccggctcccggccgcccaggaggacggcgccagggccatgtcctggctgcgctccgccgccgccggcggcggcgacccctggctcgccgacgcggccgacttcgcgcgcgtctttcgtggcgggcgactcggcgggcggcaacatcgccccccaccgtcgcggtcgggctcggcagggccggcctggggaccgggcggtccggatccgcggcgcgctcctttctgggcgccgggcatggccggcggacgcccgcacgcgcgcggaatcaagctggagtgcccgcgncgacgcggttctcacccaccgagattgtgcgacagggtacgcgccgtctgggcgctgccccgaaggcggccagcaggggacgactccggtgctccaccccgggggggggtccgcgggg

SEQ ID NO: 76814 - protein, 240 aa, Zea mays
  misc_feature: Ceres CLONE 1561624
  misc_feature (62)..(235): Pfam Name: Abhydrolase_3 Pfam Description: alpha/beta hydrolase fold
  misc_feature: SWISSPROT Homolog: EC 3.1.1.3 Triacylglycerol lipase
MSDGTVRRSAEPPALFSAVDVSEDECGVEWKDVTWDPAHGLNARLYRPRHLGAANDARIPVVAYFHGGGFCIGSGRWPNFHAWCLRLCSELPAVVLSFDYRLAPEHRLPAAQEDGARAMSWLRSAAAGGGDPWLADAADFARVFRGGRLGGRQHRPPPSRSGSAGPAWGPGGPDPRRAPFWAPGMAGGRPHARGIKLECPRRRGSHPPRLCDRVRAVWALPRRRPAGDDSGAPPRGGVRG

SEQ ID NO: 76815 - DNA, 935 bp, Zea mays
  misc_feature: Ceres CLONE 1561625
  misc_feature: Encodes the peptide sequence at SEQ ID NO. 76816
  misc_feature (377)..(377): n is a, c, t, g, unknown, or other
  misc_feature (392)..(392): n is a, c, t, g, unknown, or other
tggagctccccgcggtggcggccgctctagaactagtggatcccccgggctgcaggaattcgtctcacccctagaaaaaaaaaactgtctctcccacgtccttccgggtcctatcgctcctctccgtcgccggtggagctcatggcatcctctcatggccgccgccgccaccgccaccgccctcccgctgccgtccgggacgacgcagaggccgtctgcccagggccgcctcctcttcaccgccgcgcccgcccgctccctccgcctccgccccgccggccgccggtcggcccgctcctcgcctcgggccaccaaggctgtggtggcagcgttggctgatccctctcaggtcatgatatcaggagctccggcgtccnggcaggggcacacangtgcgaagcttcatcagaaccaaatatccaactggccgcacattctccggccgggaaaattggtttgccgggccggaaaaatccccttgcttgggctcctgaaaaaacggggaaagccggggcccaaagggaatttccattgggaaaaaaggggtccccaccctcccggccccttgaaaaaaaaaaatatgccccctttaaaaaaaggggggggaaaaggaaaaccccccttttggggaaccccgaagacccttttaaaaaaaaaaaggggtttggggcttttttttgtgggagggggggtccccccccacaaagaaaggttttttttttccgcggggcgcccttgggggcccttttttggaaaaaaaacccttctttagaaaaaatacccccggcgcccggggaaaaaaatattattttctttcctttttgggggaaaaaaagaggtgttttccccaccagaaaagaaaaaaacacccctctctctctttttttaaaaaaaaaaaaaagtgtggtgtgttttttttaaaaaaagaaaacgcg

SEQ ID NO: 76816 - protein, 205 aa, Zea mays
  misc_feature: Ceres CLONE 1561625
  misc_feature (75)..(75): Xaa is any aa, unknown, or other
  misc_feature (80)..(80): Xaa is any aa, unknown, or other
MAAAATATALPLPSGTTQRPSAQGRLLFTAAPARSLRLRPAGRRSARSSPRATKAVVAALADPSQVMISGAPASXQGHTXAKLHQNQISNWPHILRPGKLVCRAGKIPLLGLLKKRGKPGPKGNFHWEKRGPHPPGPLKKKNMPPLKKGGGKGKPPFWGTPKTLLKKKRGLGLFFVGGGVPPHKERFFFSAGRPWGPFFGKKTLL

SEQ ID NO: 76817 - DNA, 1333 bp, Zea mays
  misc_feature: Ceres CLONE 1561626
  misc_feature (1183)..(1183): n is a, c, t, g, unknown, or other
tgcgttttcgttctttttctatttccgcttttccaaacaacattgattgtgccttgtggcttattgggaaaagctgggactcccctcggtggcggccgctctatactagtggatcccccgggctgcaggaattcgtctcacccctagaaaaaatcatccattccatcatcccctttgcaagtatagtcttctctgctaaacgaagcgaagcttctagcttgtctcggaggctctcgaagacgatgggcaaggacgacatgatcgacagcggctctggcggcagctaatttctctgcctaagactacaaggacctttccccctgagccgcagatcaaagctgaggatctggggtccatggtccgcttttctcgctccatgaattggcgagtgtctccgcctggctgtgtgttcttgtccatcacaggtcgtctccgcgtatcggttcccagcatattattgtatttttctgctttcttgcgttgtgatgcggtgagaaaccgaccacactgagattgcattgttatcccccgtgacatacggcgcccgccctttatcattaagaattcccttttacggcacctgaatgtgtactcattgggggtccacctgtagaccgctcgtgaccaactttgcgatccacgtccccctctatcttgtaacggttcaccccctataagtcaacgacgaaccacaacccctgaagattcaggcctcggcacagtccacttatgggcggagtattttttgccacccgatctgctgcctctctcgagatgatgtcagtgagtactggaagtgtgaccctatcatgcaacacactctatcttaacgatacactaacgtgcgattgccataaagatctatcaaccatccttcgccactcgcgttcacactatacctacttttaattaccgccagtgatttgaatacctattctgcacctgccactaaataaattatccttcgtaccggtgcgcaaatatcgctgaggagcccgcacttccacgcctacaccgctcatcgtgtccacttctacaccctgatcgtagaggctcctcatatcttgactctgccatgacaccactgacatccacacacacctctctgttaacaactgactcgctaaatggttttgtctccgcgattccgccactattatacgtgctaccctatcctctgcgnttcatgctttgtagacaatatcatacagatcattgcacacatatcattcttatgttctacacaatttacactacttatcatcataccctacctttagtctcttgtacctttgccatatgatgtgacctcacactataattatgctttcca

SEQ ID NO: 76818 - DNA, 814 bp, Zea mays
  misc_feature: Ceres CLONE 1561635
  misc_feature: Encodes the peptide sequence at SEQ ID NO. 76819
  misc_feature (648)..(648): n is a, c, t, g, unknown, or other
ctggagctccccgcggtggcggccgctctagaactagtggatcccccgggctgcaggaattcgtctcacccctagaaaaaaaaagatatgattctacctacactcagcagagtggtgggcagcaagcatatggacatgatggctacactggttaccagacccaagggcagcagcagggctactctcagcagactggttatgatcagcagggttatggcacatctgcttatggatcagctgcaagctcgacccaggatgggtccaactatggtggtcctggaggggccagtcaggcatctccagggcagcaaacatcaaacccagctgctggaagccaacctggctataccagccaaccgcccactagtgctgcagcaacttacccacctcaaggttcagctccatctggatatggcgctccaccatcccagtctggctatggcacccaaccaccacagcaagccggatatggtcagggcgcttatgggcagccttctccacagggccagaaacctcctgcattgtcaccttatggacaggctccgcctcctggttctgctcaggctggttacgggcagtatggttacagccaaacctgcttacggtgcaccaccagcttaccctggtgcacccattggcagccaccangggctatggccagcagcagtcttatggcgatgccttaatggtagtgcaagctaggggcagccttcagcctactctactgaaagaacacctcccggtggatcccaagaacactccggttgcccctggctggggcccttgggaaaaaaactttcgaaaggtccggaaa

SEQ ID NO: 76819 - protein, 227 aa, Zea mays
  misc_feature: Ceres CLONE 1561635
  misc_feature (216)..(216): Xaa is any aa, unknown, or other
GAPRGGGRSRTSGSPGLQEFVSPLEKKRYDSTYTQQSGGQQAYGHDGYTGYQTQGQQQGYSQQTGYDQQGYGTSAYGSAASSTQDGSNYGGPGGASQASPGQQTSNPAAGSQPGYTSQPPTSAAATYPPQGSAPSGYGAPPSQSGYGTQPPQQAGYGQGAYGQPSPQGQKPPALSPYGQAPPPGSAQAGYGQYGYSQTCLRCTTSLPWCTHWQPPXAMASSSLMAMP

SEQ ID NO: 76820 - DNA, 873 bp, Zea mays
  misc_feature: Ceres CLONE 1561639
  misc_feature: Encodes the peptide sequence at SEQ ID NO. 76821
agctccccgcggtggcggccgctctagaactagtggatcccccgggctgcaggaattcgtctcacccctagaaaaacctcaactatcacaatttgttgttccaaaggatcatcttaaacatcagtgatacatctagcatatttgtgaacaattcactgaatggaaaccaaattggaaagacatttccaaatttggatgcatctttggcattcaattttgttttcgaagccgaggagaaccaaagagttagtgatttacagtccttgcagaagaagacaatggaaacaagcttgctgcttggaaatcttattgatgttttagaagaaatcaaattatctaagttggagttagtaaatcttacctccgctgcttttgttttggagtcccagacacgtaaacttggcctccacctgtctttcatgagtttcaagagtggcaagaagattgctttcatcatcgacatgacagacttgaacccgctcgtctacccttctgaaccatctgagctcattaaggtttttgaagcacatactacgctagcacaagcaagcatagacgagaccatgccttctataaagaacctgcaatctggtcgccagcaatactaaagatgtgcccgaatggattcgggctgaatcatggtaacatgaagcaccgattccctgaatggcaacctttaggaaataaacctattcgggaaatttgggggagagcgttaaaacgggtgggtttggtttttttttttccggggggctaaaaaggtttaaagggaaaaaagccccttttcgggggaaccgcaaccaattttggtctcgcaaaacctgtaaaccgcccttttttaaaccaacaaggaaaaagggggggttggggggt

SEQ ID NO: 76821 - protein, 109 aa, Zea mays
  misc_feature: Ceres CLONE 1561639
METSLLLGNLIDVLEEIKLSKLELVNLTSAAFVLESQTRKLGLHLSFMSFKSGKKIAFIIDMTDLNPLVYPSEPSELIKVFEAHTTLAQASIDETMPSIKNLQSGRQQY

SEQ ID NO: 76822 - DNA, 862 bp, Zea mays
  misc_feature: Ceres CLONE 1561640
  misc_feature: Translation starting site: 144
  misc_feature: SWISSPROT Homolog: EC 1.10.99.1 Plastoquinol--plastocyanin reductase
ctccccgcggtggcggccgctctagaactagtggatcccccgggctgcaggaattcgtctcacccctagaaatatcaggaagcctgtggacgccagtgagtgaacaccacgtcgtcttggtccgcgtctcccctgctgcggacatggcgacctccgcggtgctctggacagcggccaacccggaacagatctgcagggcatgcactgcgctgagggagccagagaaagggcttgctctggggatggggcgggagctggcaagcgaacgtgacagactcgccaggcggccagtatcatccgagccgacggcgtcccccacgtggatatgcacaagctgatgatactacccctcctgggtgcagggggggtgccaaccctgggaatggacgtgccctacggccacgttttcgttcccgtccgctgacgtaacggcagacgcaggacctaccccaatgacagggcggtgaacgacatcacccgggaccacttgctcatcatccaccgccccaacgacagcacgctggcgcagggctgccggggtgacgcacgtgcctgtgggtggagcaggtgaacacgccggggacccatggcaccaactccggaaggccccagctcgcctgcccgcaagacgtagtaaggggcagctaaaacaagatcgctctgggccccgcccgggatgcccaggacaaaaaccgtgggggtacggtggcttgccgggaaaccgggggagggatagtccttgggatgctcgactcaatcccggtaggccgaaaggaacaggcgaagggccccccttaattgcccacgggggggagggagaacccaaaaatttcggggagcgggggcccacgggaaacctgaa

SEQ ID NO: 76823 - DNA, 831 bp, Zea mays
  misc_feature: Ceres CLONE 1561642
  misc_feature: Translation starting site: 265
  misc_feature: SWISSPROT Homolog: EC 3.6.1.1 Inorganic diphosphatase
  misc_feature (655)..(655): n is a, c, t, g, unknown, or other
ctggagctccccgcggtggcggccgctctagaactagtggatcccccgggctgcaggaattcgtctcacccctagaaaaatttgccattggttcagctgctcttgtgtccctggcgctttttggtgcctttgtcagcagagctggagtgaaggtcgtctacgtcctctcccccaaggttttcattggtttgattgttggagccatgcttccgtactggttctctgccatgaccatgaagagtgttggaagcagccgccctgaagatggtggaggaggtccgcaggcagttcaacaccattcctgggttgatggagggaacagccaagcccgactacgcaacctgtgtgaagatctccactgatgcttccatcaaggagatgattcctccgggcgctctggtcatgctgactcccctcatcgttggaaccctcttcggcgtcgagactctctccggcgttcttgctggtgccctggtttctggagtgcagatcgccatctctgcttccaacaccggcggtgcatgggacaacgccaagaagtacatcgaggctggtgccagtgagcacgcgaggaccctcggtcccaagggatccgactgccacaaggcccgctgtgatcagtgaccaccattggtgaccccctgatagacacctnccagtccgtccctcaacatcctcatcaagctcatggccgtgggagtgccttcgtgtctgcccctttctttggccacccaggggtggcttgcttcttcaagttacctgtaaagaggggcaacagcccagaccactgcagtaaggtttccgatggtccccgatccgaccgtggtacaa

SEQ ID NO: 76824 - DNA, 777 bp, Zea mays
  misc_feature: Ceres CLONE 1561645
  misc_feature: Encodes the peptide sequence at SEQ ID NO. 76825
  misc_feature (562)..(562): n is a, c, t, g, unknown, or other
  misc_feature (583)..(583): n is a, c, t, g, unknown, or other
  misc_feature (593)..(593): n is a, c, t, g, unknown, or other
  misc_feature (666)..(666): n is a, c, t, g, unknown, or other
  misc_feature (676)..(676): n is a, c, t, g, unknown, or other
  misc_feature (725)..(725): n is a, c, t, g, unknown, or other
ctggagctccccgcggtggcggccgctctagaatagtggatcccccgggctgcaggaattcgtctcacccctagaaaaactccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggntggggtggagtcgaaaccggntgggtggacntctctcacccggaactcccaggccgtggagtggggccacgccccgtggtcgcgcacccgctgaagaacttcgnccaacttcanccggcgagcaggggctacccggggcggggcaagtttcttcgaacccgcntcggccctcggccggcacccgtcaaagggacggcggtctaccattcccccaa

SEQ ID NO: 76825 - protein, 212 aa, Zea mays
  misc_feature: Ceres CLONE 1561645
  misc_feature (54)..(174): Pfam Name: Chloroa_b-bind Pfam Description: Chlorophyll A-B binding protein
  misc_feature (141)..(141): Xaa is any aa, unknown, or other
  misc_feature (148)..(148): Xaa is any aa, unknown, or other
  misc_feature (151)..(151): Xaa is any aa, unknown, or other
  misc_feature (179)..(179): Xaa is any aa, unknown, or other
  misc_feature (195)..(195): Xaa is any aa, unknown, or other
MALAPTSAAVLKTPFLGARRALAKPAPRRALVIAAAAAAKKSWIPAIKSDAEIVNPPWLDGSLPGDFGFDPLGLGKDPAFLKWYREAELIHGRWAMAAVLGIFVGQAWSGIPWFEAGADPSAIAPFSFGSLLGTQLLLMGXGWSRNRXGGXLSPGTPRPWSGATPRGRAPAEELRPTSXGEQGLPGAGQVSSNPXRPSAGTRQRDGGLPFPQ

SEQ ID NO: 76826 - DNA, 810 bp, Zea mays
  misc_feature: Ceres CLONE 1561648
  misc_feature: Translation starting site: 162
  misc_feature (652)..(652): n is a, c, t, g, unknown, or other
ctggagctccccgcggtggcggccgctctagaactagtggatcccccgggctgcaggaattcgtctcacccctagaaaaaaaaagcaccagaccaattaactagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcactcaacccggcggtgaccttcgggctgttcctggcgaggaagttgtcctcaccagggcggtgttttactcatcatgcagtgcctggggcgcatctgcggcgcgggcgtcgtcaaggggtccagcaagggctgtcatggcaaaagggcggngggccccaacgtcgtggcgccccgctacacccaagggcgacggccttaggggccaaaattgtcggaacctttaatccttgtgctaaaacggttttttctcccccacccaaccccaaaaagaaacccccggggaactccccattgtccccattcccccc

SEQ ID NO: 76827 - DNA, 789 bp, Zea mays
  misc_feature: Ceres CLONE 1561653
  misc_feature: Encodes the peptide sequence at SEQ ID NO. 76828
ctggagctcaccgcggtggcggccgctctagaactagtggatcccccgggctgcaggaattcgtctcacccctagaaaaactgcgtctctacacccccatcctccgtccgcgccaccgccgcgcccatatccttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacaccagcgtcgtctcggacaagcccgatacgcctgccgacgacaaggccgaggaggttagcgccgcgcctagtggctccgctgaggcgcctatggcagagctagtgcacgaagaggcgtccccgtccccagatgatggcggcctgcatgagatgctaagcaagttgaacattagagtgtctccaactttaatcctcactggatgtggtgctgttattgcattatggatcctatcttctgttgttgctgcagttgattcagtccccctgctcccataaatgctggaactaataagcactgcttgacacatttggttcatgcgatcgaatctccttttgcagaaagcacagatgacctgtttgcgacgctcgaagatctcacaccgaggattatctgatctatcgtcgacttttttgcaacgtgtgtagggctttacagccagcttcataatagggtttttttcgcccgtttggttttgaaattacctgggaaggggaaaagaaaggtcatgtatcttaaat

SEQ ID NO: 76828 - protein, 61 aa, Zea mays
  misc_feature: Ceres CLONE 1561653
MAELVHEEASPSPDDGGLHEMLSKLNIRVSPTLILTGCGAVIALWILSSVVAAVDSVPLLP

SEQ ID NO: 76829 - DNA, 766 bp, Zea mays
  misc_feature: Ceres CLONE 1561658
  misc_feature: Encodes the peptide sequence at SEQ ID NO. 76830
  misc_feature (626)..(626): n is a, c, t, g, unknown, or other
ctggagctccccgcggtggcggccgctctagaactagtggatcccccgggctgcaggaattcgtctcacccctagaaaaagaaacatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggtggtggctacaacaagtccggcggcggcgacgactacggccgcagcggcggcgatgggtatggaaggtccggcggcgacgactacggccgtggcaccggcggcggcgggtacaacaagtccggcaacgacggctacgacagcgggtacaacagatcgggcaccaccaacgacgacgaatacggccgtggcaccggcggcgggtacggcagcaagccctctggcgacgacgcgtacgccggcggcggcnggtggcgggtacggcaagcagtccggtggcggcgcggacgaaggcggagagtaccggctcctcccgggacgactcggaggaaagtacaggaaagggaggagtaaggagcacaagcaccaaggagcacctttcggcgagga

SEQ ID NO: 76830 - protein, 186 aa, Zea mays
  misc_feature: Ceres CLONE 1561658
  misc_feature (153)..(153): Xaa is any aa, unknown, or other
MADEYGRSGYGRSGAGDDYDSGYNSKSGTDDYGRGEGGYNKSGGDDDYGRSGGDGYGRSGGDDYGRGTGGGGYNKSGGGDDYGRSGGDGYGRSGGDDYGRGTGGGGYNKSGNDGYDSGYNRSGTTNDDEYGRGTGGGYGSKPSGDDAYAGGGXWRVRQAVRWRRGRRRRVPAPPGTTRRKVQEREE

SEQ ID NO: 76831 - DNA, 889 bp, Zea mays
  misc_feature: Ceres CLONE 1561660
  misc_feature: Encodes the peptide sequence at SEQ ID NO. 76832
  misc_feature (410)..(410): n is a, c, t, g, unknown, or other
  misc_feature (411)..(411): n is a, c, t, g, unknown, or other
  misc_feature (414)..(414): n is a, c, t, g, unknown, or other
  misc_feature (415)..(415): n is a, c, t, g, unknown, or other
ctggagctcaccgcggtggcggccgctctagaactagtggatcccccgggctgcaggaattcgtctcacccctagaaaaaactgctcgagctcagctcaagtaaccacagaaaatggcgtcacttctccgccctctcgtcctcgtgctcctgatcgcctcctgcacagcgcagcagtcaccgccggcgcagcccccgccaacgccgaacgcgccaccggccaactcgccgccccaggcgcctccagccggcaacccgccgccggcaggcaacccgccacccgcgcccaccgccactccacctccggccccgaccactccgcccccggccccgaccactcctcccccggctcccacaacgccgcccccggcgccgacaactccacctccggtttccacccccccggggggnnttnncaccagcgtcgccaccgcccgctcccaccactccgccaccgtctcccccgggaagcccgccgcccgctcccgccaccccgccaccgtctccgcccatgggggccacctcccggcaaggccccttccacccgccacccccaccgccacggggcggggccaaatcgggccccaagggtgggccccgacttcccccgcccctgggggaaaccgggttgggtcccccaaaaagccccaagacgcctaaggcccggccgcccgcgaacattcccggggggccctcggtttttgcccgggggggaaccccgaacaaaaggaggaactcgggggagaaagacccgcgccccgggtcggaattcgccaaaggggggttggccatttggggggggccggggcccttccccactttctcgtttgtagaggaaaaaaaaacccgagaccctttctccccgggtctccacgcagacgaaagttgtt

SEQ ID NO: 76832 - protein, 181 aa, Zea mays
  misc_feature: Ceres CLONE 1561660
  misc_feature (100)..(100): Xaa is any aa, unknown, or other
  misc_feature (101)..(101): Xaa is any aa, unknown, or other
MASLLRPLVLVLLIASCTAQQSPPAQPPPTPNAPPANSPPQAPPAGNPPPAGNPPPAPTATPPPAPTTPPPAPTTPPPAPTTPPPAPTTPPPVSTPPGGXXTSVATARSHHSATVSPGKPAARSRHPATVSAHGGHLPARPLPPATPTATGRGQIGPQGWAPTSPAPGGNRVGSPKKPQDA

SEQ ID NO: 76833 - DNA, 903 bp, Zea mays
  misc_feature: Ceres CLONE 1561663
  misc_feature: Encodes the peptide sequence at SEQ ID NO. 76834
ctccccgcggtggcggccgctctagaactagtggatcccccgggctgcaggaattcgtctcacccctagaaaaagctcgctccctccctccctccctcccgcgcggatcacagaagggctcacggtcacggccggcctcccaattcgcaacctcgcctccgcctctcctcctaccccctccgaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcaaccgaggccagcagcgctcgtcgtagacgcggcagcggtggaagcgctggccgctcccgctgccgcggccgcgggccaggggcaagctaccgaaaccgcggcgagggcgtccgcaaaccggtgctccaactgcccgaaagcccctggggctgacggggttccgggggcccttcggcgaagctcttctgggggggggcacccggtactcgggaccgggcacgggtggcagcttacaaaaaaagggggggcgcccccccggggaagcccatccgccccggggagaaaacccgggtggggggccccccgggccacaagggcggtttagggttcctgaataccaccaaagcgggggagggaaggggacacccccccccacagggggctccccaag

SEQ ID NO: 76834 - protein, 170 aa, Zea mays
  misc_feature: Ceres CLONE 1561663
MAQRDKKEEPTELRAPEITLCANNCGFPGNPATQNLCQSCFSASRSPSSPTSSSSSLASAASQPRPAALVVDAAAVEALAAPAAAAAGQGQATETAARASANRCSNCPKAPGADGVPGALRRSSSGGGHPVLGTGHGWQLTKKGGAPPRGSPSAPGRKPGWGAPRATRAV

SEQ ID NO: 76835 - DNA, 798 bp, Zea mays
  misc_feature: Ceres CLONE 1561666
  misc_feature: Encodes the peptide sequence at SEQ ID NO. 76836
  misc_feature (629)..(629): n is a, c, t, g, unknown, or other
  misc_feature (686)..(686): n is a, c, t, g, unknown, or other
tggagctccccgcggtggcggccgctctagaactagtggatcccccgggctgcaggaattcgtctcacccctagaaaaagccttctcggcgcgctacgcctacgactgagctgaaagaagcggtagatcggcgttagcggcgagctagggttccggcgagtgcacccaatggcatcggaggcggcgcggcggcggcaggagatggcagaggaggggcaacggcacctggaggagactatcgcagcctcgttccagatcctcgtatccatgaacgacgagctctgcaacgccggcctttggtcctcctcatccgtctcggccaccgctgcggctggctaccagcaccatcactctgctactcttccgaccccacactctgtagattccgacgctgccgacgcagggggcgcgcccagccccggcgggtcgctcgacgaggcgaggcaccgctacaagtcagccgtggcggcgctgcgggcatctatctctgccgtgtcgtcctgcgctcaggacattggatcaacagaatctgaagctgaccatgcagagattgagagattggaagagcatgctgctgctttgagaaaggaaattgaaagcaaaaacaagcaagtaaaactcctcattgnatcagctccgtgacctaatagctgacatagcaatggtggcagaccccttgcttccgntggaaaagtgtcgaagttagaagacagtagcccggggacgtctggtattaagcataattggggcagggttggtttaactgaaccacacttggaagggagccaattagattgg

SEQ ID NO: 76836 - protein, 157 aa, Zea mays
  misc_feature: Ceres CLONE 1561666
  misc_feature (154)..(154): Xaa is any aa, unknown, or other
MASEAARRRQEMAEEGQRHLEETIAASFQILVSMNDELCNAGLWSSSSVSATAAAGYQHHHSATLPTPHSVDSDAADAGGAPSPGGSLDEARHRYKSAVAALRASISAVSSCAQDIGSTESEADHAEIERLEEHAAALRKEIESKNKQVKLLIXSAP

SEQ ID NO: 76837 - DNA, 1086 bp, Zea mays
  misc_feature: Ceres CLONE 1561668
  misc_feature: Translation starting site: 186
ggagctccccgcggtggcggccgctctagaactagtggatcccccgggctgcaggaattcgtctcacccctagaaaaactctcctcccaaactgcggatagagcagcgagccatcgacacgatcgcgagcgcaagcacgtacgttgtcagaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatgggacgctgcccggcgactattggcttcgacccgctgggcctctcggacccggaagggcaccgggggcttcatcgagcccaagtgtgcgggctatgggcgaggggatcaaacggccgcttctccatgctgggcgccgggtggggcccatcctcccccggagatttttcgggaaagaatggggcatctatcccccccgggataacccggcgcctgcccgtgggtttcaaaaaagggggggtcatttccccgccccgccggggcgaccttataaaaatttacgggggggccggaaactctctctaaacccgccttcctttggtgtcttgtccaacaaattggggcgccttttaatggtggcgctttctgtccctaaattaaacgtgtcccgtccgtttcttgtggagatgtggggaacaaacccgcggggggttcccttggggggcacagctatgtacctttcctcccggtgcctccgataaataattccctccccccgcgggttcaggaggaacccttgtccttttaccccgggggtgagggccccttcttttaaacaccgccttgtgtgttttggtgataatcccgggaaatgggaaatgtaaatgacccttatcactttagggaagattcaagaaagggcgcgggctcccccatgcttcgccactcttcggtattttttaccccagggtggttttccccggtggtctgcccctttcc

SEQ ID NO: 76838 - DNA, 861 bp, Zea mays
  misc_feature: Ceres CLONE 1561676
  misc_feature: Encodes the peptide sequence at SEQ ID NO. 76839
ccccgcggtggcggccgctctagaactagtggatcccccgggctgcaggaattcgtctcacccctagaaaaagaacggacacgatggtggccttgaccgcggggatttccgtagccaccggcgtcgtgttcagccccgccggccgccggcgaggccgcggacacgccgcctttcgctgctcgtcgtcctctgccggagagaggcaggctctcttcagccgcatcgcccccgtctacgatcatctgaacgacgtgctcagcctgggacagcaccggacgtggaagcgcatatgcgtctcttggtcgagagcgaagatgggggatcaagttcttgatctctgctgcgggagcggggatttggcgttcctgctgtctcagaaggtcggcttagatggagaggtgatggctgtcgatttttcaagtcagcaactacagactgctgctgggcgtcaggagcaacggtggaagctgtgttacaagaacatcaaatggatcgagggtgatgcacttgatttaccattcacagactgctacttcgatgctggaacagttggctacggattgcgcaatgtggttgataaaccgaaagcgatgcaagaagtatttagggtccctggaaccaggatcaagaagccctcttttcttgatttttaacaagagctccgtcactttttcccagccttcatttacagaagttgggggcgaataggaacaaaggttggtggggtctctttttggctagttggggctttgggactcactctggaaaagaatgacaaggggccttttggaaaaaggctcccgcttttctcaagggttatcctcaagactgtggagagaaagagtagttggggagtgaaaa

SEQ ID NO: 76839 - protein, 189 aa, Zea mays
  misc_feature: Ceres CLONE 1561676
  misc_feature (33)..(190): Pfam Name: Ubie_methyltran Pfam Description: ubiE/COQ5 methyltransferase family
MVALTAGISVATGVVFSPAGRRRGRGHAAFRCSSSSAGERQALFSRIAPVYDHLNDVLSLGQHRTWKRICVSWSRAKMGDQVLDLCCGSGDLAFLLSQKVGLDGEVMAVDFSSQQLQTAAGRQEQRWKLCYKNIKWIEGDALDLPFTDCYFDAGTVGYGLRNVVDKPKAMQEVFRVPGTRIKKPSFLDF

SEQ ID NO: 76840 - DNA, 812 bp, Zea mays
  misc_feature: Ceres CLONE 1561679
  misc_feature: Encodes the peptide sequence at SEQ ID NO. 76841
  misc_feature (774)..(774): n is a, c, t, g, unknown, or other
ctccccgcggtggcggccgctctagactagtggatcccccgggctgcaggaattcgtctcacccctagaaaaaacctcgcccccgaaccttggcgtctgccctaccaaccgcagcagcgacactagaatggccgcggcgccgtcatccctcgcgtcctcccacctctccccaatcgcggcggtgtccactcccgccgtcccacatcagcttcgcatcggctgctcccgccgccgcgcccagcgcatcgttgccatggctggatccggcaagttcttcgtcggaggcaactggaagtgcaatggaacaaaggactccattagcaaacttgtctctgaattgaatgctgctacccttgaaactgatgtagatgttgtggtggcacctccattcatctatattgatcaggttaagaattcactaactggtcgcattgaggtttctgctcagaatgtgtggattggaaaaggaggagcctacaccggagagatcagtgcagaacaactggtggacatcggctgtcaataggttattcttggacactctgagcgtagacatattattggtgaaaatgatgagtttattggaaagaaggctgcatatgcagtgagccaaaatgttaaggttattgcctgcataagagagctgctggaagagagggaagccggcaaaacttttgatggttgttttaggcagatgaaggcttttgcagatagtatttcaaaatgggcagaatgtgtaattgcataccaagcctgtttgggccaatggaaccngaaaaagttgctcctcccgagcaagcccaggaagttcc

SEQ ID NO: 76841 - protein, 90 aa, Zea mays
  misc_feature: Ceres CLONE 1561679
  misc_feature (7)..(89): Pfam Name: TIM Pfam Description: Triosephosphate isomerase
  misc_feature: SWISSPROT Homolog: EC 5.3.1.1 Triose-phosphate isomerase
MAGSGKFFVGGNWKCNGTKDSISKLVSELNAATLETDVDVVVAPPFIYIDQVKNSLTGRIEVSAQNVWIGKGGAYTGEISAEQLVDIGCQ

SEQ ID NO: 76842 - DNA, 939 bp, Zea mays
  misc_feature: Ceres CLONE 1561680
  misc_feature: Encodes the peptide sequence at SEQ ID NO. 76843
  misc_feature (506)..(506): n is a, c, t, g, unknown, or other
  misc_feature (616)..(616): n is a, c, t, g, unknown, or other
  misc_feature (683)..(683): n is a, c, t, g, unknown, or other
  misc_feature (685)..(685): n is a, c, t, g, unknown, or other
ctccccgcggtggcggccgctctagaactagtggatcccccgggctgcaggaattcgtctcacccctagaaaaaccttccattcacccgcagctcccatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttggaagtggtctgaccaactatgcagctgcctactgcactggccttctgtttggctcgccgtgtgctcaagatccgtggtttggatcangagtacgaaggcaatgttgaggccactggtgaagacttctctggtgagccagctgatgagaggaagcctttccgtgctcctcttggatgttggccttatcaggactacancaggggaaccgtgtctttggtgccctccagggagcattgggatggaggccctggatattcctcacancnaggaagaggtttgctggatttcagaaaggacgacaagcagttggatgctgaataccaccgcaaggtactctattgtgggccatgttgctgactacatgaaagaacttgctgaagaggagcccgaaaataccggaccccctttgtgcgtaatttaaaaagggagttgaagctgataaattgaacgctgtaaaagaagtcaatgctggcatcctgccgatcccttcattggtaagccaccaagcgccccaaaggac

SEQ ID NO: 76843 - protein, 124 aa, Zea mays
  misc_feature: Ceres CLONE 1561680
  misc_feature (27)..(116): Pfam Name: Ribosomal_L18p Pfam Description: Ribosomal L18p/L5e family
  misc_feature (119)..(119): Xaa is any aa, unknown, or other
MGGFVKTHKTNAYFKRFQVKFKRRRAGKTDYRARIRLINQDKNKYNTPKYRFVVRFTNKDITAQIISASIAGDMVLASAYSHELPRYGLGSGLTNYAAAYCTGLLFGSPCAQDPWFGSXVRRQC

SEQ ID NO: 76844 - DNA, 754 bp, Zea mays
  misc_feature: Ceres CLONE 1561682
  misc_feature: Encodes the peptide sequence at SEQ ID NO. 76845
  misc_feature (680)..(680): n is a, c, t, g, unknown, or other
tggagctccccgcggtggcggccgctctagaactagtggatcccccgggctgcaggaattcgtctcacccctagaaaaagcaatgctgaacgctgcacacctgtaaaagatagagctatcccctccctccccatcccttggagccagcaactccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccgtgccccactcggctgctggtgagcagcccttgtcgccccctcctctcggcccgcccgcttcgtgtctccgccgctggcgccgtcgctaccagaagcagcgccgtgggccctcgcggtctggggctcgggctgctgccagcctcgcccgatcgggatggcaagtgccgccagcgacaggtgtcatgcagcgcggccggggatgctgtggcggccccgaaggcggaagaaggaggcgggctcatgaagacgctgtggctcggctcgctcttcggcctctggtacctgttcaacatctacttcaacatctataacaagcaggtactcaaggtttttcccataccctataaacatcacagaagttcaatttngctgtcggaactgtagcagctctgtttcatgtgggatcactgggtattattaagaggccaaagatttctggaag

SEQ ID NO: 76845 - protein, 136 aa, Zea mays
  misc_feature: Ceres CLONE 1561682
  misc_feature (132)..(132): Xaa is any aa, unknown, or other
MQSAAAFRPCPTRLLVSSPCRPLLSARPLRVSAAGAVATRSSAVGPRGLGLGLLPASPDRDGKCRQRQVSCSAAGDAVAAPKAEEGGGLMKTLWLGSLFGLWYLFNIYFNIYNKQVLKVFPIPYKHHRSSIXLSEL

SEQ ID NO: 76846 - DNA, 839 bp, Zea mays
  misc_feature: Ceres CLONE 1561683
  misc_feature: Encodes the peptide sequence at SEQ ID NO. 76847
ccgcggtggcggccgctctagaactagtggatcccccgggctgcaggaattcgtctcacccctagaaaaaaccgggcaccatgagctcctactccggcgaccgctcctcctcctcctccttgcgccccaccaacacctccttcgactcctacaagttcgacttcggcatcaactcctcccgctcctccggctctcgccccctccgcgaccagcggccgggcgcggctaccaaccctccaacgaggcccgccaccggcgccacgtggatgcaccagcccgccagcgccaagccgtcgtggacccaccagccttcccccgccgcggcgtcggcgcccaccatggcggggcctggatccgggccaacctccatggtcggcgacatctttggccggagctggtcctccgccgcgccctcctctgggttcggcatccctcaggccaacaaccccggcctcttcagcgatctcctcggctccgcgctcggctcctcccgctcccagtccaacgcgccgctcagatccgccgccgcgccacaggcatccaggccagccggtgagaagcccaatgtcaacgctagcagctctcccttctcgatgggcggcatggcgggcgcgctcccgaaaactacgggagcaccgatggggctcggtggatacggcgtttggtggccggccgatgaaaaccgtgggcatgggcgcaacggctgctgcgcagccgatggggcaacaaagggatccatttgggcccaataaacccctttggcggcaaagcctggggtccatgaaacgcggtggaaacagggccatttcggtcaagccgggacaaggggatttgggaat

SEQ ID NO: 76847 - protein, 223 aa, Zea mays
  misc_feature: Ceres CLONE 1561683
MSSYSGDRSSSSSLRPTNTSFDSYKFDFGINSSRSSGSRPLRDQRPGAATNPPTRPATGATWMHQPASAKPSWTHQPSPAAASAPTMAGPGSGPTSMVGDIFGRSWSSAAPSSGFGIPQANNPGLFSDLLGSALGSSRSQSNAPLRSAAAPQASRPAGEKPNVNASSSPFSMGGMAGALPKTTGAPMGLGGYGVWWPADENRGHGRNGCCAADGATKGSIWAQ

SEQ ID NO: 76848 - DNA, 1000 bp, Zea mays
  misc_feature: Ceres CLONE 1561684
tggagctccccgcggtggcggccgctctagaactagtggatcccccgggctgcaggaattcgtctcacccctagaaaaaggtattcatgcgtcgaccatcaccggcgacggcgtatctccgtgctcacgtcccggcgtcccgagccggcggccacgggccataacagacccggaggacatcaccagcgcgagcgccgccagccccaagcaccgaggccgagccgcccgagcgcggagcggcggtaccacgccacccgcccgccgccgcccgttgcggaggctgtgcagcacagccgttggggtgccgaggcaccgatcaggctgcgcaaccgccgaagtcggcctccgggtggcgccaagctgcagagcagcgcgccagcgcccctgtatcggactacctttttcggcgagaccacccctagtagaggatgatatacacccgcgattgacacgttctatctgacgggaggagcagctgcgcaactcaccatcacgggaaggatggggatcgaacgaagcccactgagactggggctccgccgtctatgggctgccaacctcatcccagaaaaagtggcatccctccctcaggcttccaccaaagcagttgatgggccacgggcaccaagtattgggttcccacccccttttttctgggcaaaaaaatcattttggttcccaattttaggggccaaaaagaagttgcctggctaattttgtgtttttggcctgggcaagggaaaatttgggaggaaaaagtccccgggaaaatcaaaagccttttttttttttgggtccttcccctctaaaatgggaaatggtggaaaaaaaaaaccttggccaattggaaattcctaaaagggccttctccaaagaaaatttctagaaacgggaggcgtggccctgattacggaaagaaccgacccttttgttaaaaagagaaagggggttattttgcccagggcggggcacccccccaaaatttcatatcaaactacct

SEQ ID NO: 76849 - DNA, 735 bp, Zea mays
  misc_feature: Ceres CLONE 1561685
  misc_feature (172)..(172): n is a, c, t, g, unknown, or other
  misc_feature (189)..(189): n is a, c, t, g, unknown, or other
  misc_feature (262)..(262): n is a, c, t, g, unknown, or other
ctcccgcgtggcggccgctctaaactgtggatcccccgggctgcaggattcgtctcacccctagaaaaatctctctaggttttttgatttttagccgccgcccgctgcctatctcacatccctcgagaagaccctgctcctcgcgatcgatacgatggccgtctttctcgancctcacacgcgacgggnctcagtccctcgaggctcacctcgccggcaaaaactatgtgtctggtgactccatttactaagatgacattanggtctttcgccgcgtgcccgtcaagcctggcgctgaaatttcttattgccgccccctggtacaaaaacgtctcctgccgcggtaccccccaaaatccccgggtaaggcttttgggggaaatcccgcctgggggaataacctcccggggaaaattgtcccctggggattaaggcccgaaaaaaattatataccccttttacttttttgggggaaggaaaacccggggggaaaaaaaaaagggccccctttataatgtggtcccccccccttcaaaaaggccctttttttttaaaaaaaaaaaaaagggggggaacccccccccccccccttttgtgggggttacacccccggggggcgaaaaaaaaaactttttttataaaaaaccgcgcggggggggggggctccccccccccgcccccccaaaaagagggggggctcctctttgtgggagagaaacaaaaaaaatggtgggg

SEQ ID NO: 76850 - DNA, 833 bp, Zea mays
  misc_feature: Ceres CLONE 1561686
  misc_feature (756)..(756): n is a, c, t, g, unknown, or other
ctggagctcaccgcggtggcgggccgctctagactagtggatcccccgggctgcaggaattcgtctcacccctagaaaaactccccttcccataatcatctcagcgaatcctatccaggcgatggaccaacaaggtgcgggcgagggactccgaggtgccggcggggctgggtctgacggcggcggagtacgagcagctgcgcgtcgacggtggacacgcaccaccggtaccccgtggggggagggtctatgctccttgctgctggcggagcggatccacgcgccgccggaggccgtctgggccgtcgtccgacgtcttccactgcccgcaggggtaccagcacttcatccggagctgcccacgccggccagaacccgaagcccgttacggcgtctggccaggccccccccgcgaggttactgtcatctctggccggccccgcagcagcattaccgagcgtctcgacctagtcgaagaacacgctagggtgttgcgcgtcccgatcccccgaggcggagatggccttcagaacaaccgctcgcgggcccccgtctcccaagcttggaggccccgcggatctggaccgtcgtggtccgagggctacggcctgttaaggtccccgaacggcgacacgcttggccgacaccccggcttgtaggacgtagcccgcgcttgagggcgcgacccctccggaagcctgtatgtcagcttcctggagagcgacagggctggccgagggcgcgcccccagactcntgaatgtccagcgcctttccgggcgggagtcctcggaacaagatatcccgcgcgggtgtgtgcggggcacacaatct

SEQ ID NO: 76851 - DNA, 919 bp, Zea mays
  misc_feature: Ceres CLONE 1561687
  misc_feature: Encodes the peptide sequence at SEQ ID NO. 76852
  misc_feature (753)..(753): n is a, c, t, g, unknown, or other
  misc_feature (802)..(802): n is a, c, t, g, unknown, or other
ctccccgcggtggcggccgctctagaactagtggatcccccgggctgcaggaattcgtctcacccctagaaaaaatcggccatcgctctagccagcggccagcccgtccgccagcgagaggtcaaaaactactacgagccaaaaactggagcccagggaaagcgacgagcaaaccaaacatggcggcgatcctcgcgcgcgccggcgtcatcgccaccgccggcaaaggtttctcgggccgccgccggggcaatggtatcgtcgtcgcggcggtcactaaaacgggggctgctgtgccacaggagggggcgctggaacggccggcgtggtccggcgagaccacgctgtcgcgtctggttggcgcgctcatcgcgttcaagccgctctactcggtattgaagctcgcctcccgcgaggtcatcatcaggacggcggagaagtcgaacatcccgtggagggagatgacgaaggaggtgctggagtcggacgtgtacgaggtgttcgagagaatccaagacccaaacctcgtgtaccctgactactatctcaacccgtttcatgcctacgacgaagggaatctatcatggctggctgcagcagaggccgagccggcaacaatgtcaatcgcaaagagggcaatacctgaggctacatcaatcgaagaggccaaccaaatcgtccgcggcaactggctgaatgtaattgaggagcatcatctgaagtactcggggaactgtcaggtaaacgacattntggacattggctgctcctgttggagttagcaacagatacctcgccgagnaagtcccatcaagctcagctgttggggtcgacctatcaccgtaactttcttggtgtggcgggacaaagggaaaaaactgttccgaaccaggcctattccctggggtcaggcaaatgg

SEQ ID NO: 76852 - protein, 200 aa, Zea mays
  misc_feature: Ceres CLONE 1561687
  misc_feature (192)..(192): Xaa is any aa, unknown, or other
MAAILARAGVIATAGKGFSGRRRGNGIVVAAVTKTGAAVPQEGALERPAWSGETTLSRLVGALIAFKPLYSVLKLASREVIIRTAEKSNIPWREMTKEVLESDVYEVFERIQDPNLVYPDYYLNPFHAYDEGNLSWLAAAEAEPATMSIAKRAIPEATSIEEANQIVRGNWLNVIEEHHLKYSGNCQVNDIXDIGCSCWS

SEQ ID NO: 76853 - DNA, 908 bp, Zea mays
  misc_feature: Ceres CLONE 1561691
  misc_feature: Encodes the peptide sequence at SEQ ID NO. 76854
  misc_feature (494)..(494): n is a, c, t, g, unknown, or other
ctccccgcggtggcggccgctctagaactagtggatcccccgggctgcaggaattcgtctcacccctagaaaaaaagcgcttcgcctccaatatctccacgccgttcgcggtgcttccgctcgcccactcctgcgccgctgcagctcccggcaccgtcctacgaaccaacacggccccagatttcttccagctccaaccgattcgaccggaaccgccgcacgagaccccccaaagctcgcatcctttcctgcgtttatttacttcagttcaaattcgggagtgttctgtttttgccctaacttggtcacaatgggcggcaataatgacggcgtttccggtgccgcttgcttgaagccgctcaacggcgtctcccctacctacgtacccagcgccggcgccggcgccctgtacttccttatcggctccgggctcggcgtcgtggcggtgctccacgcatctgggttgggcgaagtcagcggagagtggggctccncggccgcgtggggctgagtaagcagagagtggccctccgccgcgcggtggggctgcccaactgggcgggatcggtcggcgcccagcgcctgctcctcccaacgtcgcttcttttcctgggcgtcagcgtctgggggcctcccaagggctgcgccgccgggggaggggcgcgtctggcacacggactccgcggtgccggcgttgcacgtccggggggaatcttctgcgccgggggcgggtcaaaaaatccgggccccaaaaagcctccccggcgtggaaacaccccctcggcgaatccagaaagccggccccaaggcccctggctgctgaattcaccagaagcttaaggggaagaaaagacaaaggcgggaaatcaccatcccaaagaggggggtggcgaaccgaaaagaagccc

SEQ ID NO: 76854 - protein, 66 aa, Zea mays
  misc_feature: Ceres CLONE 1561691
  misc_feature (62)..(62): Xaa is any aa, unknown, or other
MGGNNDGVSGAACLKPLNGVSPTYVPSAGAGALYFLIGSGLGVVAVLHASGLGEVSGEWGSXAAWG

SEQ ID NO: 76855 - DNA, 1247 bp, Zea mays
  misc_feature: Ceres CLONE 1561692
  misc_feature (56)..(56): n is a, c, t, g, unknown, or other
  misc_feature (63)..(63): n is a, c, t, g, unknown, or other
  misc_feature (64)..(64): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (84)..(84): n is a, c, t, g, unknown, or other
  misc_feature (1221)..(1221): n is a, c, t, g, unknown, or other
  misc_feature (1247)..(1247): n is a, c, t, g, unknown, or other
tatgtttattgtctttaaaaaacaacttaatccgtaaaaaaaataagatggacggnagagttnntttttnnnntacaagctggnagctccccgcggtggcggccgctctagaatagtggatcccccgggctgcttgaattcgtctcacccctagaaaaactccgccccacgcagctgatgagctgattctccccggcgtcccgatcgtaatcgccgttggacagcgtgcgccagaacctctgcccccgcagggtgcaagctagtattctggctatctggtcctttatagtgcctgcgcataacatcgatccgctcccggtccccgtgcagccaatcctctagatggggtcgaaccaggaaattcttaacctagaaaagaaccacagaaacaaaacacactcccagtggggcgcggggtacgctagagactttagataaaataaactcttgtgaaaatataaaaggggaacccctggggccgccacccccaagtgggttggggaaaagactgatgagaaatcccccccgcatttttcgaggaagaatcgccagcaaaatctctaataagaaaacaaggacgaccgtgtcgttcccatattcataatggggggcccagagtgcaggacaaaaatcgtgacaaggagagcgagtagacaccgggggcataccctcggggggttacccaacccacaggcgcgattcgattaaccgaccagaaagacacaatgaaaggcagatcggagcggactgccatgttatgcatgctcccacagcaaagaagacggtttatggatcaccagaagaaacgtcgtgagagcggacagccctcctgttttggagaagcgagacaattgtgttacccactggaataagagtctacacatgagaaagttacatccgctcgtccaagaatagatcctagctgagcggcggggagtgattattgtagatgccattatcaacccaccacccagtatttaccgggattacactcgacaattagcgccgggatatagcctagaccagagattttatttcccttcgacgcggatattgatacaccggcgcacactggaagtattgcatagagggtcgagaagagcaaagacagacgcaaatgttgagaacgagaaaatttcctcctcaccctccaattatttgtaaatggcagtggcattgagcactcatcacgcgcctcccatattgtattgtatctaaccnataccacgtggagtctggggtgacgn

SEQ ID NO: 76856 - DNA, 832 bp, Zea mays
  misc_feature: Ceres CLONE 1561697
  misc_feature: Encodes the peptide sequence at SEQ ID NO. 76857
  misc_feature (409)..(409): n is a, c, t, g, unknown, or other
ccccgcggtggcggccgctctagaactagtggatcccccgggctgcaggaattcgtctcacccctagaaaaaaccatgccactacagctctcccccgcccacgattggccaccggcccgggagatgccgacgcccattgcgaccgcgatttgctcccccgtgtcctcggcctcttcctccactctcatcctccctcctccccccgtcctcggctgttctcgtcgcctccgtcgcgcgttccgctctccccacaggccttgtccgccgcatcgtcctcggctgttctcggcgcctcgctccacgcctgtcctcgcccaacgaccctcgccgcaccccctccctcgtcttcgacgactccccctctggcgctgtcctcactggcatcgacgcctgctctctccgtcgtggngggaggggaaagcgaaggaggaagaagagccaagcggttaagctgactcggttgctcgcctcccaccaaaatcccccaagacctcatcgacgaggagatggagatggagtccagccccgccgcatcacccttttcgtcgagccgtcgccttgcgcctatgcccccgcagctcctccgcatcgcaatcgctgcctcccgctatgcaacccttggatccactttctcatgcgattgcccctggatcgggaaaccacgtcctggcgttccgccgcggctttccttgaaccggcaaagcacggtccagggcctccagggcactttgcaggctttccacggctttctcttggccaggggggagcccaggtagctagggccctccccactggttccaagggccaggggggggggtccccaggggggcaa

SEQ ID NO: 76857 - protein, 124 aa, Zea mays
  misc_feature: Ceres CLONE 1561697
  misc_feature (112)..(112): Xaa is any aa, unknown, or other
MPLQLSPAHDWPPAREMPTPIATAICSPVSSASSSTLILPPPPVLGCSRRLRRAFRSPHRPCPPHRPRLFSAPRSTPVLAQRPSPHPLPRLRRLPLWRCPHWHRRLLSPSWXEGKAKEEEEPSG

SEQ ID NO: 76858 - DNA, 772 bp, Zea mays
  misc_feature: Ceres CLONE 1561702
  misc_feature: Translation starting site: 155
  misc_feature: SWISSPROT Homolog: EC 1.10.99.1 Plastoquinol--plastocyanin reductase
  misc_feature (627)..(627): n is a, c, t, g, unknown, or other
  misc_feature (628)..(628): n is a, c, t, g, unknown, or other
ctggagctcaccgcggtggcggccgctctagaactagtggatcccccgggctgcaggaattcgtctcacccctagaaaaagtggacgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcaagccggtgaaggggcttggcttgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacgggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcnngctgcgtcgtgccgtgggaacggcgctgaagaccagttcatctgccccctgccagcggatcccagtacacaacccagggcaaagtgggtccgtggaaccggcgcctctgtcgctgggcctggttcacgcccgacgtcgacgacc

SEQ ID NO: 76859 - DNA, 1331 bp, Zea mays
  misc_feature: Ceres CLONE 1561703
  misc_feature: Encodes the peptide sequence at SEQ ID NO. 76860
ttttgtattttgcgcttttgatgccggactcacactcttagagtctattttatatggttattcctcatagttggagctccccgcggtggcggccgctctagaactagtggatcccccgggctgcaggaattcgtctcacccctagaaaaaaagcctgtggacgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcaagccggtgaaggggcttggcctgagcatggggccgcgagcgcgcccaccggagcattgtgtgccaggcggcgagcagcatctccgccgaaccgcggtcccgacatggagaagcggaagctgatgaaacttctcctcctcggcgccatcttgtttgccaacgttcgcacgggcgtcccctacggggcccttttttgtccctgccgggttcggggaaacccggggggggggacctttcgcgaaagggaaagcttgggggacggacattcacggtggggaggggtgggcttatacaaataaagggtcccaaaattaaccgcaaagacttcggggaagggggggttctaaggggggaaaccccccacgttgcccgggggggtgtggggcctaaggaaaaaaaagcgcctctgggccctacccctttcgggggaataaacacatctcggggggtggcgactctaacccccgtcgggacttgtgtttttccatggtccccggggtgaaacagagtgtgtcctcgtaagaaagaacaaagatgttttccgccttcttgtcccgcccttgtgtggaaaaagagggtgaataactcttcgtgtctaaccgcacccatcgtctcctcttggtgcgagccataagtgggtgggtcgccctcctttggggggaaatgagaaggggggacatcttctctgtattggcaccggtggacgcccaccgtagtgttatctatctccgcacaatcatttgtctgcacatattcacgggcgagtgtgggtacttctttttcctagatctccctctagtggagttaggaggataagacaaactcttttcccggtatacacatcggctcatgagatcctccctgcttgggtgcggaaaagacgcacgttatggcgttaaaatccgtgggagacaccctggttggggtactcggagattacctactaagcggtgggtgatcctgtgcataatggccccctcccactcccgttgcggagagaaaaaataaaaagaggtcgggcgccctcct

SEQ ID NO: 76860 - protein, 64 aa, Zea mays
  misc_feature: Ceres CLONE 1561703
  misc_feature: SWISSPROT Homolog: EC 1.10.99.1 Plastoquinol--plastocyanin reductase
MATSAALSTAANPTQLYRSRASLGKPVKGLGLSMGPRARPPEHCVPGGEQHLRRTAVPTWRSGS

SEQ ID NO: 76861 - DNA, 855 bp, Zea mays
  misc_feature: Ceres CLONE 1561704
ccccgcggtggcggccgctctagaactagtggatcccccgggctgcaggaattcgtctcacccctagaaaaaataccctccccttcctcataccggagactccgacgacaccgattgactccatagcatgccctcacgcttgacctaaagctccactccgatcgttgtcattcacatcccgatacagcctgatgctaagtttccctgctgctggggcgtccctcacccccccatcaggatctacgatgttcgcatgaagagcatccgtgctttcaccactccccttcttgtgcgcccctctcctggcgccagaatgagaatgtctccgccccagcgccgtgtgacgcttcccccgttgcctggaacatattcttcaccaaggccgccagagacgatgcgtcccccatcttggccctggttgacccgatccgtgtcctcctgtccctcaacatgctctcgggcgatcccggctgagatgctcctctacgccaatcgacggagagcctctggatgcacctcaggaggcctgctgcttcagtggactcgtgacgagagacctccctatcgccgcggacggaagtacatcagtgtctgcccgtgacaacgcaagctctgcactagcgcttagtctcagttctcccggctgccaattcactcttctgagcaaaaagtggaacttcatgaagttggaccgcggtgactactcgagactcttcagcgagctaccaagtgctcctgatggtgtgatggaaagctggtcgtcacgccggtcgtacttcacagcatgctcctgcccaagatgtcatcgatgacactgccaagatgctgatgaccatccgaacgttcagactcccc

SEQ ID NO: 76862 - DNA, 742 bp, Zea mays
  misc_feature: Ceres CLONE 1561706
  misc_feature: Encodes the peptide sequence at SEQ ID NO. 76863
agctccccgcggtggcggccgctctagaactagtggatcccccgggctgcaggaattcgtctcacccctagaaaaaatcccttggagccagcaactccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccatgccccactcggctgctggtgagcagcccttgtcgccccctcctctcggcccgcccgcttcgtgcctccgccgctggcgccgtcgctaccagaagcagcgccgtgggccctcgcggtctggggctcgggctgctgccagcctcgcccgatcgggatggcaagtgccgccagcgacaggtgtcatgcagcgcggccggggatgctgtggcggccccgaaggcggaagaaggaggcgggctcatgaagacgctgtggctcggctcgctcttcggcctctggtacctgttcaacatctacttcaacatctataacaagcaggtactcaaggttttcccataccctataaacatcacagaagttcaatttgctgtcggaactgtagcagctctgttcatgtggattcactggtattattaagaaggccaaagatttcctggagcaccagcttgtagccaatcctaccctcggggctattggttccaaact

SEQ ID NO: 76863 - protein, 147 aa, Zea mays
  misc_feature: Ceres CLONE 1561706
MQSAAAFRPCPTRLLVSSPCRPLLSARPLRASAAGAVATRSSAVGPRGLGLGLLPASPDRDGKCRQRQVSCSAAGDAVAAPKAEEGGGLMKTLWLGSLFGLWYLFNIYFNIYNKQVLKVFPYPINITEVQFAVGTVAALFMWIHWYY

SEQ ID NO: 76864 - DNA, 919 bp, Zea mays
  misc_feature: Ceres CLONE 1561708
  misc_feature: Encodes the peptide sequence at SEQ ID NO. 76865
  misc_feature (797)..(797): n is a, c, t, g, unknown, or other
  misc_feature (832)..(832): n is a, c, t, g, unknown, or other
acccgcggtggcggccgctctagaactagtggatcccccgggctgcaggaattcgtctcacccctagaaaaacttccattcacccgcagctcccatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaagtttgctggatttcagaaggatgacaagcagttggatgctgatacccccgcaggtacatctatgggtgggcatgttgctgactacatgaagaactttgctgaagaggaagcangaaagtaccagagccacttcagtgcgtacattaangaaagggagttgaggctgaagaatttgagcccctgtacaagaaaggtcatgctgccatccgtgcctgatccctcgggttgtaaatca

SEQ ID NO: 76865 - protein, 257 aa, Zea mays
  misc_feature: Ceres CLONE 1561708
  misc_feature (27)..(173): Pfam Name: Ribosomal_L18p Pfam Description: Ribosomal L18p/L5e family
  misc_feature (217)..(217): Xaa is any aa, unknown, or other
  misc_feature (228)..(228): Xaa is any aa, unknown, or other
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDKEYEGNVEATGEDFSVEPADERRPFRALLDVGLIRTTTGNRVFGALKGALDGGLDIPHSEKKFAGFQKDDKQLDADTPAGTSMGGHVADYMKNFAEEEAXKYQSHFSAYIXERELRLKNLSPCTRKVMLPSVPDPSGCKS

SEQ ID NO: 76866 - DNA, 1246 bp, Zea mays
  misc_feature: Ceres CLONE 1561711
ctttttttgttgtggtgccgtacttttctatcacccattaatgatacttgttttgtccccttctcttttttaaaaactggagctccccgcggtggcggccgtttctagaactagtggatcccccgggctgtcaggaattcgtctcacccctagaaaaaagcgggtggctcctcacttcggcccctccacccactatcgggaacgaagatgaggagggcgggatgtcgaacatggagttctagcacccgaggatcggctccctccccttccttgccaggtagtgtctcctccggccaccgcggcaaggtgaagtacatttcggagggacgaccccgacaagccttgccatcccactgccttccttggctacaaggctggattgactcccattgtccgggaggccgacaagccaggatccaaactacataccaaggaaactcgggaggctacctccatcgttgaaacctctcctcgtagacttgcttcggcacacgggatctgtgaagactcctcgtgggctgggcccaccctagtcgcgcttggggtccgtcttccctcacggaagctttgacgataaaggttctcactagtacccggatgccaggagccgggatagagggcttgttccaaaagaatcctctcctccatatgttggatatgtggactcctcggcgaacaaacgaattatccctgactctctagccttcggggaaacaattgcaaggaaacgtttgcctggtcccgtgcattacccggtgggtgtgtttgacctgccatttgtcccgcggcggttaatggggaatgacactgtgatatggggggctctcgggagaaggcactgttacagtaaaagtgccctccggccccgctgtcctggcggagagaagttactatgaggcccctatgccgcggcgggcggtacactgtctaggcggcatgtcagcagacgagtcggtggactcttatttgtacatacccacgattgtctctctgcgcattatatcacagcgccgcgcgtggtgtacgagtggcccgcgcctcgtcccttctctgcgctatgtcgcggtgtgaagggtgtactctcgaggtgtggttgggggcatcctatacgcgtcgaaggggctctacctgttcggctcgtgtggactcatattatcgctggcgagaagtaacacggcggcgcgttccgccgttctacggacctccctgggtcggtcctcgctcaggaggtggcgctctaatcccg

SEQ ID NO: 76867 - DNA, 795 bp, Zea mays
  misc_feature: Ceres CLONE 1561712
  misc_feature: Encodes the peptide sequence at SEQ ID NO. 76868
  misc_feature (685)..(685): n is a, c, t, g, unknown, or other
ctccccgcggtggcggccgctctagaactagtggatcccccgggctgcaggaattcgtctcacccctagaaaaaatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgcccgccgcaagtcaaagaatgcagcggctgccaagccaagaaggccgctgctgctgggaccaagcgcaaagtgccgaagaagatgtcgtggcgaagccgaagaagtcccccgccgncaggcccaagccaagccgaagaccgtgaagtcccctgcctccaagaaagcacggaaagcctccccatgaaaggggttgctttagtccaagctccgaatgggggttggggg

SEQ ID NO: 76868 - protein, 195 aa, Zea mays
  misc_feature: Ceres CLONE 1561712
  misc_feature (35)..(105): Pfam Name: Linker_histone Pfam Description: linker histone H1 and H5 family
MPALAKPASRTAKPAAAPKPKPAAAKPKAATAGASHPPYFEMIKEAITALKERTGSSSQAIAKYVGDKHGASLPANFKKMLSIQLRGSAAKGKLVKVKASYKLSDAAKKASPKTKAKPAKAAAAKTTAPKPAKAARRKSKNAAAAKPRRPLLLGPSAKCRRRCRGEAEEVPRRQAQAKPKTVKSPASKKARKASP

SEQ ID NO: 76869 - DNA, 715 bp, Zea mays
  misc_feature: Ceres CLONE 1561713
  misc_feature: Translation starting site: 197
  misc_feature (513)..(513): n is a, c, t, g, unknown, or other
ctccccgcggtggcggccgctctagaactagtggatcccccgggctgcaggaattcgtctcacccctagaaaaaaccagcaccgaggcaggagcggcgatccattccacacaaccaccactgctcttgccccagcccgccgcaggagttgccagatctgccccggtcacaggaactccgactccgagccctctccaatggcggttaaggtctacgtcgtgtactattccatgtatggacatgttggcaaactagctgaagagatccagaaaggtgcctcgtctgttgaaggtgttgaagctaaaacatggctggtccctgaaaccctccctgaggaagtgcttggaaagatgggcgcaccccctaagcctgacgtgccagtcatcacgccgcaagaactcgcagaggccgacggaatcctctttcgggtccccaacgagttcggaatgatggcagcgcagatgaaggcgtttctcgatgcccactggtgggctctggagggagcgaagcttgnccggcaagcctgccggcgtcttcttctgcactggatcccagggtgggtgggccaggagacgaaagcgtttaacagcgatcccccagttggacccacaacggccttgggggttccctggcccgtggggcctaaccccttcggggccccaaacttgttcggaaattggaccaaaggtttagggggggggaaacccccttagggg

SEQ ID NO: 76870 - DNA, 846 bp, Zea mays
  misc_feature: Ceres CLONE 1561715
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (138)..(138): n is a, c, t, g, unknown, or other
  misc_feature (142)..(142): n is a, c, t, g, unknown, or other
  misc_feature (146)..(146): n is a, c, t, g, unknown, or other
  misc_feature (147)..(147): n is a, c, t, g, unknown, or other
  misc_feature (178)..(178): n is a, c, t, g, unknown, or other
  misc_feature (197)..(197): n is a, c, t, g, unknown, or other
nnnnaaaannnnnnnnnnnnntnnnnnnnnnnnnnnnnnnnnnnnnnnnnnnnnnnnnnnnnnnnnnnnnnnnnnnnnnnnnnnnnnnnnntccccccannnnnggctcnnnnnnnnaaaaaacctgggactccaccncggntggnncggccgtctctagaaactagtggaatccccncgggctgcaggaaattcgntctcacccctagaaaaagcggttgcccctttgcccgcatcatcccacctcgcgaacgaggacggcttctagtccctcgcctaccccgcccccgaacctggcgtctgccctaccaaccgcagcagcgacactagaatggccgcggcgccgtcatccctcgcgtcctcccacctctccccaatcgcgggcgggtccactcccgccgtccacataagcttcgcatcggttgttcccgccgccggggccggggggaatccttgcccatgggcttggaaacccggaaaaatttctttctctcggaaggggaaaatgggaaaagggccaaaaggggaaacacaaaggggaactccccttttttagccaaaaaaaattttgtccccccccccgaaaaaattttgaaaaaagggggggggggaaaaacccccccttttgtaaaaaaaaaccgggaaagggtttaaaaaaaaaatttttttttggggggggggggggggacaaccccccccccccccccttttttaaccccccaaaaaaaaaatggggagaacacaaaagggggggtaaaaaaaaaaaaaaaatttcttcccccaaaaaaaaaggggggggggggcccccccaaaaaaaaagaaaggggtggtttttccccccccccc

SEQ ID NO: 76871 - DNA, 1816 bp, Zea mays
  misc_feature: Ceres CLONE 1561716
  misc_feature: Encodes the peptide sequence at SEQ ID NO. 76872
aatcagggagaagagtttgataggtcacaagtatgattgggagcactggagggtgtaacaactcacctgccgaatcaactagccccgaaaatggatggcgctgaagcgcgcgacccacacccggccatctgggcgagcgacatgccccgatgagtaggagggcgcggcggccgccgcaaaacccggggcgcgagcccgggcggagcggccgtcggtgcagatcttggtggtagtagcaaatattcaaatgagaactttgaaggccgaagaggagaaaggttccatgtgaacggcacttgcacatgggtaagcgcctgccggaagtagaatcattcgattccccaaagcgaaatccgcagcctcgcctctctcgccattttccaggcgcgcgctcgtcgcggccgccgccagcgatccagatccttgcacggacacaaggtctcaccggctcagcgctccccaccggatcggatcccgtcccgatggctcccactcccactcccactcacacggcggcggcggtggcgctcgccgcgcacgactcgtccggccacctcgcgccgctcaccatcacccgcaggagcaccggggacgacgatgtagcgataaagatcctgtactgtgggatgtgtcactctgaccttcacagcatcaagaacgagtggcacaacgccacgtaccccatggtccctggtcacgagatcgccggagtggtgacggaggtgggcaagaacgtgaccagcttcaaggccggggaccgcgtcggcgtgggctgcatggtgaactcgtgccagtcgtgcggcagctgcgacgaggacttcgagaacagctgccgggccgtcatcttcacctacaactccgtcgaccgcgacggcaccgtcacctacggcggctactccagcagcgtggtggtgcacgagcgcttcgtggtccggttccccgacgcgatgccgctggatcggggggcgccgctgctgtgcgcgggcatcacagtgtacagccccatgaagtaccacggcctgaacgtgccggggaagcacgtcggcgtgatggggctgggaggcctgggccacgtcgccgtcaagttcgccaaggcgttcggggccaaggtcacggtcatcagcacgtcgcctgggaagaagcaggaggcgctcgaccggcttggcgccgacgccttcgtcgtcagcaaggacgccgaagaaatgaaggcggctgcgagcaccatggacggcatcatcaacacggtgtcggcgaacctcaccttggccccgtacatgggcctgctcaagcccaacggcaagatgatcatggtcggcctgcccaccaagcctctcgagatcccgccctttgatctcatcattgggaacaagaccctggccgggagctgcatcggcggcatgagggacacgcaggagatgatcaacgtggcggccaagcacggcgtgacgacggacatagaactggtggccgcggactacgtgaacacggccatggagcgcctggccaaggctgacgtcaggtaccgcttcgtcatcgacatcggcaacaccctcaagaattcagagtaatcagacctaaaacgccggcgacacctctactgctgctgcttgttgtgccctgtcggctttatacgatgaaccgcgtccttttttttctgtgtcagtgataatattttagctaaggcagacgtaaacgtagttcgcgaggattgccttcccatgcatgttatggaagttggatgcttttattgttgttgccgtaaaacgagatatgatgcagcatttttttattttccctctaaaaaaaaaaaaaaaaa

SEQ ID NO: 76872 - protein, 421 aa, Zea mays
  misc_feature: Ceres CLONE 1561716
  misc_feature (243)..(378): Pfam Name: ADH_zinc_N Pfam Description: Zinc-binding dehydrogenase
  misc_feature (97)..(212): Pfam Name: ADH_N Pfam Description: Alcohol dehydrogenase GroES-like domain
  misc_feature: SWISSPROT Homolog: EC 1.1.1.255 Mannitol dehydrogenase
MGKRLPEVESFDSPKRNPQPRLSRHFPGARSSRPPPAIQILARTQGLTGSALPTGSDPVPMAPTPTPTHTAAAVALAAHDSSGHLAPLTITRRSTGDDDVAIKILYCGMCHSDLHSIKNEWHNATYPMVPGHEIAGVVTEVGKNVTSFKAGDRVGVGCMVNSCQSCGSCDEDFENSCRAVIFTYNSVDRDGTVTYGGYSSSVVVHERFVVRFPDAMPLDRGAPLLCAGITVYSPMKYHGLNVPGKHVGVMGLGGLGHVAVKFAKAFGAKVTVISTSPGKKQEALDRLGADAFVVSKDAEEMKAAASTMDGIINTVSANLTLAPYMGLLKPNGKMIMVGLPTKPLEIPPFDLIIGNKTLAGSCIGGMRDTQEMINVAAKHGVTTDIELVAADYVNTAMERLAKADVRYRFVIDIGNTLKNSE

SEQ ID NO: 76873 - DNA, 797 bp, Zea mays
  misc_feature: Ceres CLONE 1561717
  misc_feature: Encodes the peptide sequence at SEQ ID NO. 76874
ctggagctccccgcggtggcggccgctctagaactagtggatcccccgggctgcaggaattcgtctcacccctagaaaaattgcctatcaaccgctactcacgccgtactgtctgatcggcaacacctcgtgtacacgtaggcccggagatatggcggcatcgccggtggccatcggcacggcggtgttccagcgggggccactccgcgtggaggcgaggcacgtcgactacagccaggtccccagcgtgcccaagccgctcatggtggtcgcccccaccgacgccggcgtctaccccgtggccgtcttcctgcacggctgcaacacggtcaacagctggtatgagagcctcctgtcgcacgtcgcgtcccacgggttcatcgccgtggcgccccagctctactgcgtgacgctcaacatgaacgacttgaaggacatcgacgccaccaggcaggtcaccgcctggctcgccgacaagcagcaaggccctggcgcacgtgctcgccaacatcctccagctccacgtgcgtgaggccggacctctccaggctggcgctggccggccacagccgcggcggcgacacggccttcgccgtggcactcgggctcggacccgccgcctcggacgacgacgtactacacgcagacgcaggcacatcggccggcggcgttgccactcaagtctccgcgcctgatcggcgctggacccccgtggcggggctatcatagcatgcgcaggtgggagccgaaaagtgctgaaccttccgggccccggtcccttgaacccggggatgcgg

SEQ ID NO: 76874 - protein, 126 aa, Zea mays
  misc_feature: Ceres CLONE 1561717
  misc_feature: SWISSPROT Homolog: EC 3.1.1.14 Chlorophyllase
MAASPVAIGTAVFQRGPLRVEARHVDYSQVPSVPKPLMVVAPTDAGVYPVAVFLHGCNTVNSWYESLLSHVASHGFIAVAPQLYCVTLNMNDLKDIDATRQVTAWLADKQQGPGARARQHPPAPRA

SEQ ID NO: 76875 - DNA, 799 bp, Zea mays
  misc_feature: Ceres CLONE 1561719
  misc_feature: Encodes the peptide sequence at SEQ ID NO. 76876
ctccccgcggtggcggccgctctagaactagtggatcccccgggctgcaggaattcgtctcacccctagaaaaaatcccattccataccattccgccaaagaagaaccacagacgctcgctcccaactcccaagccaagccggatcccaaaatcggcacagcgcacccactccgctcagtcccttcgttcacccccatccatccagccagccagccagccatgggcggcaaggactgcggcaaccacggcgaggacgacctgcggcggtcgtgccggcgcctgctagcgatcctcctagtcctggccctgatcgtgggcgtgatcgcgctgatcatctacctggtggtccgccccacgcacccgcgcttctacctgcaggacgcgtcgctgcagcagctagacctctccaacgccaccaccaccaccaccacctccgcgtcctcgtccctcctctccacgacgctgcaggtgacgctggcctcgcgcaacccgaacgagcgcgtgggggtgtactacgaccggctggacgtgtacgcgtcgtacaagtaccagcaggtgacggtggccgcggcgctgccgcccgtgtaccagggccacggcgacgtggacgtgtggtcgcccgtgctctccggccccggcgtccccttcgcgccctacctggccgacgcgctctgccaggactgccaggcggggctacctcgtccctccagtcaaggtcgacggccgcgtgcaatggaaagtcggcaaactggatctccgggcaacaccaccttcttcgtcacctggccccgcgtttca

SEQ ID NO: 76876 - protein, 193 aa, Zea mays
  misc_feature: Ceres CLONE 1561719
  misc_feature (40)..(180): Pfam Name: Hin1 Pfam Description: Harpin-induced protein 1 (Hin1)
MGGKDCGNHGEDDLRRSCRRLLAILLVLALIVGVIALIIYLVVRPTHPRFYLQDASLQQLDLSNATTTTTTSASSSLLSTTLQVTLASRNPNERVGVYYDRLDVYASYKYQQVTVAAALPPVYQGHGDVDVWSPVLSGPGVPFAPYLADALCQDCQAGLPRPSSQGRRPRAMESRQTGSPGNTTFFVTWPRVS

SEQ ID NO: 76877 - DNA, 1027 bp, Zea mays
  misc_feature: Ceres CLONE 1561721
  misc_feature: Encodes the peptide sequence at SEQ ID NO. 76878
agctccccgcggtggcggccgctctagaactagtggatcccccgggctgcaggaattcgtctcacccctagaatatgacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcatgggcatgcgccgcggggccacagcgctgctgcgcgcccgcagcgtcactgacgacgacctcgacgagctccgcgtctgcatcgacctgggcttcggcttcgagcccgcacccgccgccgcgtgcgcctgcacctgcgccgggaggaaccgcctcctggagacgctgcccgcgctctacctctactacgccgcccacagccgggctagcggatgcaccccccctgcacagcgcagcgcccccttcttacgcctcccccctcctacgcattcgcctctcttgccacccccctgtcccatacttccctccactgccaccccccccgactacctgttaacatgccctcccaatacccttcttcccccccgcgagcttcccccatttccattcccttaacccccccaccttattctcctcctaggcccacccgcccccagccttcccttttttctcccttcccccccattaacaacaatataacccaccccccgaggccccttactcccccctcatactatatccctatttccccagccccgccgccccttcgtctgcacatcactcacttcataaataaaatcactccccctactttccctcatcccataccgacctaggtcccctccgcgactttcccactctcctctttatgcgtcccctttcacacataccaacctcacaccctctctctccttccctcctatttcctcttcctcactccatttattaaattct

SEQ ID NO: 76878 - protein, 174 aa, Zea mays
  misc_feature: Ceres CLONE 1561721
  misc_feature (21)..(123): Pfam Name: DUF1685 Pfam Description: Protein of unknown function (DUF1685)
MEKAGQQRHVIGGGGKKAPALGLQKQNSWSPDIERDEAWERRRMGMRRGATALLRARSVTDDDLDELRVCIDLGFGFEPAPAAACACTCAGRNRLLETLPALYLYYAAHSRASGCTPPAQRSAPFLRLPPPTHSPLLPPPCPILPSTATPPDYLLTCPPNTLLPPRELPPFPFP

SEQ ID NO: 76879 - DNA, 681 bp, Zea mays
  misc_feature: Ceres CLONE 1561722
  misc_feature: Encodes the peptide sequence at SEQ ID NO. 76880
ctccccgcggtggcggccgctctagaactagtggatcccccgggctgcaggaattcgtctcacccctagaaaaagtgcacttcaagcttcctccgcggcctcccgtcgagcaaccatggcggcggcggtaaccctcctccgccttcctctcgcccgactctcctaccacctccgctccgtaccttcctctcgtctgccgtctccgcgcctacgtatctttgcctcccatcgccttttctcctccctggaccatgtctccgcctctgcttccgcctccgcggccgtggccgaggttgtaggcgtgccggacgcggaggagtcggtagaggaggaatctgcggccgaggcggaggcggaggcgcccaggtcgttcgtgctcccacggctgccgcggccgaagctgagcgtgaaggagcggaaggagctggcctcgtacgctcacgggcctcgcaaaaagctcaaatccgcaccaggtcgggtaagagcgggcgtcacacccgaacccttggtcctccccccttcaggtggacaaaccctccgagttccaaaagagaggccccctaaaagcctaaaaaattttccttgggggaaaacctggcccccggggggggggggccccccccccgggaaccggggtaaaaccggggcaaacccttgtgggggggggggcccacaccgggg

SEQ ID NO: 76880 - protein, 188 aa, Zea mays
  misc_feature: Ceres CLONE 1561722
MAAAVTLLRLPLARLSYHLRSVPSSRLPSPRLRIFASHRLFSSLDHVSASASASAAVAEVVGVPDAEESVEEESAAEAEAEAPRSFVLPRLPRPKLSVKERKELASYAHGPRKKLKSAPGRVRAGVTPEPLVLPPSGGQTLRVPKERPPKSLKNFPWGKTWPPGGGGPPPGNRGKTGANPCGGGGPHR

SEQ ID NO: 76881 - DNA, 822 bp, Zea mays
  misc_feature: Ceres CLONE 1561723
  misc_feature: Encodes the peptide sequence at SEQ ID NO. 76882
  misc_feature (664)..(664): n is a, c, t, g, unknown, or other
  misc_feature (754)..(754): n is a, c, t, g, unknown, or other
ctggagctcaccgcggtggcggccgctcctagaactagtggatcccccgggctgcaggaattcgtctcacccctagaaaaaacaggtcgcaacaacccccaacgagcaaaccccccatttgccaccaaccccgacgagcggcgatgaccggcacggtgtctaagctggcggcgccccgtccggcggcaccgccgctccggccggcgtccctccgcaccgccgccctcgccttcgccccctccgcgcgccgggtccgcgtctccgtcgccgggcgagccaggagccccatcattgcgatggcttcggccaaggaaggaaatggtgcaccgaccaagaggactgcgcttcatgatctctacgagctccagggcctgtccccgtggtacgacaacctatgccgccctgtcacagacttgctgcccattatcgccagcggcgtccgtggagtcaccagcaacccaacgattttccaaaaggccatttcatcgtccagcgcatatgatgatcagttcaagcagctcatttcggctggaaaggacgcggagagcgcttactgggaactcgttataaaggatatccaagatgcgtgcaaactttttgagcccatctacgatgagactgatgggggctgatgggtatgtctcccgtagaaggtgtctcctangttggcaatgacactcaagggaactgtgaagcggcaaagtggttacacaaagtggtcaaccgccccatgtctacataaagatccagctanctgcagaatgtgttccttcccatccagaaagtatcgctaatggcatttagcgtcaacgtcacgcttat

SEQ ID NO: 76882 - protein, 162 aa, Zea mays
  misc_feature: Ceres CLONE 1561723
  misc_feature: SWISSPROT Homolog: EC 2.2.1.2 Transaldolase
MTGTVSKLAAPRPAAPPLRPASLRTAALAFAPSARRVRVSVAGRARSPIIAMASAKEGNGAPTKRTALHDLYELQGLSPWYDNLCRPVTDLLPIIASGVRGVTSNPTIFQKAISSSSAYDDQFKQLISAGKDAESAYWELVIKDIQDACKLFEPIYDETDGG

SEQ ID NO: 76883 - DNA, 926 bp, Zea mays
  misc_feature: Ceres CLONE 1561724
  misc_feature: Encodes the peptide sequence at SEQ ID NO. 76884
ccccgcggtggcggccgctctagaactagtggatcccccgggctgcaggaattcgtctcacccctagaaaaagccagcgaaccaactattcgtttgcttttcgtcttcgtcctctctttgcccaattgtcggtcgcccgcgccgtcgtctccgctccgccggccttcctgcgaaaccctagcgaggcgagcgagagagaaactagcggccatgttcggctacaggaaggctgacccggacctcgaggccggcgggtcctcgctgctgtacccgggaatgacggagagccccgagctgcggtgggcgttcgtccgcaagatctacgtcatcctagccgtccagctcgccatgacggccgcggtctccgccttcgtcgtcaaggtgcccgccgtctccaacttcttcgtctcctccaacgccggggtcgcactctacatcttcctcatcatcctgcctttcctcgagctgtgccctctgcgctactaccaccagaagcatccggtcaatctgctgctgctcggcctcttcaccgtcgccatcagctttcccgtcggcatgacatgcgctttcactagcggcaaaatcattttggaggctgccattcttacagcagtggtggtgatcagcttaactgcgtacactttccaggctgcaaagagggttcatgatttcaacttccctcgtcccttcctatttgctgctatcatggggctcctggtgttttccctaatccaagacctttttcccgcctggggaagatacctggggaggatttacgggggggttgggcatcgcctttccttccggggggaaccccctccttggaaccgggaaattggtcttcaagcggcttcccccctcagagagaaacctattgggggcgggggtgttttcccccttcacttggacgcgctatcaacacgtgt

SEQ ID NO: 76884 - protein, 238 aa, Zea mays
  misc_feature: Ceres CLONE 1561724
MFGYRKADPDLEAGGSSLLYPGMTESPELRWAFVRKIYVILAVQLAMTAAVSAFVVKVPAVSNFFVSSNAGVALYIFLIILPFLELCPLRYYHQKHPVNLLLLGLFTVAISFPVGMTCAFTSGKIILEAAILTAVVVISLTAYTFQAAKRVHDFNFPRPFLFAAIMGLLVFSLIQDLFPAWGRYLGRIYGGVGHRLSFRGEPPPWNREIGLQAASPLREKPIGGGGVFPLHLDALSTR

SEQ ID NO: 76885 - DNA, 831 bp, Zea mays
  misc_feature: Ceres CLONE 1561726
  misc_feature: Encodes the peptide sequence at SEQ ID NO. 76886
agctccccgcggtggcggccgctctagaactagtggatcccccgggctgcaggaattcgtctcacccctagaaaaagtgatccaaccaaagaccctatccaaaaccagaggcaagccaagacgcaagctgcaagcacgcgctcgtgcccgcgccatgaagtgctggtgcgtgcacgcgccaaggggagcaatggcgacgccgctctccagccccttggctcccaccgccctccgctcccctctccggcaccgcgccctgctgctgctgctgccgttccctccccgtgcggcctcctccggcgaggacaccgccgcagcagccgaccaggagccggccccggcggccaccaagacggccaccgcggacgacgacttcgaggagcgcgtgctacggatcaagtcccgcgtcgggcccaagaagcgcggcgcgcgcaagaagaaggccgcggcgtccgcgtcagccagcgccgtgacgctcccgcccgtgccgctgcgggagccccggtcggcgctcggcgcgcccgtcgagctcggcttcaccgcgtacagcgagaggctcaacggcgcgctggccgcgctggggctcgccgcggtgctgctcgtggagctgggctccgggcaggccctggtgaagtaccaccagccggccacgctgttcctgcaggcgtacaccgtcgctgcggccgccgcgctgttcatcaagtacgagaaggagcggatcagcacgtggccgggggccgccgcaaaggagaaaaaatggcgttgctcccggcgccgaatcttacttgtacttttacccccttgaaatgattgggcacggcaggggatatt

SEQ ID NO: 76886 - protein, 216 aa, Zea mays
  misc_feature: Ceres CLONE 1561726
MKCWCVHAPRGAMATPLSSPLAPTALRSPLRHRALLLLLPFPPRAASSGEDTAAAADQEPAPAATKTATADDDFEERVLRIKSRVGPKKRGARKKKAAASASASAVTLPPVPLREPRSALGAPVELGFTAYSERLNGALAALGLAAVLLVELGSGQALVKYHQPATLFLQAYTVAAAAALFIKYEKERISTWPGAAAKEKKWRCSRRRILLVLLPP

SEQ ID NO: 76887 - DNA, 764 bp, Zea mays
  misc_feature: Ceres CLONE 1561730
  misc_feature: Encodes the peptide sequence at SEQ ID NO. 76888
  misc_feature (764)..(764): n is a, c, t, g, unknown, or other
ctccccgcggtggcggccgctctagaactagtggatcccccgggctgcaggaattcgtctcacccctagaaaaatctcgaagtcgactcctattcttatcgccccgaaggcggtctccactctctacagacagccgccaccgccgccggtggttcacaagcagccggtaggtactcaacccaaaccgcaaggaggacacggaacccaaattccagcacgactcctccagccagcagcccaagcgaacctagggcccttgagctccctcccgcatggcgttcccgtggtgcctctcggctccggccgccgtcccgcctgtggcgcccgcgcccgcgcccgcgcccggcgcctttggcgtctccgcgtcggtcaccgccctagcgcgtgtgccggttctcgccggtaggcggcgcaggtggagcacgctcgtggtccgcgcggcccccgacgaggagaagattaccaagcggtcgcccctcgatttccccatcgaatgggagagaccaaagcctgggaggagacctgatatcttccctaagttcagcccaatgaagacaccattaccacatccgttaccagctgatgatcctttggatgatgatcaagaggaggaagaggaagaacaaccaccaccgcaggaggagccacaagaggatgatccagacaaggaagaacctgaggaagatgacccggacaagccaaccgagtaacttctggatggcttgaactgttgtggtagatataggcagcgggcaaacatgtgn

SEQ ID NO: 76888 - protein, 145 aa, Zea mays
  misc_feature: Ceres CLONE 1561730
MAFPWCLSAPAAVPPVAPAPAPAPGAFGVSASVTALARVPVLAGRRRRWSTLVVRAAPDEEKITKRSPLDFPIEWERPKPGRRPDIFPKFSPMKTPLPHPLPADDPLDDDQEEEEEEQPPPQEEPQEDDPDKEEPEEDDPDKPTE

SEQ ID NO: 76889 - DNA, 838 bp, Zea mays
  misc_feature: Ceres CLONE 1561731
  misc_feature: Encodes the peptide sequence at SEQ ID NO. 76890
  misc_feature (513)..(513): n is a, c, t, g, unknown, or other
  misc_feature (771)..(771): n is a, c, t, g, unknown, or other
ggagctccccgcggtggcggccgctctagaactagtggatcccccgggctgcaggaattcgtctcacccctagaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcggncaggccacgtacctgggcgccccccggtgccgtggggcacgctgccgaccattctgggtgaatcgagttcgtggccatcgccttcgccgagcaccagcgccccatgggagaaggaccccgagaagaagatgtacccccggcggcgcccttcgacccgctcggctttctcaatgggacccgccaagttcgaggagtcaagctcaaggagatcaagacgggcgcctcgccatggctggccttcgtcgggcttctgcgtcnaggaaattcggggtacccccggcaccgggcccgcttggagaccctcggcttccaaccttgggcggac

SEQ ID NO: 76890 - protein, 233 aa, Zea mays
  misc_feature: Ceres CLONE 1561731
  misc_feature (54)..(205): Pfam Name: Chloroa_b-bind Pfam Description: Chlorophyll A-B binding protein
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGNWVKAQEWAAVPGGQATYLGAPRCRGARCRPFWVNRVRGHRLRRAPAPHGRRTPRRRCTPGGALRPARLSQWDPPSSRSQAQGDQDGRLAMAGLRRASASRKFGVPPAPGPLGDPRLPTLGG

SEQ ID NO: 76891 - DNA, 945 bp, Zea mays
  misc_feature: Ceres CLONE 1561741
  misc_feature: Encodes the peptide sequence at SEQ ID NO. 76892
ccttgctgtagctcaccgcggtgggcgccgcttcagactagtggatcccccgggctgctgcgaattcgtctcacccctagaaaaaagccgcggcagcaccgccacctacgccggcagaatccttgatcgagacaggagcggacgtggcctagggtttctgagccaggccggcgccatggtgggctgctctaggggctccctccccacctggatgaccgccgccgccgcgcgggtcgacctctctggcggcgtaacgccttcgcaccagggctcgccctctccacctcactcctcctcgggtcccgctccggccgcgggggcggaccagcagctcgggttgttcgagcgcgcgctctccgccgccggcgccgcctgcgtctcagctatcatcgtctaccctctcgatgctgccaagacgaggctgcaggctccagccgcaggggtgctgtaccaccagcctgcccagatgggggcgctcggccccgaggcgatggtgggccgagtgccaaggtgtccctctagcgcacgggtgggggctcctcacagggaaagtttgccaagtctgggagctcctggattgcgttaccgagttgaaaggggaaaacagggaaggggcttccccttctgaatgtgcccttaatatggaggatggggacatttggccgcgtggagcattgcaacactgtgcgtcagcgccatgcattccggtacgaggcgcaagaggggaacggacaaaatgtggtggaaattggagaagggtaaagcatctttagggggggatgtaagtcgactatgagtgggggggggatataagtgccgcatcgtagcggcggacagatgacccggatgcgctttcgatttttgttggtttagacatagatcgctgaagtgacaaccgggacgttgtatggttgtgtgtgactggagttcgcatgtcgtgttttt

SEQ ID NO: 76892 - protein, 150 aa, Zea mays
  misc_feature: Ceres CLONE 1561741
MVGCSRGSLPTWMTAAAARVDLSGGVTPSHQGSPSPPHSSSGPAPAAGADQQLGLFERALSAAGAACVSAIIVYPLDAAKTRLQAPAAGVLYHQPAQMGALGPEAMVGRVPRCPSSARVGAPHRESLPSLGAPGLRYRVERGKQGRGFPF

SEQ ID NO: 76893 - DNA, 826 bp, Zea mays
  misc_feature: Ceres CLONE 1561742
  misc_feature: Encodes the peptide sequence at SEQ ID NO. 76894
  misc_feature (703)..(703): n is a, c, t, g, unknown, or other
agctccccgcggtggcggccgctctagaactagtggatcccccgggctgcaggaattcgtctcacccctagaaaaatcaagacctccgtcaagaacacggtgacccaggtggccaagaaggtgctgaccatgaacccctcgggggacctctccagcgcgcgcttcagcgagaaggagctcatcaccgccatcgaccgcgaggccgtgttcacgtacgcggaggacgcggccagcgccagcctgccgctgatgcagaagctgcgcgccgtgctggtggaccacgccctcagcagcggcgacgcggagcgcgagccctccgtcttctccaggatcaccaagttcgaggaggagctccgcgcggtgctgccccacgaggtggaggccgcccgcgtcgccgtcgccgagggcaccgcccccgtggccaaccggatcgcggacagccgctcgttcccgctgtaccgcttcgtgcgccaggagctcggctgcgtgttcctcaccggcgagaagctcaagtcccccgggcgaggagtgcaacaaggtgttcctcggcatcagccagggcaagctcgtcgaccccatgctcgagtgcctcaaggagtgggacggcaagccgctgcccatcaacatcaactaaaagacgccaggcgccgccatccatgctgccgcccgcgcatggccggaggagaagaggaaaatacatganaaaataaaacttgtacacgtgtatgtctccagattgtgccaccgtcgttctcgtcgttgacttttggttgtatggtcgatccatatgtgtgtgccgtgtgtggcgtttgttctttcttctttg

SEQ ID NO: 76894 - protein, 190 aa, Zea mays
  misc_feature: Ceres CLONE 1561742
  misc_feature: SWISSPROT Homolog: EC 4.3.1.5 Phenylalanine ammonia-lyase
MNPSGDLSSARFSEKELITAIDREAVFTYAEDAASASLPLMQKLRAVLVDHALSSGDAEREPSVFSRITKFEEELRAVLPHEVEAARVAVAEGTAPVANRIADSRSFPLYRFVRQELGCVFLTGEKLKSPGRGVQQGVPRHQPGQARRPHARVPQGVGRQAAAHQHQLKDARRRHPCCRPRMAGGEEENT

SEQ ID NO: 76895 - DNA, 771 bp, Zea mays
  misc_feature: Ceres CLONE 1561743
  misc_feature: Translation starting site: 166
ctcaccgcggtggcggccgctctagaactagtggatcccccgggctgcaggaattcgtctcacccctagaaaaactctgtctctctaggtttttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgacgatgatgatgaccttgatctttctggtgatgaaactgaggaggacaagaacgcagctgatgagcgtgccgccgctgccaaggcctcttctaaaaagaaagaaagtggtaatcctccgtccttatggatgtcaaaccatgggacgatgagactgatatgaagaagctggaggaggctgtccgcaatgtccagaatggagggtctgacttgggggagcattcaaaccttgtgccctgttgggatacggcatcaagaagatggactatcatgtgtgacaatttggcgaaccatctttgtgtccctccgaccctcttatttggaggaccaa

SEQ ID NO: 76896 - DNA, 840 bp, Zea mays
  misc_feature: Ceres CLONE 1561745
  misc_feature: Encodes the peptide sequence at SEQ ID NO. 76897
ctccccgcggtggcggccgctctagaactagtggatcccccgggctgcaggaattcgtctcacccctagaaaaactctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggttgggaaggggatctgttcccgctgttaccggaggccttcaagggaatcaaacagatcggtgtaatcggctggggctcgcagggtcctgcacaagctcagaacttgagagactcacttgttgaggcaaagtcagatattgttgttaagattggtctccggaaaggttctaaatcttttgaagaagcccgagcagcaggattcaccgaagagagtgggacgctgggtgaatatatgggagactgtatcaaacagtgatcttgtttttgctactgatatctgattctgctcaggctgataactacgagaaaaatttctcgcacatgaaaaccaacagtatttctgggtttggcacatggaatttctccttgggaacattgcacatctcccgggggttttgattttccccaaaaaaaatcagttgggggttgctgttatgccccca

SEQ ID NO: 76897 - protein, 177 aa, Zea mays
  misc_feature: Ceres CLONE 1561745
  misc_feature: SWISSPROT Homolog: EC 1.1.1.86 Ketol-acid reductoisomerase
MAAATSSSTYLAIGRKTLSPAPSVATAATSVSFPATQHPCLVAASADRRRAVAAKVSSPSVIGTAMPSLDFETSVFKKEKVSLAGHEEYIVRGWEGDLFPLLPEAFKGIKQIGVIGWGSQGPAQAQNLRDSLVEAKSDIVVKIGLRKGSKSFEEARAAGFTEESGTLGEYMGDCIKQ

SEQ ID NO: 76898 - DNA, 839 bp, Zea mays
  misc_feature: Ceres CLONE 1561746
  misc_feature: Encodes the peptide sequence at SEQ ID NO. 76899
ggagctccccgcggtggcggccgctctagaactagtggatcccccgggctgcaggaattcgtctcacccctagaaaaactccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatgggggtggggtggagtcgagccgggtggggtggacttcttcaacccggactcccaggccgtggagtgggccaccgccgtgggtcgcgcaccgctgaagaactcgcccacttcaccggcgagcagggctaccccgggcggcagttctttcgacccgctcggccctcggccggacccgtcaagggacggcgtctaactttccccgacgtcgaaaaagctcgaggggctcaaagcgggccaaaaattcaacacggcccgcatcggccatggcttggccagggttct

SEQ ID NO: 76899 - protein, 233 aa, Zea mays
  misc_feature: Ceres CLONE 1561746
  misc_feature (54)..(217): Pfam Name: Chloroa_b-bind Pfam Description: Chlorophyll A-B binding protein
MALAPTSAAVLKTPFLGARRALAKPAPRRALVIAAAAAAKKSWIPAIKSDAEIVNPPWLDGSLPGDFGFDPLGLGKDPAFLKWYREAELIHGRWAMAAVLGIFVGQAWSGIPWFEAGADPSAIAPFSFGSLLGTQLLLMGVGWSRAGWGGLLQPGLPGRGVGHRRGSRTAEELAHFTGEQGYPGRQFFRPARPSAGPVKGRRLTFPDVEKARGAQSGPKIQHGPHRPWLGQGS

SEQ ID NO: 76900 - DNA, 834 bp, Zea mays
  misc_feature: Ceres CLONE 1561749
  misc_feature: Encodes the peptide sequence at SEQ ID NO. 76901
  misc_feature (410)..(410): n is a, c, t, g, unknown, or other
  misc_feature (419)..(419): n is a, c, t, g, unknown, or other
ggagctccccgcggtggcggccgctctagaactagtggatcccccgggctgcaggaattcgtctcacccctagaaaaaacagcgccacgccacacgcaacgcaagcagctgcttctctctttccgctccgcaggccgcagcgcccatcaagagcgagaagccctgtcgcgcgcggagacgatggaagggccggcggcggcggaggcggagaacggcggcgcgggcaaggggtccggcagcaggttcaggcgggtgtgcgtgttctgcgggagcagctccggcaagcgcagcagctaccgggacgccgccgtcgagctcggcaaggagctggtgtcgaggaaggtgggatttggtgtacggcggaagcagcctggggctcatggggggaggtctcccgaggccgtgcacanggggcggcnggccatgtcattgggcatcatacccgaccagtctcatggggaaaggagatcaccgggggagaacgtgggcccaaggttgcgggcccttgggcgggggatgccaccagcgcaagggcggaaaaatggccccgcaaactcccatatgccttccatcgggcctccccgggggaatccctcccgggccgggttgggatccgaatcacccggccccttaggctcccgggaaacctaagctaagaaagcccggggagaaacccgtttgaaacccctggcatggtaccgggggtattggggggtttttgtgttttaaattttgccaggggggggggaatccggggaccccgtgggaaaaaaaaccccccccggggaagggggaattctcccccggggggggccccccctgtgggggaatacc

SEQ ID NO: 76901 - protein, 156 aa, Zea mays
  misc_feature: Ceres CLONE 1561749
  misc_feature (77)..(77): Xaa is any aa, unknown, or other
  misc_feature (80)..(80): Xaa is any aa, unknown, or other
MEGPAAAEAENGGAGKGSGSRFRRVCVFCGSSSGKRSSYRDAAVELGKELVSRKVGFGVRRKQPGAHGGRSPEAVHXGRXAMSLGIIPDQSHGERRSPGENVGPRLRALGRGMPPAQGRKNGPANSHMPSIGPPRGNPSRAGLGSESPGPLGSRET

SEQ ID NO: 76902 - DNA, 956 bp, Zea mays
  misc_feature: Ceres CLONE 1561751
  misc_feature: Encodes the peptide sequence at SEQ ID NO. 76903
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (33)..(33): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
ggggggggggnnnnaaacnnnnnnggnnanggngnggggggnnnnnnnnnnnnnnnnnnnnnnnnnnnnnnnnnnccaaaactggagctccccgcggtggcggccgctctagaactagtggaatcccctcgggctgcaggaattcgtctcacccctagaaaaaccccgtctcctctcctctcctctcccccgcatccacggccgcaggccgcagccagccactcgacgatctagtcgtctctctctccccgctctgccgcctcgctgccgcggcttcccgtcggctggaggatgaaggtcacggtcgtgtcccggagcggccgggaggtcgtcaagggcggcatcgacctcaaggactcggccaaggtcgcggacctgcaggaagccatccatgccagggactaaaaagtattatcccttctagggaggggctccaccctccccccttcaaacctggaaaaaggccggaaagcccagtttgtccccccattcccaaaaggcccagcccttggttaaaaaaacacttgcaaaaaaaggggtttcttggggctccactgaacaaggggggtcctttccaaaaaaattttagggggcccccaagggggttttatttaaaaagaaaaaaaccggggtttttttttctttttcaaaaaagaaccccgggggggccccccttctcctttaattattttacccccccccggggggtgtccccaacaaaataggggcgcgcgggcgggtttaacaaaaaaaaataaatctctctcgggggggaaccaaaaagggggggggaaaaagaggggcccccaattaccacccccctctttttttttaaaaaaacaacaacccccccgcccccggaggacaccccacggggggggggggtgtcttcccccccccaattttttgaaaaagagggggggtttttatgttggggggagaaaaaaatctttttc

SEQ ID NO: 76903 - protein, 37 aa, Zea mays
  misc_feature: Ceres CLONE 1561751
MKVTVVSRSGREVVKGGIDLKDSAKVADLQEAIHARD

SEQ ID NO: 76904 - DNA, 871 bp, Zea mays
  misc_feature: Ceres CLONE 1561752
  misc_feature: Encodes the peptide sequence at SEQ ID NO. 76905
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (373)..(373): n is a, c, t, g, unknown, or other
  misc_feature (374)..(374): n is a, c, t, g, unknown, or other
  misc_feature (379)..(379): n is a, c, t, g, unknown, or other
  misc_feature (380)..(380): n is a, c, t, g, unknown, or other
  misc_feature (383)..(383): n is a, c, t, g, unknown, or other
  misc_feature (407)..(407): n is a, c, t, g, unknown, or other
  misc_feature (436)..(436): n is a, c, t, g, unknown, or other
  misc_feature (641)..(641): n is a, c, t, g, unknown, or other
agctccccgcggtggcggccgctctagaactagtggatcccccgggctgcaggaattcgtctcacccctagaaaaaacactcgcttgagcatatagtgtgctcttctcttcctcttccagttggtattctttatctgaaacatagtacagaggaggagaggagaacgagagctaagaagatgaccggcaaggttctccttgtggccgtccttatcttggtgggcgtggcctctcgatgctcgggcagtaggggcctgcagggcgatcacgttgctgaacagaagttcggtggcggtggctatggaggtggcggtgggtacggaggctacggcggcggtggaggagaggtggtttggtggggtatcnnncctgnngctcnntgngggaggtctccgaggccgtcgccnggggcgggcggccatgtctttgggcctcntaccggcccggtctcctggggaaaggagatcacccggggagaacggtggggcaaggtgccgggcccgtggcggggggatgcaccagcggcaagggcggagaatgggcgcccaacttcccaatggccttcatccgcgcttccccgggtaattccctcctggcctgtttgcaatcgaatcaaccccccccctaagctcccggaaccnttagcttatgcaggcgcggcgcaacccccggtttaaagcccttggccatggaaccagttataaagggggttttgttatttaaaatttgccgggcggggatcccgggatacctctggagaaaaacccccccgggaagggataatcccgggggggccccaacctgggggcaccccaacaaaaaaaacccggggggggcgctcgctaaaaaaagtggaaaggggggatcctac

SEQ ID NO: 76905 - protein, 165 aa, Zea mays
  misc_feature: Ceres CLONE 1561752
  misc_feature (63)..(63): Xaa is any aa, unknown, or other
  misc_feature (65)..(65): Xaa is any aa, unknown, or other
  misc_feature (67)..(67): Xaa is any aa, unknown, or other
  misc_feature (68)..(68): Xaa is any aa, unknown, or other
  misc_feature (86)..(86): Xaa is any aa, unknown, or other
MTGKVLLVAVLILVGVASRCSGSRGLQGDHVAEQKFGGGGYGGGGGYGGYGGGGGEVVWWGIXPXAXXGRSPRPSPGAGGHVFGPXTGPVSWGKEITRGERWGKVPGPWRGDAPAARAENGRPTSQWPSSALPRVIPSWPVCNRINPPPKLPEPLAYAGAAQPPV

SEQ ID NO: 76906 - DNA, 1202 bp, Zea mays
  misc_feature: Ceres CLONE 1561753
  misc_feature: Encodes the peptide sequence at SEQ ID NO. 76907
  misc_feature (11)..(11): n is a, c, t, g, unknown, or other
  misc_feature (62)..(62): n is a, c, t, g, unknown, or other
  misc_feature (74)..(74): n is a, c, t, g, unknown, or other
  misc_feature (75)..(75): n is a, c, t, g, unknown, or other
  misc_feature (348)..(348): n is a, c, t, g, unknown, or other
  misc_feature (685)..(685): n is a, c, t, g, unknown, or other
  misc_feature (703)..(703): n is a, c, t, g, unknown, or other
  misc_feature (722)..(722): n is a, c, t, g, unknown, or other
  misc_feature (738)..(738): n is a, c, t, g, unknown, or other
  misc_feature (742)..(742): n is a, c, t, g, unknown, or other
  misc_feature (755)..(755): n is a, c, t, g, unknown, or other
  misc_feature (779)..(779): n is a, c, t, g, unknown, or other
  misc_feature (793)..(793): n is a, c, t, g, unknown, or other
  misc_feature (829)..(829): n is a, c, t, g, unknown, or other
  misc_feature (833)..(833): n is a, c, t, g, unknown, or other
  misc_feature (841)..(841): n is a, c, t, g, unknown, or other
  misc_feature (868)..(868): n is a, c, t, g, unknown, or other
  misc_feature (882)..(882): n is a, c, t, g, unknown, or other
  misc_feature (907)..(907): n is a, c, t, g, unknown, or other
  misc_feature (1135)..(1135): n is a, c, t, g, unknown, or other
  misc_feature (1202)..(1202): n is a, c, t, g, unknown, or other
ggggggggggnggggggggggtttaaaccaaaaataaatctactataaaacaaaatatcaanggtgggggggtnnttgttggggctcaccgcggtggcggccgctctagactagtggatcccccgggctgcaggaattcgtctcacccctagaaaaatctgccaagcgcacatcgctaccagttgatcgcactctacacaacacaaccgatacgaagaagcttcttgtctagttagccgcgcccgctcgccatgtcctccttgaagagaagcattgcgtctggcgtcgtcgtcgtcctactggtgctctcccgtgaagccagcttcggtgacgctgtccgcgtcatancagacggccagggcgggggcgagggcgtccgccttccgagcgacggggaaagaggagtgagtacgtcggctggggggggggatcacgggaagcacctcaggtaggggggagcaccccatgttttttgcactggacccccacatctggcttcctgccccttaaagccacggccgaatcggtaccacctacggaaaaaacaagtcagccgaccccctcaggtaacaaaccttaagtggcgatgaacaactttaccttaattagtaaggccagccgaccccaaacatacacgtcaactttagtgtctgaaaccaaaccccaagttaccagcaaatttttntacacccaccgcggaggnaacaaagcaccccaggtcncattcgaaaagatatnaganccacacccacgcnaccagggcatatactcctagatgnatacaacgaggccncctacaccgcatagctaaaaggcatcaccactatgnatcncagacgangtctcatcgggacaataataaatgaangtcacccaccctgnccctaaaaacgatccgctccataantaagaaaagaccccacacaccaccagataataggcctaagccgcacccctccaataatcccgcacgtcatgaattggatacccacatatgatacataacacacgacgcggtcaaccttgaagcgcaatcatctcaccacacaaaaagaaatctatcgcaaagttggattctcacatcaggacgtagacaaatatgtaaacggtcaacccaacaacagaatttggcagnttcccacgacacgacatgaggagtatgacatatatccccgccagcatgataaaaggcacaatcccgn

SEQ ID NO: 76907 - protein, 66 aa, Zea mays
  misc_feature: Ceres CLONE 1561753
  misc_feature (33)..(33): Xaa is any aa, unknown, or other
MSSLKRSIASGVVVVLLVLSREASFGDAVRVIXDGQGGGEGVRLPSDGERGVSTSAGGGDHGKHLR

SEQ ID NO: 76908 - DNA, 836 bp, Zea mays
  misc_feature: Ceres CLONE 1561755
  misc_feature: Encodes the peptide sequence at SEQ ID NO. 76909
  misc_feature (627)..(627): n is a, c, t, g, unknown, or other
ctccccgcggtggcggccgctctagaactagtggatcccccgggctgcaggaattcgtctcacccctagaaaaaattttgcgtgagaacaacccggatcttgctggtgatagaagaagaactgttatgaggccccctcaagtcctcagggaaggaacaaagaagacagtttttgtgaacttcatggacttgtgcaaaacaatgcataggcaaccagaacatgtgatgatgttcttgcttgctgagatgggaacaagtggatccctggatgggcaacaaaggttggttatcaaaggaagatttgcaccaaaaaatttcgaagcgatacttaggagatatatcaatgaatatgtcatatgcaatggttgcaagagtccggataccattctttctaaagagaacaggttgttcttcctccgatgcgagcagtgtggttcatcgaggtctgttgctcccatcaaggctggattcgttgcccaagtgggccgtcgtaaggctggatcttaagctacctactacttgcctgaaatcgcttcccgatgaagacaatgcaaactagtttgctggtccacaaaaatcatttgtgcactttcccctgtgcctacacagttcactggatttctgctgntcgctatacttggattggtgctgtgaaaaaaaaaaaccctttcccgtgggccgtggccgccgtctgctgtctccttcactcgccaatcgatttccctcggtcaaacgccgaaccccaccctgactccattccctccggcgatgacatctggttttccgacccctttcgggagtacagggaaaggagtccccatgggtaaccaacaaaag

SEQ ID NO: 76909 - protein, 167 aa, Zea mays
  misc_feature: Ceres CLONE 1561755
  misc_feature (24)..(148): Pfam Name: eIF-5_eIF-2B Pfam Description: Domain found in IF2B/IF5
PRGGGRSRTSGSPGLQEFVSPLEKILRENNPDLAGDRRRTVMRPPQVLREGTKKTVFVNFMDLCKTMHRQPEHVMMFLLAEMGTSGSLDGQQRLVIKGRFAPKNFEAILRRYINEYVICNGCKSPDTILSKENRLFFLRCEQCGSSRSVAPIKAGFVAQVGRRKAGS

SEQ ID NO: 76910 - DNA, 634 bp, Zea mays
  misc_feature: Ceres CLONE 1561756
  misc_feature (250)..(250): n is a, c, t, g, unknown, or other
  misc_feature (598)..(598): n is a, c, t, g, unknown, or other
ctccccgcggtggcggccgctctagaactagtggatcccccgggctgcaggaattcgtctccccctagaaaaaacctccacagctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctggggtgagcccattcggggcagcngctggccgcatccgcgctggacgaggagggccctggccttacgaaagtacccttggaagcagggaccctggggggaaaaaagaaaggggaagcctggggttcctttccgggggggccaaaaccccggggggggggcccaaaaagaaaaaaaaaaacccccccctttgggcctgtggttttttccccacaaaaaaaagggggcccccccccccccccggttttttttgggggggaaaaaaaccccccccccccccgggggaaaaaaatcggggggggggagagaaaaaaacccccccccccaaaaaaaaaaaaaagaggggggtgtttttttcccccccccgcggaggnggggggagggggggggggcccccccccgcggggggt

SEQ ID NO: 76911 - DNA, 876 bp, Zea mays
  misc_feature: Ceres CLONE 1561758
  misc_feature: Encodes the peptide sequence at SEQ ID NO. 76912
  misc_feature (582)..(582): n is a, c, t, g, unknown, or other
  misc_feature (583)..(583): n is a, c, t, g, unknown, or other
  misc_feature (590)..(590): n is a, c, t, g, unknown, or other
  misc_feature (594)..(594): n is a, c, t, g, unknown, or other
  misc_feature (614)..(614): n is a, c, t, g, unknown, or other
  misc_feature (802)..(802): n is a, c, t, g, unknown, or other
  misc_feature (858)..(858): n is a, c, t, g, unknown, or other
agctccccgcggtggcggccgctctagaactagtggatcccccgggctgcaggaattcgtctcacccctagaaaaaacctcccaactccagaagtcctccctagacgccgccagccgcgcgcacacccaccgagagctcctcgggctttctttctccgttcctccctcgcgcgctcagggtttcacgatggaggccgaggcggcggccaagagggcgcgggagggcggggaggacgccaccgcgccggtggcgggggccgaggcggtggtcgccggtgctggcgagcaggcgggaatctccgccgtcatcccaggatggttctccgagatcagccccatgtggcccggtgaggcgcactccttgaaggtggagaaggttctgttccagggcaagtcagactaccaaaatgtgatggtttttcagtcctccacgtacgggaaggtgcttgtcctcgacggagttattcaggtgacagagagggatgagtgcgcgtaccaagagatgattactcacctgcccctttgctccatcaaagaccccaagaaggtgttggttattggaggggggggggaagggtggtnnttttttntgtntgttttttttgggtttgagntggggggcgtggatttcgtcttttcctcttcttaagcggtcgctacaaaggcctaaaaggcaaaatcctgcctccggcggcgggggccatacgtaaaaaactgcccgccggttccaacttccccctaaaagtggggtcgtgggacaaaaatggacgctctacaccgcgcgaccccgaaatgtctgtgngcgggggagacccctccgcgtccgcggtataggctgtatagagcgaggggcggttnggggttccttcctcttgg

SEQ ID NO: 76912 - protein, 153 aa, Zea mays
  misc_feature: Ceres CLONE 1561758
  misc_feature (43)..(154): Pfam Name: Spermine_synth Pfam Description: Spermine/spermidine synthase
  misc_feature: SWISSPROT Homolog: EC 2.5.1.16 Spermidine synthase
  misc_feature (132)..(132): Xaa is any aa, unknown, or other
  misc_feature (135)..(135): Xaa is any aa, unknown, or other
  misc_feature (136)..(136): Xaa is any aa, unknown, or other
  misc_feature (143)..(143): Xaa is any aa, unknown, or other
MEAEAAAKRAREGGEDATAPVAGAEAVVAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGGEGWXFFXXVFFGFEXGGVDFVFSSS

SEQ ID NO: 76913 - DNA, 1166 bp, Zea mays
  misc_feature: Ceres CLONE 1561761
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (55)..(55): n is a, c, t, g, unknown, or other
  misc_feature (58)..(58): n is a, c, t, g, unknown, or other
  misc_feature (60)..(60): n is a, c, t, g, unknown, or other
  misc_feature (63)..(63): n is a, c, t, g, unknown, or other
ccccccccttctgtttgctcccccccccaggnnnnnnnnggnggnnngtgtgttngtntnttntttttttaaactgggactccccgcggtggcggccgctctagaactgtggatcccccgggctgcaggaattcgtctcacccctagaaaaattattgaggaacagagctggttttccaaaaaaaaaaattctgctttgattttccataaagaaaacctctcagcctctttcttctagctccatccaagctggtagtcctaatgggccccggccttcgacatgtacctattagtaacattacacgcgcacaccaaatcccctcctcatcccccctcggattaggaactcgcgaaagcactccaagccttttttaacgaggggttgcccctcctcatcctcctcccccctaccatgggttctccgtccctcccattccttgtccacaaatttctttaattgctaaaaccccgcttaaacctggtttatgccccattgggtttttttccaatttccgggggggcggggtcctttctttggaagttttcggcccgcttttatttttccccctttttggacggtcccttgtatttgtgtcgggccaaaatggggcccttaaaacaaagtttgggccgccgcccccattttccagcgagaaatccctggcgcccccgcttttctagtttttttccgttcaaacgcaccctccttataaattgaaataggggggccgggtgtttactcccgggggattgttcctccttgggtccccccccgggtgtggcgcgcctcccccctaatgtaaaaaacaccttttatgggggggggttcccatttgttcatgaaatgccgcccccccaccccttttggtggcccgtgggtgcacttctctattaaatactttttcttctccgttggtttttgcgggttttccacacccccttgctggggacactatatggggtggggcgggaaaaaataacaggtcccccccaaaacatacaacccccccctctcgtggttgggttcctgcccccctttttaacctacccccgacaagagaagaggggtctttctccacatacaaaaaaggaggagggttttcctcccctcccaggtgggaaaaaggcgcagcctctatattttgttgggcgcctctgcgcggggg

SEQ ID NO: 76914 - DNA, 872 bp, Zea mays
  misc_feature: Ceres CLONE 1561763
  misc_feature: Encodes the peptide sequence at SEQ ID NO. 76915
  misc_feature (602)..(602): n is a, c, t, g, unknown, or other
  misc_feature (701)..(701): n is a, c, t, g, unknown, or other
  misc_feature (704)..(704): n is a, c, t, g, unknown, or other
  misc_feature (705)..(705): n is a, c, t, g, unknown, or other
ctccccgcggtggcggccgctctagaactagtggatcccccgggctgcaggaattcgtctcacccctagaaaaagcacatcctcctcctgttgccgctcgctcgccgtgccgcaatggctacggccgtcgcctcccatacgttgctctcctccgccttcgccccgcgccactaccaccgccgcctgacccggaccgcgtccgtggggccgcgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgacaagacatggtatgttgttgatgcaacagacaagatcctaggcaggctagcatccaccattgcagtacatatcaggggaaagaatgaacccacttacactcctagtgtagacatgggagcttttgttattgtggtcaatgcagataaggttgctgtttctggtaaaaagcggtcacaaaagctttataggaggcactccggaaggcctgnagggatgaaagaagaaacttttgaccaacttcagaaaggatttcagagagaatcattgaacctgcggttcgtggcatgctcccccagggaaggcctggnaannagatatttacccaccttcagggatacaaagggacgaacattccgcccgagcttcaaaactggtcccctcccgatcagggataaagaatccaaaaactgggtaggaaatcatcgactgaaaaagaggcattggcaattctccccagaaggtttgcccttggttggaag

SEQ ID NO: 76915 - protein, 252 aa, Zea mays
  misc_feature: Ceres CLONE 1561763
  misc_feature (96)..(184): Pfam Name: Ribosomal_L13 Pfam Description: Ribosomal protein L13
  misc_feature (163)..(163): Xaa is any aa, unknown, or other
  misc_feature (196)..(196): Xaa is any aa, unknown, or other
  misc_feature (197)..(197): Xaa is any aa, unknown, or other
MATAVASHTLLSSAFAPRHYHRRLTRTASVGPRRAAPVGLAVRCEKSDKQKRQPLAALVPREQRFMFEGDELCGPDIWNTTWYPKAADHVTTDKTWYVVDATDKILGRLASTIAVHIRGKNEPTYTPSVDMGAFVIVVNADKVAVSGKKRSQKLYRRHSGRPXGMKEETFDQLQKGFQRESLNLRFVACSPREGLXXRYLPTFRDTKGRTFRPSFKTGPLPIRDKESKNWVGNHRLKKRHWQFSPEGLPLVG

SEQ ID NO: 76916 - DNA, 940 bp, Zea mays
  misc_feature: Ceres CLONE 1561764
  misc_feature: Translation starting site: 175
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (406)..(406): n is a, c, t, g, unknown, or other
  misc_feature (423)..(423): n is a, c, t, g, unknown, or other
  misc_feature (579)..(579): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (718)..(718): n is a, c, t, g, unknown, or other
  misc_feature (725)..(725): n is a, c, t, g, unknown, or other
  misc_feature (726)..(726): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (734)..(734): n is a, c, t, g, unknown, or other
  misc_feature (737)..(737): n is a, c, t, g, unknown, or other
  misc_feature (738)..(738): n is a, c, t, g, unknown, or other
  misc_feature (830)..(830): n is a, c, t, g, unknown, or other
  misc_feature (832)..(832): n is a, c, t, g, unknown, or other
  misc_feature (847)..(847): n is a, c, t, g, unknown, or other
  misc_feature (880)..(880): n is a, c, t, g, unknown, or other
  misc_feature (891)..(891): n is a, c, t, g, unknown, or other
  misc_feature (911)..(911): n is a, c, t, g, unknown, or other
tcccgcggtggcggccgctctagaactagtggatcccccgggctgcaggaattcgtctcacccctagaaaaaacctcgcttgagcatatagtgtgctcttctcttcctcttccagttggtattctttatctgaaacatagtacagaggaggagaggagaacgagagctaagaagatgaccggcaaggttctccttgtggccgtccttatcttggtgggcgtggcctctcgatgctcgggcagtaggggcctgcagggcgatcacgttgctgaacagaagttcggtggcggtggctatggaggtggcggtgggtacggaggctacggcggcggtggaggaggagtggtgggtggggtatgggcgnnnnnnnnnnnnnnnnnnnnnntnnnnnnnnnnnnnnnggggnggggtggggggttgggntgggtggggggggttgttgggtttggggtgggtgtgttggtgggtttgttgtatgtttgttgtttggtttgtgggtggttttgtgtgggtttgggtgtgtgtggggtggttttgggtgtgtgtgtgggggtggttgtttggggttggtttgttggnttgtgggttgtttttttgtttgggtgtgtttttgggtttgtttttttgttggtgttgtgtgtggttgtttgtttttgttgttttgtgggttggtggnnnnnnnnnnnnnnnnnngnnnnggnnnnnngnnngnnnnntnttgtgtnnttnnnntnttnnttttttttttttttttgtgtgttgttggttgggttgtttgtgggtgtgtttttgtgttttttggtggtgttgtttttggttggggtggtttntnttttgttggggttgntttgtttggtggttgtttgttgggcgtttgttntttttgggttntgttgttgtgttttttggtngtgtgttttgtttttgggttgggtggtta

SEQ ID NO: 76917 - DNA, 883 bp, Zea mays
  misc_feature: Ceres CLONE 1561767
  misc_feature: Encodes the peptide sequence at SEQ ID NO. 76918
ctccccgcggtggcggccgctctagaactagtggatcccccgggctgcaggaattcgtctcacccctagaaaaagcccacgtcccacccctcctgcatttcaaaataggcgtatctccctgcgcttttcctagccctttgtcatccaaggaaacaataaacaaccggcgcttttacacccccgccaagaacaggagcaacaacaacaaggctcctcgcaacaatccattctaatccaaggcgaagctcatgaacaacttggtcgattcggtcgagcacgacgagataccagacgtcggctgcgtgcacgccgtgctggccgagctcgtccacaccttcctcttcgtcttcaacgtgcgtcaccaccgccatggcccgccagattcctacgggaaacccccgccaaccctattcccatgggcaacccctggcggggggggggtaaccttgaaccccctgggcccctggggctcccaggggaaccggccagggtttcacccgtcctccgggggggcaaacttgtaaaccccccgggggggaagggggggggtttcaaagggggggccggggcccccaaaatcccaaaaaccccccgggggggggggggttttaaaacaccccccccccccaatttggtcggggagccggcccccccggggcggggggggcgcctacccccctcttgaaaaaaagagagggagatggtgaaaaacaccggggggaccccgggtgggggagggggattattcccccccaggagggggggccaggttgtaaaaaaaacaaatttccccctttggggcgggggtgttttgaaaaaacaacccatgttttttggaaccgccgagtgggagaggattccccaagagagccgctgaaagaaa

SEQ ID NO: 76918 - protein, 91 aa, Zea mays
  misc_feature: Ceres CLONE 1561767
MNNLVDSVEHDEIPDVGCVHAVLAELVHTFLFVFNVRHHRHGPPDSYGKPPPTLFPWATPGGGGVTLNPLGPWGSQGNRPGFHPSSGGANL

SEQ ID NO: 76919 - DNA, 873 bp, Zea mays
  misc_feature: Ceres CLONE 1561768
  misc_feature: Encodes the peptide sequence at SEQ ID NO. 76920
  misc_feature (396)..(396): n is a, c, t, g, unknown, or other
  misc_feature (607)..(607): n is a, c, t, g, unknown, or other
  misc_feature (622)..(622): n is a, c, t, g, unknown, or other
  misc_feature (623)..(623): n is a, c, t, g, unknown, or other
  misc_feature (642)..(642): n is a, c, t, g, unknown, or other
  misc_feature (684)..(684): n is a, c, t, g, unknown, or other
  misc_feature (721)..(721): n is a, c, t, g, unknown, or other
  misc_feature (740)..(740): n is a, c, t, g, unknown, or other
ctccccgcggtggcggccgctctagaactagtggatcccccgggctgcaggaattcgtctcacccctagaaaaaaggaatatatgcatcctgcccccaccccccttttacctccccactcgtctgcaccgaatcggtcgatcggtgcttttaatctctgagcaagcgatcgagctcaccaacaaccaccgcgctcaagagtagcagcccgccggccgcgccggagccgaaaacgacgaggcggtggcatggggaggccgccgtgctgcgacaaggtgggagtgaagaaagggccgtggacccccgaggaggacctcatgctcgtctcctatgtccaggagcacggccccgggaactggcgcgccgtgccgaccaacaccgggctgatgcggcccancaagagctgcaggttgcggtggacaaactacctccggccgggaatcaagcgcggcaactttaccgaccaggaggagaagctcatcatccacctccaggctctccttggcaaccggtgggcggcgatagcgtcctacttgccggagaggacggacaacgacatcaagaactactggaacacgcacctcaagaagaagctgaagaagatgcangccggcgaagggcgnngggagaaaccgcgaacgcncaacaggttgctcggaaagcggcgccgtcgccaccgcaagcnccgggaggaaagcgccccgcggtgcccaagggggcantggggagcggcgggttganaaccaacatcacaacggggcggcagggttctgcgcgaacgcgctctcgctgggaactttcgcctttcggcttcggggccgcccgccgggcttaaggtgggagcctctggcgggcgaaccgccccgggggaaca

SEQ ID NO: 76920 - protein, 163 aa, Zea mays
  misc_feature: Ceres CLONE 1561768
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature (50)..(50): Xaa is any aa, unknown, or other
  misc_feature (120)..(120): Xaa is any aa, unknown, or other
  misc_feature (126)..(126): Xaa is any aa, unknown, or other
  misc_feature (132)..(132): Xaa is any aa, unknown, or other
  misc_feature (146)..(146): Xaa is any aa, unknown, or other
  misc_feature (158)..(158): Xaa is any aa, unknown, or other
MGRPPCCDKVGVKKGPWTPEEDLMLVSYVQEHGPGNWRAVPTNTGLMRPXKSCRLRWTNYLRPGIKRGNFTDQEEKLIIHLQALLGNRWAAIASYLPERTDNDIKNYWNTHLKKKLKKMXAGEGRXEKPRTXNRLLGKRRRRHRKXREESAPRCPRGXWGAAG

SEQ ID NO: 76921 - DNA, 776 bp, Zea mays
  misc_feature: Ceres CLONE 1561769
  misc_feature: Encodes the peptide sequence at SEQ ID NO. 76922
agctccccgcggtggcggccgctctagaactagtggatcccccgggctgcaggaattcgtctcacccctagaaaaacttctgcctgtgtgcatcgcttgccagcttccgcctttccatgaccaccccgctcctgctgtgattctaggacgacgtgccgcccgggccggctgccttctcacgccgggagggttggggaacgagcgccgcagccgccgccgccaccacgaactcgcggaagaccatgccgagatccaggggcaacgagccgccgctgcggacgtcgcagcgcgcgccgctgcacctcaagacgacggcctgctccgaggcgaatggcgcgcaccaccgccccgtcgccgaccggagtagccccagggtctcgccgcgcagccctctgcccgagaagaagcgtgcggcgggaacacgtgttgcggagctggagggcaagctggggaaggtgcacgacgagctcaagaagctgcgggagcagctcgcgtccgccgaggccgccaagaatgacgcgcatgtcgcgctcgaggaggccaagaagcgcgtcggtaccaagggtagcccagcctccaccaccaccacctactcctctctcccccccttcgcctggggtcgaaatcgcctagaagacctgagagctgatgctgcctcagccggcagccgaggaggagagcagcataaacgtccgggccgacgatgtgttttgaggtcctcccgggcccgagtcgggggacagggagagccagagcgccggctgaagtcctgccaa

SEQ ID NO: 76922 - protein, 178 aa, Zea mays
  misc_feature: Ceres CLONE 1561769
MPRSRGNEPPLRTSQRAPLHLKTTACSEANGAHHRPVADRSSPRVSPRSPLPEKKRAAGTRVAELEGKLGKVHDELKKLREQLASAEAAKNDAHVALEEAKKRVGTKGSPASTTTTYSSLPPFAWGRNRLEDLRADAASAGSRGGEQHKRPGRRCVLRSSRARVGGQGEPERRLKSCQ

SEQ ID NO: 76923 - DNA, 886 bp, Zea mays
  misc_feature: Ceres CLONE 1561772
  misc_feature: Encodes the peptide sequence at SEQ ID NO. 76924
  misc_feature (576)..(576): n is a, c, t, g, unknown, or other
  misc_feature (720)..(720): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (772)..(772): n is a, c, t, g, unknown, or other
  misc_feature (778)..(778): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (791)..(791): n is a, c, t, g, unknown, or other
  misc_feature (792)..(792): n is a, c, t, g, unknown, or other
  misc_feature (842)..(842): n is a, c, t, g, unknown, or other
ggagctccccgcggtggcggccgctctagaactagtggatcccccgggctgcaggaattcgtctcacccctagaaaaaagaggaggcacaagagcgccatacatacacaaacagcgtacaagactcaaccactccctccttgtttgtttatataccttggcaccaccaaggcagcaccctgtaaactaaccaccaaagccgaagaaggcggcttgccctgcccgccgccttggtgccgcgcgcgccatggccaagagcaagtcgtccgccaaggccggccccccgctcctcggcaagtacgagctcggccacctcctcggccggggcaacttcgccaaggtataccacgcgcgctgcctcggccgaagcgaccccctggccgtgaaagtgctggacaaagacgggctgggcgccaccggcatgagagtcgcggctccttctcccaaggggtgttcaatgcggccgcctgaagaaaaaccaacaagggagggggcgcccccaaggggaggggggggggggccccccaaaggaggaaccccccaaaaaaaaaagggacacccgcggggggggagacanaaaaacccccccccgccccccccggggtgggggttgtgttttttccgcgcgccgccccccccaaacaaaaaaaaaaagggggggggggggggcgccaacaacggggggggggggggggggggctcataataaaaaaaaaaaaanaaaannnggggggggtgtatcccggggcggggcgtcgccgtagtaaaaaaanaaaaanannnnnnnccccnnttaaaaagaaagattgtgttggcggaggaggaagagaacaacaagagggnagatataatattttttctgggccccccaaaatcccccaaaaaaa

SEQ ID NO: 76924 - protein, 152 aa, Zea mays
  misc_feature: Ceres CLONE 1561772
  misc_feature: SWISSPROT Homolog: EC 2.7.11.1 Non-specific serine/threonine protein kinase
  misc_feature (110)..(110): Xaa is any aa, unknown, or other
MAKSKSSAKAGPPLLGKYELGHLLGRGNFAKVYHARCLGRSDPLAVKVLDKDGLGATGMRVAAPSPKGCSMRPPEEKPTREGAPPRGGGGGPPKGGTPQKKKGHPRGGRXKNPPPPPPGWGLCFFRAPPPPNKKKKGGGGGANNGGGGGGGS

SEQ ID NO: 76925 - DNA, 875 bp, Zea mays
  misc_feature: Ceres CLONE 1561774
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (302)..(302): n is a, c, t, g, unknown, or other
  misc_feature (315)..(315): n is a, c, t, g, unknown, or other
  misc_feature (319)..(319): n is a, c, t, g, unknown, or other
  misc_feature (338)..(338): n is a, c, t, g, unknown, or other
  misc_feature (829)..(829): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctgggagctccaccccggatggcgggccgnctctagaaactantggnatccccccgggctgcaggnaattccgtctcaccccctagaaaaaaatcctactgtcacacacacacaggagagagaccaagttggtttccaaagccaagtgggtggtactagcagtctagcaaccagctagcctcggggcggccagcagggcagcccatcatgtccgggaaagggagaaagcacccacccactttttttttaaaaaccaaccccaccaaggaaggggaacgaagggaaacccaagccccccgcccggggccaaaatttacccggggggtttaccttccccaaaaaacccccaaaagggtgggggtttaaaaccgggccccaccccggggggcaaaaaaaaagggggccccaaaaattttccccccaaaaaaaaaagggggtttccccaaaaaaaaagggggggggggaaaaaaaaagggggaacccccccccaaagggccccccaaaaagggggggggcccccccctttttttgggaaaaaaaaaggcccccgggggggncccccccttttttttttccccccccccccccgggggggggggcccc

SEQ ID NO: 76926 - DNA, 825 bp, Zea mays
  misc_feature: Ceres CLONE 1561775
  misc_feature: Encodes the peptide sequence at SEQ ID NO. 76927
ctccccgcggtggcggccgctctagaactagtggatcccccgggctgcaggaattcgtctcacccctagaaaaaggtcagcctcagccaccgaccgttgcaccagctcgcatggcgctccacgccgtctcccccgcggcggtctcctccccgctgcgcgccctctcgcgcagattcccccagcgctcaggctgtggttgtttaccaaagcagtccgtcacaatttgctcctctacgaactttgcaagaaaacttcaggatggaccagtggacttcgctgccaggcgactggttcttggacactcggacaagagagcagttttgacgcatgccactattgaagaaatcgaagcggagaaatccctcatcgaagaccaagctaaagaaaagatggagaaggcgatcgaaacagtccaaactaacttcaacactgtgaggacagggcgtgcaagcccggcaatgcttgaccggatcgaggtcgagtactacggaactccagtgaacttgaagagcattgcacagataagcactccagatgcaacttctcttcttattcaaccatatgataagtcaagcctcaagcttattgagaaaactatagttgccgcaaatcttggtgtgacaccaagcaatgacggagaagtgatacgagtgactgtcccaccgttgacatctgatcgcagaaaggattagcaaagacagtggctaaattggctgaagatggcagggtgctatagggacataagaagagatgcaatcaaagctacgataactacagaagaaaagagctttctgaagacatgtgaaagattgtcagctgacctaa

SEQ ID NO: 76927 - protein, 193 aa, Zea mays
  misc_feature: Ceres CLONE 1561775
  misc_feature (100)..(194): Pfam Name: RRF Pfam Description: Ribosome recycling factor
MALHAVSPAAVSSPLRALSRRFPQRSGCGCLPKQSVTICSSTNFARKLQDGPVDFAARRLVLGHSDKRAVLTHATIEEIEAEKSLIEDQAKEKMEKAIETVQTNFNTVRTGRASPAMLDRIEVEYYGTPVNLKSIAQISTPDATSLLIQPYDKSSLKLIEKTIVAANLGVTPSNDGEVIRVTVPPLTSDRRKD

SEQ ID NO: 76928 - DNA, 648 bp, Zea mays
  misc_feature: Ceres CLONE 1561776
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (332)..(332): n is a, c, t, g, unknown, or other
  misc_feature (383)..(383): n is a, c, t, g, unknown, or other
  misc_feature (384)..(384): n is a, c, t, g, unknown, or other
  misc_feature (457)..(457): n is a, c, t, g, unknown, or other
  misc_feature (519)..(519): n is a, c, t, g, unknown, or other
  misc_feature (616)..(616): n is a, c, t, g, unknown, or other
  misc_feature (637)..(637): n is a, c, t, g, unknown, or other
tcacccgcggtggcggccgctctagaactagtggatcccccgggctgcaggaattcgtctcacccctagttatggccctctctccatccctgcccacgaccctccgccaccaggcaccagccatcgcctgcatcagaatctcccgcccgtccgttacatcccagggcgacgcggccgcggccatgacgccatcctcagctctcgccctcgcgcaccacgccgcggtatccccgctcccgtcctccacgccgcgggccctcccccaggtccagcttctctgagcctgggcccggggctccgccgggctcggggccgnnnnccccggggcttgngtcccgggggggggccccccccccgggggggttttctttcccccccccggnncccccccctttaccaagcccggggcccccaaggcccggggagggggggtttttttttcgacaaaacaaacccngggggggggagttccccggggcccccgggggttcccccccccccgggggggggcccccttcncgggggaaaaaaaaacaccccttttttcggggagggggggggggggggaaaaaaccaccccccccccccccccttttaaagaaaagaaaaaacaatntcttactcttcttctttcgcnttcggcggccg

SEQ ID NO: 76929 - DNA, 797 bp, Zea mays
  misc_feature: Ceres CLONE 1561777
  misc_feature: Encodes the peptide sequence at SEQ ID NO. 76930
tggagctcaccgcggtggcggccgctctagaactagtggatcccccgggctgcaggaattcgtctcacccctagaaaaagctgccatgaggcccgaacagttgaagctactagcgtgtagctagggaagagaagcgcgcgagtagctagcagacgtacgtaggcagaagcctagctgggtttgaagggccccgatcgatgatcccctacgcgactgcggcggaggcggagggagcactggggcgcaccatgacgtgggctgagacagcatggtacgagtactcggcggtgatgccagattcctggctgcactgccacaccacatttatcctgttcgtcatctacagcatcgccccgctgcccctgctactcctagagcagttcgctccgtccgtcgtgctgccgtacaagctgcagccccggggtacggctgcccccggcagcctccctcagctgctacatggacgcggcctgcatctttccgctcgccgttggccttcagttcgtctcctatcctgcggtcgccaagatactaaggacccgaatgggactgccgttgccgtcggtgagggagaccatcgcgcagctagtcgtatactctctagtggaggattacctcagctactggatgcaccgtctgctgcacacccagtggtgctacgagaagatccaccgcgtccaccacgagttcacggctcctacaggcttccgccatgtcgtacagccactgggcccgaggacgtcgtccttttctatcccggccttgggccggcccagtgctcggtgcatgccttggtc

SEQ ID NO: 76930 - protein, 112 aa, Zea mays
  misc_feature: Ceres CLONE 1561777
  misc_feature: SWISSPROT Homolog: EC 1.14.13.72 Methylsterol monooxygenase
MDAACIFPLAVGLQFVSYPAVAKILRTRMGLPLPSVRETIAQLVVYSLVEDYLSYWMHRLLHTQWCYEKIHRVHHEFTAPTGFRHVVQPLGPRTSSFSIPALGRPSARCMPW

SEQ ID NO: 76931 - DNA, 1249 bp, Zea mays
  misc_feature: Ceres CLONE 1561778
  misc_feature (1236)..(1236): n is a, c, t, g, unknown, or other
tgtggtgcggtctaccagccaggcttggcgtgggccgcctcccttttcttttacacacagaatatttttttataaaaactggagctcaccgcggtggcggccgctctagaactagtggatcccccgggctgcaggaattcgtctcacccctagaaaaaggtgagcctcagccacgggacggtgcacccgcttgcatggcgctccacgccgactcccccgcagaggtctcctccccgctgcgcgccctctcgcgcaaattcccccagcgctgaggctgtggttgtttacccaagcagtacgtcacagtttgctcgtctatcgaactgtggcagaaaatttcagcgaggaccattgagacttcgctgccccgagactggatcgatggacactcctgagcagagaggcggtttttgacgcatgccgcctcctggaaaaaatcgaatcgggagaaaaacccctcttcgtaatacctaggctacaagaaaaggccccccccacacgggggatcagaaaacagtcctcagaactgagctttcctacacactgtaaagaggacaaggggcggtttacaaaaacccgcgggagcaatggccttgtaaccgccggattccgaagggtcggaaagtttaccaatatcgcaaaactctcccaagggggaacacactgtagacagagaggtttatttttcccctggaagaaccaagaacggtcccttcccccgatgatatgatcgagaacgcacggtttgtgcgaggtggttatgtatgttgcgaaggacccccaagagatgcgggcgagtgggggtagttttctgaggcgcctctctttacaacaagaggttgtattatttagcgtgtaggaagagaaatcaccactctgtgtgtgttttcgtttgggcgatagtcacgtaagaagatctcacgcttgctcgggaggagtttgacggcggcccccccatgctggttaggtaggagtcgacgtcagtgcggatctacagcgcgggcgatacttccgcatagagtgggtagttacgagcctaaccggccacgtctgtgtgtgttcgtagagttattggccgcacgtgagtaatcgcgcgccgggaagcgggggcgtaacttttttgcctagctagacgctagccatatgtgtttgtgtgccacataaatatatgagcggcccgggagcataaaaatcgcttctgagcgggagatatagttattaatgtgaaggagaganctggatcactacg

SEQ ID NO: 76932 - DNA, 903 bp, Zea mays
  misc_feature: Ceres CLONE 1561780
  misc_feature: Encodes the peptide sequence at SEQ ID NO. 76933
  misc_feature (402)..(402): n is a, c, t, g, unknown, or other
ctccccgcggtggcggccgctctagaactagtggatcccccgggctgcaggaattcgtctcacccctagaaaaaagtttgccgctctgtgagcctgctgccgtcttcttccgccgccgccgccgtcgtcgtcttcgtccgtagatcagagagcggggaggaagaaaaagcgatcgatggcgtccaactacgtggacacgccgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcgggttgcagcagaagaaggcgcaggcggccgcgggggggggggatttcctttgttntttcatttggccgggtccaccgcaccagctttcagggacaccgctcacgggggggagacacgctgtaagtcttcagacccccccccgacctctttgcgtgcagtcaatttttttctttccgggttcatggcataacccaagtgaacctcctgtgtgtcttccccaccacccacctattggttgagattcccgaggaacccggatggggatagactttaaaggggaactgtctctctttgccccaggttttgaaaaatggggggaatttggctttggccatgggcacccttttgccaaagggttttacctggttttcgaaacaaggggccaactttcggaaaaaggggccccccattccaaatgtgatgtgattaggggaaaaaggttatgaaaggggtgggcctccatttggatacaaaccccggccgagaaaaatttctggtggaataaaacctttggttagggcatttccaaaacttgcgacaccgcctcttatggggt

SEQ ID NO: 76933 - protein, 136 aa, Zea mays
  misc_feature: Ceres CLONE 1561780
  misc_feature (76)..(76): Xaa is any aa, unknown, or other
MASNYVDTPGEEGRFHGPHSHSTSTTPTGGAAAAAASPRNFRRSFSSASSAGHSHGGGLQQKKAQAAAGGGDFLCXFIWPGPPHQLSGTPLTGGRHAVSLQTPPRPLCVQSIFFFPGSWHNPSEPPVCLPHHPPIG

SEQ ID NO: 76934 - DNA, 882 bp, Zea mays
  misc_feature: Ceres CLONE 1561784
  misc_feature: Encodes the peptide sequence at SEQ ID NO. 76935
gagctccccgcggtggcggccgctctagaactagtggatcccccgggctgcaggaattcgtctcacccctagaaaaaagtggcctcatctctctcttcctcttctcccgccgcccagcttctctcttctctcggcggcgccaccacggcgatcaagcgcgatacgggcgtaaccgaagaatcgacaatgggcggcgagaaggaaacctttgatacgtccgacctcaacgcctccctccccgcggccgctgcagccctcagcgccgaggaccgcgccggcctcgtcaatgcccttaaggataagctgcagagcctggcgggccagcacgccgatgtgttagagacgctgtcgcccaatgttaggaagcgggttgagtttttgagagagatccacactcaacacgatgaaattgaggccaagttttttgaagaacgagctgcccttgaggcaaagtaccagaagctttatgaacctttatacacaaagaggtatggaattgtaaatggagaagtggaggtagatgggtgtttgtgatgaaccggccagtgagaatactgttgagggaaaagaaccagacgctaaaggagtttccgacttttggcttactgccatgaaaacaaacgaagtttttgtctgaaggagatacaagaccgccgatgaagccccctttgaaatatctaaaaaatatccagtggtctctaaaaaccaggatcccaaggggtttcaagctgggaattttttcttttgaaacaaaccccattttcttaagaaattttggtccctggacaaaaacgttccccacttgggtttaataaaaaaagaacccccttttttggggaaaaagcttatttgggaactcgaaaacccggaggtgggattccc

SEQ ID NO: 76935 - protein, 115 aa, Zea mays
  misc_feature: Ceres CLONE 1561784
MGGEKETFDTSDLNASLPAAAAALSAEDRAGLVNALKDKLQSLAGQHADVLETLSPNVRKRVEFLREIHTQHDEIEAKFFEERAALEAKYQKLYEPLYTKRYGIVNGEVEVDGCL

SEQ ID NO: 76936 - DNA, 882 bp, Zea mays
  misc_feature: Ceres CLONE 1561785
  misc_feature: Translation starting site: 143
  misc_feature (703)..(703): n is a, c, t, g, unknown, or other
tggagctccccgcggtggcggccgctctagaactagtggatcccccgggctgcaggaattcgtctcacccctagaaaaaacagacacacacacacacacacactcaacagcaacagctaagcctctcccacaagacagcaacatggctgaggaggaggccaagaaggtggaggtggaggtcaccaaggagcccgaggcggcggcgaaggaggacgtagccgatgacaaggccgtcatccccgcgaccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatggggaaaacacaagaaagcaaacatagaagctgaactgaagaagattgaggaacaactggaaaaagaagaaagctgaatatgcagagaagatgaagaacaaagttggcatgatacacaaggtagcccgaagagagcgagcgatggtggaggcaaaacgcgggtgaggaagtcctgaaagcccgagagatggcttgcaagtaccgggccaccnggcacgctccttagaagctcatcggttgcttcggagcctagaaacctttcagtcagaacgagcagaaatgaaaaacgtcgccagtgattgcctggtcctctcgctctatccaggggtaggggggcctccaaagttttaaaccctacgccgccgctgtataaaccgaatcccttccaaga

SEQ ID NO: 76937 - DNA, 761 bp, Zea mays
  misc_feature: Ceres CLONE 1561787
  misc_feature: Encodes the peptide sequence at SEQ ID NO. 76938
  misc_feature (86)..(86): n is a, c, t, g, unknown, or other
  misc_feature (87)..(87): n is a, c, t, g, unknown, or other
  misc_feature (99)..(99): n is a, c, t, g, unknown, or other
  misc_feature (100)..(100): n is a, c, t, g, unknown, or other
  misc_feature (200)..(200): n is a, c, t, g, unknown, or other
  misc_feature (215)..(215): n is a, c, t, g, unknown, or other
  misc_feature (216)..(216): n is a, c, t, g, unknown, or other
  misc_feature (237)..(237): n is a, c, t, g, unknown, or other
actctcgcggtggcggccgctctagaactagtggatcccccgggctgcaggaattcgtctcacccctagaaaaatcagccatcccnnctcccgcggcannagtctctctgaattgtgggtctccggcgatggcggctctagctccatccaagattctgggcaccaagctcaacttcgccggctcctcccgctacgccacnggcagcgcccaccgnncggggggctcaggaagaatcnggttctccccctcttcagcaaagaagcctgcccagaaagcccaagccctctgcggtgtcgtcctcttctccggacatcagcgacaagctcgccaaagtggaacggccctgaacaggaagaactacccgcccgaatgggctccttggacccccctcggaaggtcccgggaaaaaccctccccccccccaaaaaaagggttcccctggggaaaaattaatggggcctacccacccccccctttttttttgggccccccgggggggccccaaaaaaaaaaaaccccccccaaaagggagaaaattttttctccccccccaaggagttttcttccggggggggcgccccccttcaaaagaaaaaaggggcggggaaaaaaccccccccccgtggggccgccaaaaaaaaaaaaaaggggggggggcccctccccacaggtggttttctctcagaagggagggggggccccccccgccccccccttaggtggtggggggggggaactacttcactcgtttgattatctg

SEQ ID NO: 76938 - protein, 211 aa, Zea mays
  misc_feature: Ceres CLONE 1561787
  misc_feature (30)..(30): Xaa is any aa, unknown, or other
  misc_feature (37)..(37): Xaa is any aa, unknown, or other
MAALAPSKILGTKLNFAGSSRYATGSAHRXGGSGRIXFSPSSAKKPAQKAQALCGVVLFSGHQRQARQSGTALNRKNYPPEWAPWTPLGRSREKPSPPPKKGFPWGKINGAYPPPPFFLGPPGGPQKKKTPPKREKIFSPPPRSFLPGGAPPFKRKKGRGKNPPPVGPPKKKKRGGGPSPQVVFSQKGGGAPPAPPLGGGGGELLHSFDYL

SEQ ID NO: 76939 - DNA, 1204 bp, Zea mays
  misc_feature: Ceres CLONE 1561789
  misc_feature: Encodes the peptide sequence at SEQ ID NO. 76940
  misc_feature (1130)..(1130): n is a, c, t, g, unknown, or other
  misc_feature (1203)..(1203): n is a, c, t, g, unknown, or other
acccgcggtggcggccgctctagaactagtggatcccccgggctgcaggaattcgtctcacccctagaaaaatcgctcatcacagataaatcttttttcccctccatttcatttcagcgtcgcgaaaaatggtagtcgttgatccgaaagccgtcgcctcggcgcaccagttcaccgtggtaatcgacggcgtcgagacgaccgtccacgagggcgtgctccggcgctacggcggcacggtggccgtggtcggcccgggcgtcctcaaggtgagccgtctccagcacttggtggtgcgcggcgggggggggggcgaccttcgcttctccccgtggctggtcgtcggccgccgaggattggggagcgggttctttcccccggtgcgacacccagcttgttggaaggtgtttctatcttatgtgcctagttttgtttcccctttggcctaattttttgtcgttccggcggcttttttcctttaaccccatcgcgcggggattcctattcttacctccttgttgtccatgggttgccggccgcgcaccgcctgttttgttcgctctctgccaactattccgatggtattctttttttgtccttttccgtttgttaccggtttttcgtggcgcccttgccggctcccttagtttggaccccccctttctattttggttgacccgtgttgttgccgcccccgttgtaatgtgtcctgtccgcgaattagattacccgcctttgattgttcccgctggtgtatatattattctttcgcacttactcttctcagagttcacacatcccgtacaccgactgtgctttcgtgttattatagtcttccagccggttgcccggctctcacgatgcgttcactactactatatatatttttcagctatcactcgtactcttatggattcgtatacttcctcgctcactcgtcttccgactcactgtgtttgtgtttcgtattgcacccccctgccgttagaatatattagcgcaccccgccgtgtgtgcacatcagactgtgattctattgtggccctaaccgccacattgtgatgctatactgcgataattcactacccgttatgaggtagcagtatcatacaaagacaatacccgatatnctgtcacgtttagttcaacagccgaccttgtcactgcgatccacatattgctgtatgtacttttagtcagctnt

SEQ ID NO: 76940 - protein, 106 aa, Zea mays
  misc_feature: Ceres CLONE 1561789
MVVVDPKAVASAHQFTVVIDGVETTVHEGVLRRYGGTVAVVGPGVLKVSRLQHLVVRGGGGGDLRFSPWLVVGRRGLGSGFFPPVRHPACWKVFLSYVPSFVSPLA

SEQ ID NO: 76941 - DNA, 901 bp, Zea mays
  misc_feature: Ceres CLONE 1561790
  misc_feature: Encodes the peptide sequence at SEQ ID NO. 76942
  misc_feature (488)..(488): n is a, c, t, g, unknown, or other
  misc_feature (599)..(599): n is a, c, t, g, unknown, or other
ctccccgcggtggcggccgctctagaactagtggatcccccgggctgcaggaattcgtctcacccctagaaaaagccattgcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcacccagnaacacatcttcgcgtcgcggccgccgtccatggccgccgagatcatccgctacgggccctcggacgtcgcgttcgtgccctacggcgagtactggcggcagggcaggaaanctctcacacggacatgctcagcaccaagaaaggtgcagtccttccgcatggccaaaggaaaaaggtgcgcctcgtcatggaaaaaaaccgggcgggttgccacccccggccccccggggggggtgggactgaggaaattcctggtccggaaaccccaaccaattgtgtgtcccccccggtctttgggcccctccaccgaaacaagggccggaaaaggggttttccccggttgaaaaaaataaaagggtcccccccccggggggtacacccccgggaaaacttcccccccaaaagggcggggg

SEQ ID NO: 76942 - protein, 235 aa, Zea mays
  misc_feature: Ceres CLONE 1561790
  misc_feature: SWISSPROT Homolog: EC 1.14.13.68 4-hydroxyphenylacetaldehyde oxime monooxygenase
  misc_feature (122)..(122): Xaa is any aa, unknown, or other
  misc_feature (159)..(159): Xaa is any aa, unknown, or other
MALGAAYHHYLQLAGDHGTATHALLLGVLIFLVIRLVSARRTGTTSANKRKQQQRLPLPPSPPGKLPIIGHLHLIGAETHISIRDLDAKHGRNGLLLLRIGAVPTLFVSSPSAADAVLRTQXHIFASRPPSMAAEIIRYGPSDVAFVPYGEYWRQGRKXLTRTCSAPRKVQSFRMAKGKRCASSWKKTGRVATPGPPGGVGLRKFLVRKPQPIVCPPRSLGPSTETRAGKGVFPG

SEQ ID NO: 76943 - DNA, 849 bp, Zea mays
  misc_feature: Ceres CLONE 1561794
  misc_feature: Encodes the peptide sequence at SEQ ID NO. 76944
  misc_feature (504)..(504): n is a, c, t, g, unknown, or other
ctccccgcggtggcggccgctctagaactagtggatcccccgggctgcaggaattcgtctcacccctagaaaacctactagaaaaatccattcccatcccattccccactctactcattcagcagatcccgtcactcgctctccacaagcagagcaccgcagcagaacgaggaaggatgctggccatcttccagaagcaggtggcgcacgcgccgcaggagctcaacagcccccgcgccggcgcgtcgcccagcaagccccggaaccccgacgagatcctgcgcgacttccacgccgcgcacccggccgccgccttctccgcctccttcggcggcggcgccgcgctcgcctgcgtcggcccctcctcctccgccaccgccaccggcaccgccacctaccagcggatgttctgcggcctggaccacatctactgcgtcttcctgggccgcctcgacaacctcagcggcctcatccgccagtacggcctggtgcgccgctccaccnacgaggcgatgctggtcatcgagggcctacgcacgctgcgcgaccgcgggccctacccgccgaccaggtcgtcaagggactcgccggggcctttgcccttcgtcgtcttcgacagccgctccggggccgtctttggcgcccttgggggcccccaagcccgggggagcgccggggccgctgtaacgggggcgtccgcgggccaaagggtcccccggggagatcagaacaaccgggaacctgggtaaagccgcggttggggggaaaggcccaagggggccctttccccggagggggtggtatgtgtttccaaagcggagccgggggggccccaagagagccttcaag

SEQ ID NO: 76944 - protein, 190 aa, Zea mays
  misc_feature: Ceres CLONE 1561794
  misc_feature (110)..(110): Xaa is any aa, unknown, or other
MLAIFQKQVAHAPQELNSPRAGASPSKPRNPDEILRDFHAAHPAAAFSASFGGGAALACVGPSSSATATGTATYQRMFCGLDHIYCVFLGRLDNLSGLIRQYGLVRRSTXEAMLVIEGLRTLRDRGPYPPTRSSRDSPGPLPFVVFDSRSGAVFGALGGPQARGSAGAAVTGASAGQRVPRGDQNNREPG

SEQ ID NO: 76945 - DNA, 1006 bp, Zea mays
  misc_feature: Ceres CLONE 1561795
  misc_feature: Encodes the peptide sequence at SEQ ID NO. 76946
ctccccgcggtggcggccgctctagaactagtggatcccccgggctgcaggaattcgtctcacccctagaaaaaattcgggcctggcaaggctggcatgccgtcggcctccctagctcgccgcctcctctctactatatcatctccagcgatcccttcacgcagtaccagcaccagcgccagcaacagcaacagctgtggtttcagcacaagaagggccaggaagaagcgcagctgcgtttcttggacggtgagcgcggctactccggcggacatggcgaccaacagcggcagtgccctggcgaagctggcgccgctggaagccatcctgttcgacatcgacggcacgctctgcgactccgaccccatccacttctgcgccttccgaaaactcctgcaacaagccggcttcaacgggggtgtccccatcacggaaggagttctcagcgccaacatcagcgggggggcacaaagacgaacctctccaagtgcgctggttcccgggcatgggaaccccaaaagggggatgccgggtccatgggaggaaaaaaaaaaactatggttcagaaaaagttgggggccctggggcaagctgaaaaaccccccgggaagggggctgcaaggaatcctgttgccggaattgggatgggaaagaggccccccaaccctttaaagaccggccgcggggggggggaacaaaaaccccccccgagggggtgaaacaccccaaacctgaaaggccggttcccctttggggggcccacaccgaaatttttttccccgggggggctctgcatccggggaaggaagtgggaacagggggcaaaaagcgttccccttgacccggacccccaaagggggtccaagataaatggggggattccccccaaaaaacctttatatattaaaaaacccgcatccggggtccgggccgtggtggtctcccaaaaaccccgtggtggccctcacaagaaaacccgggaggggttaaaaaaggggaccctctg

SEQ ID NO: 76946 - protein, 132 aa, Zea mays
  misc_feature: Ceres CLONE 1561795
MATNSGSALAKLAPLEAILFDIDGTLCDSDPIHFCAFRKLLQQAGFNGGVPITEGVLSANISGGAQRRTSPSALVPGHGNPKRGMPGPWEEKKKLWFRKSWGPWGKLKNPPGRGLQGILLPELGWERGPPTL

SEQ ID NO: 76947 - DNA, 809 bp, Zea mays
  misc_feature: Ceres CLONE 1561798
  misc_feature: Translation starting site: 296
  misc_feature: SWISSPROT Homolog: EC 2.5.1.9 Riboflavin synthase
  misc_feature (741)..(741): n is a, c, t, g, unknown, or other
ggagctccccgcggtggcggccgctctagaactagtggatcccccgggctgcaggaattcgtctcacccctagaaaaaagggccgctccgctcctgctcctgctcctgctcctgctctctctctctctctctctctctcggcgtcgattgggcgaccgccgccgccgcccccaggtcttcgctgggcccgtcgccggcgacgagcacccaccaggttcggaaacattgctgacgttcacctgtaccacagtagttcagtcgagtagctgtcggactcggaacacacatgccggcgatggcaactgctcctgtgaaattctctgtggctacgaactccccatgtgtccagcctagcttgcccctgaggcgtacacctgccgccatctccttcccttgtcgtccatggtcagccgcaatgaactcatgtactggattgttgaggcgctctgacgtggttgcagccgcggggcaccagaagttgatgggatctttgaccactaacgagggactcaggtttgggggtggttgtgggcacgttcaacgaggtcgtgacaaatttgttactacagggtgcccctggaaactttcgagcgatactctgttaaagaagaaatataacagttgtttagtgttcccggaagcttttgaggtcctataacagcacaaaagcttggggaaatctgggaaatttgatgcaattctgtgcattgggagctggtgattagaggtgacacaacccancttatgatgctggtgcaaactcagctggcatcaggtgtactcaaggctggatttatctgctgggtggt

SEQ ID NO: 76948 - DNA, 893 bp, Zea mays
  misc_feature: Ceres CLONE 1561800
  misc_feature: Encodes the peptide sequence at SEQ ID NO. 76949
ctccccgcggtggcggccgctctagaactagtggatcccccgggctgcaggaattcgtctcacccctagaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggcttcaacggctactacaactaccccccacaggcggacatctgccatgcctaccagatcatgaagaaggggcggacttaaggacgaggaacatcgtttgtctttcatgttacgatgacattcgcgcatagcccggaaaaatcccaaggccggggggtcatcataaatcattcccccgggggtggcggacctcttatggcttggggggggcccaaaggattaccccctgggggcaaaaagtctaaccgcccaacaaattttcttcccccgggttcctgccttgggaaacaaaaactgtttttttcaaggggggggggacccggccaagggtttttggaaaaatgggccccccaagggacacaaaaatatttggtttttttctacccgggacccccttagggggcccccctcccccaaaggaaaacaaataagtgggtgttgtccgcccaccccccccctcaagtgtcccaaagagaaaaaatcctggggggggaaaaatatcgccccccgggggaagtttcccgaaagccctctcccgcgggaggaaaaaacttcttttttgggag

SEQ ID NO: 76949 - protein, 81 aa, Zea mays
  misc_feature: Ceres CLONE 1561800
  misc_feature: SWISSPROT Homolog: EC 3.4.22.34 Legumain
MVADRLRLALLLSACLCSAWARPRLEPTIRLPSERAAADETDDDAVGTRWAVLIAGFNGYYNYPPQADICHAYQIMKKGRT

SEQ ID NO: 76950 - DNA, 833 bp, Zea mays
  misc_feature: Ceres CLONE 1561801
  misc_feature: Encodes the peptide sequence at SEQ ID NO. 76951
  misc_feature (700)..(700): n is a, c, t, g, unknown, or other
  misc_feature (793)..(793): n is a, c, t, g, unknown, or other
ctccccgcggtggcggccgctctagaactagtggatcccccgggctgcaggaattcgtctcacccctagaaaaaggaggatagatggctcatggctgccatcgtctaggctcaacatccgaaagacgggccatggtcggtttccttcctcaccccagcggcggacatctatccgaaaataggccgcacctcgtccgctttgctccttgttcatccttcacctgctgatggcggcagcggcgcggccatccaacgccactcttctcgcgcgcctccgggacggcacggccaagttcgagctgctggatgactctgcgtttgcgcttgcgcacgcgcccccggcctggccccgacttcactgctttgccaggattgccccctcgttgaggggtgggtggtcggcagcgttgaacaaggtggagcattacggggttcagagggttaccggcgatggccggtgcatgtttcgagcgctggctaaaggaatggcaaaaaacaaggggattcctttggccccaagggaggaggtagaagatgcagatgatttacggatggcagtgaaagaaattatatgtgacagcgagactgggcggcaggagtacgaagaagcagttatagcaattactgtggagcaatcattgaaacgctactgccaaaggataaggaggcctgatttctgggggtggagagtcagaattccntggttttgtctagactgtgtcggcagccaataattatttatatttccagagcgtgagtaccatggtccggggtaatgggtttcattcctatangctgaatatgggtttggaattcaccaaaaatacaaagcag

SEQ ID NO: 76951 - protein, 168 aa, Zea mays
  misc_feature: Ceres CLONE 1561801
MAAAARPSNATLLARLRDGTAKFELLDDSAFALAHAPPAWPRLHCFARIAPSLRGGWSAALNKVEHYGVQRVTGDGRCMFRALAKGMAKNKGIPLAPREEVEDADDLRMAVKEIICDSETGRQEYEEAVIAITVEQSLKRYCQRIRRPDFWGWRVRIPWFCLDCVGSQ

SEQ ID NO: 76952 - DNA, 840 bp, Zea mays
  misc_feature: Ceres CLONE 1561802
  misc_feature: Encodes the peptide sequence at SEQ ID NO. 76953
ccccgcggtggcggccgctctagaactagtggatcccccgggctgcaggaattcgtctcacccctagaaaaaactcaaatcacaaaccccgctacctcttaactcttcacacgcacaccgtcgtcaaccatggttgctgacatgaaggagaacggcggcgcggtgttggcggcgggcgagaaggcgccgcaggtggtcgtcaagcgcggcgagccgacgctggtgccgccggcggaggcgacgccgacgggcgggcagtactacctgtccaacctggaccagaacatcgcggtgatcgtgcagacggtgtactgctacaagcccagcggcggcggcggcgacgtggcggccgcgctccgcgacgcgctggcgcgcgtgctggtgcactactacccgctggcggggcggctgggcgtaagcccggagatgaagctgaccgtggagctgaccggcgagggcgccgtgttcgtggaggccgacgccgcctgcgaactcgccaccgtcggcgacctcccaagcccgaccccggcgcgctcgggcagctcgtctactccgtccccggcgccaagcacatcctcaagatgcctcccatgaccgccccaggttgaaaaaggttcaagtgtgggggcgtcccacttgggccttggcatgaaacacctgcatgttccaaagggattcgggccccgggaattttttcaacttctgggggcaaagaagggggcccccgggttccttgaaactccccggggccccccgttctctggaaccgcaaccgttctctgaaagaggcccgaaacccccccggggggaaaactttttctcccccccccaaagtttccc

SEQ ID NO: 76953 - protein, 154 aa, Zea mays
  misc_feature: Ceres CLONE 1561802
  misc_feature: SWISSPROT Homolog: EC 2.3.1.167 10-deacetylbaccatin III 10-O-acetyltransferase
MVADMKENGGAVLAAGEKAPQVVVKRGEPTLVPPAEATPTGGQYYLSNLDQNIAVIVQTVYCYKPSGGGGDVAAALRDALARVLVHYYPLAGRLGVSPEMKLTVELTGEGAVFVEADAACELATVGDLPSPTPARSGSSSTPSPAPSTSSRCLP

SEQ ID NO: 76954 - DNA, 949 bp, Zea mays
  misc_feature: Ceres CLONE 1561803
  misc_feature: Encodes the peptide sequence at SEQ ID NO. 76955
  misc_feature (566)..(566): n is a, c, t, g, unknown, or other
ctccccgcggtggcggccgctctagaactagtggatcccccgggctgcaggaattcgtctcacccctagaaaaatcctgtctccctcccacctttcccttcctcgccgctctcgcttgcccgcgcaccgagatttcctgcctgctcgtgctcgctccgctgctctcctcgactcctcctgcgtgcctgccgaccggtccgaggcacgccgcggcggaggctctgcgtctgccggccgggtcgtcggattcggccttaggttggttggttggttggttgggtcgcgggcatgtccacggcggtggcgcggccggcgcacggcggattccggcggtcggggagcgggaagccggatccggacgaggcggacaggatgatgcggagcgccaacgggtacttggtccaagaagaggaggaggaagagcatggcgatgaggcggcggcgaaggagagaggaggaggaggcggaggcggtgtcggaggcctcgtcgatcggggcggcgtcgtccgacagctcctcctccatcggggagaactccgcgtcccgacaaggaggaggaggaggangttgagagcaaggcgcaggggctcggcatgatggggctggccacgctcgaatccctggatgaagccctgccctccaagcggggcctgtccagctttctacgcgggccaatcccagtcgtttaccatccttgccggaagccgcggcggcagggggccgcaagggaaattgccaagcccggagaacccggtcaacaaacggcgggcccttgctgcagggcttggtcccggcgggggggctttattgaatccgcttggcctgccccttctctcctgccgtgggctggcccgggacccgaccttggtgggaggtgacgaccacttggagggcgcgtacattctgatagagcgggtggtaactggtgcgcttccctccacatcgtggg

SEQ ID NO: 76955 - protein, 102 aa, Zea mays
  misc_feature: Ceres CLONE 1561803
  misc_feature (93)..(93): Xaa is any aa, unknown, or other
MSTAVARPAHGGFRRSGSGKPDPDEADRMMRSANGYLVQEEEEEEHGDEAAAKERGGGGGGGVGGLVDRGGVVRQLLLHRGELRVPTRRRRRXLRARRRGSA

SEQ ID NO: 76956 - DNA, 797 bp, Zea mays
  misc_feature: Ceres CLONE 1561804
  misc_feature: Translation starting site: 231
  misc_feature: SWISSPROT Homolog: EC 1.3.1.9 Enoyl-[acyl-carrier-protein] reductase (NADH)
  misc_feature (746)..(746): n is a, c, t, g, unknown, or other
tggagctccccgcggtggcggccgctctagaactagtggatcccccgggctgcaggaattcgtctcacccctagaaaaaaacgaaacgctgaggcagcatcttccccgccgtcctccgccgcctcccattttcaccttggctgcagcctgcaacacaatcctacgcttccgacttcaacgcgcgcccctcccattttcacctagccctactcctttgtacataaaggaagatgggagcatatgcaacgactggtatgcagatgatagcaacacgcccttccatcccggcctacaggcaaatacttgggtcgacatcagcactatctgcatttggaaggtcaatctgttccagaactggctttgccatctcttctaaagccacatcagcaggaccactggtttcttcgaattgcaagagggttgttgtgagggcaatgtcgcagagaggtgcccaaggacttcccattgatctcacaggtaaaagagcatttatagctggagttgctgatgataatgggttatggttgggcaattgctaaggctcttgctgctgctggtgctgagattcttgttggtacatgggtgcctgcgttgaacatatttgagacaagcttgagacgtggaaagtttgatgaatcacggaagctacctgatggatctccttatggagattgctaaagtatatccactgggacgcagtttatgacaccccctgaagaatgtccctgaagatgttaaagcaaacnaaaagaaatgctgggagcttcaaactggacctggttaaaggaagttgttga

SEQ ID NO: 76957 - DNA, 832 bp, Zea mays
  misc_feature: Ceres CLONE 1561806
  misc_feature: Encodes the peptide sequence at SEQ ID NO. 76958
  misc_feature (56)..(56): n is a, c, t, g, unknown, or other
  misc_feature (57)..(57): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (150)..(150): n is a, c, t, g, unknown, or other
  misc_feature (165)..(165): n is a, c, t, g, unknown, or other
  misc_feature (190)..(190): n is a, c, t, g, unknown, or other
aggcgaagttgccaacagccgctgtgtcggcaggacaactactcttaaaaaaaaannccccnnnnntttgcccnnnnnnacacaactgggagctccccggcggtggcgggccgtctctagaactagtggaatcccctcgggctgcagggnaattcgtctcacccnctagaaaaagcgggtgagccggggnaccctcctacgtctcgccaccctgctggtatagcccgccggtcgtccacgccatggccacccaatatgcgcggctctccctgccatgccgcctgccctcgccgctccctccgccggtgccgacgacgacccgccgggctgccgcgcgccgcggcggcggcggcgtccacctccccgcggtgccacgcgtcgggggcgcgggcgggcaacgccgcggcccgcgggcccggggccgggccctcgggggcccttccgaaggggcgaaaaagtgcaagccaacccggggaggggggggaaaacccggaacccaagggggggggggaaaacaacaaaaaattggcttttccccccctaacttgggggggggattcttaacacccccctaagggggggaaaaaaaaaaaaaaaacccttcttgtggggagaaaaaatgggggagccccgggggggatttttccctcctccaagggggaaaataaataggggggccttttttttttcccaccaaaaaaagggccaaaaggggcgaaaaaaatttgtggtgtaaaaacgggggggggtgttttttaaaaaaaacactcttagaggggggaggggaagcccctttttttttgtggggaaaaggggggggaccacacacctt

SEQ ID NO: 76958 - protein, 110 aa, Zea mays
  misc_feature: Ceres CLONE 1561806
MATQYARLSLPCRLPSPLPPPVPTTTRRAAARRGGGGVHLPAVPRVGGAGGQRRGPRARGRALGGPSEGAKKCKPTRGGGGKPGTQGGGGKQQKIGFSPPNLGGGFLTPP

SEQ ID NO: 76959 - DNA, 1201 bp, Zea mays
  misc_feature: Ceres CLONE 1561807
  misc_feature: Translation starting site: 569
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
gggtgggggtgtcgactgtgacccgcggtctcgcttatatattacctaaaagaattttaannnnnnntnttaataactggaactccccgcggtggcggccgctctagaatagtggatcccccgggctgcaggaattcgtctcacccctagaaaaaactctccagtgccctgccaatcccccgctctcccgcctaccgccaggcccaggcgccagcctccaaagtccaaacccagctagagcttagagctagcatggagtccgccgccccgtgcccgcgcgcgcacgcgcaccccgtggacctccgctggctgctctccgtcgccgccggcggcctcttcacgctgctgctggtgctgctggccacctccccgtcgttccggctcggctccacctcgccctcaccccgcctcttcctcgggcccgcgtccggctcctcccggggcgcgcccaccactcttcgtcgaagcccgcccgccccccccgggggggccggtccccgcccgcgtccgccctcgctacccgcgcttcgcgtacctcaatctccggctcggcccggggacgcccggcatgatgcgcccccttgtctggctggcggctcttaccccccccatgaaaaacgcttacgatgctccccaccttataacgcggagaggcggccccgaagacccaaaacgggtgcgggggagcttggttccccccctttctgttgggctccaaccacactccggtgggacttcaccggggcggagcgccacgaaaaaacgtgggaaggggtggggctcctcacgaaaagagggcccaaacccatcctgatttacaccttataagagggtgggcgccgctccccccccaaggggggtgaagacaaaccaccaggcactcgtggtatatgttctctgtacgaaataggcccgagttcctcttttagtatgctcgcaatgacagatggagagtgatcgcgcctggatgcgttcccatcatgtgtgtcacgagcgagtttttataaaagcatgcttctcgccagcagcgcggaattaataacccgcgtttaagactgttggccggggaaaggagaactttgtagtggccgccgagtgtgttatcccgataaagaaagacatgaaggagtattctaatgagatgttctgaagacacacacgccttggatagaaatgcttatctggcaagaaaacgtagttg

SEQ ID NO: 76960 - DNA, 884 bp, Zea mays
  misc_feature: Ceres CLONE 1561810
  misc_feature: Translation starting site: 141
  misc_feature (458)..(458): n is a, c, t, g, unknown, or other
  misc_feature (478)..(478): n is a, c, t, g, unknown, or other
  misc_feature (492)..(492): n is a, c, t, g, unknown, or other
gcggtggcggccgctctagaactagtggatcccccgggctgcaggaattcgtctcacccctagaaaaaaccgaatcttgacggaacgattccaccaagaaccgcgggcaacaattcacaccgcgcttctcttctccagcgatgcagacgacggcggcggcggctgtggcatgggcgcctggcccatcggcgtccacctcgtcatcgtcctcgccgtccaccttcagggtgggggttgcgtcgacggccgtgcgggcttgttccgcgcccaggcttgttgcgtcctccgcgcccctgggctgtcgacggctgcgacaagtggttcaagctgttgccaatccagaccctgcgatcgagcttccattgactgctgaaaatgttgagatggtgttggatgaagtaaggccgtatcttatggcagacggaggcaatgttgcgttgcatgagattgatgggaancgtggtaagggtaaagctgncaggagcatgtggntcatgcccggctttcagtacaacgatgaagatgggtattgaacggcgcttgatggagaaaataccagagattgttgcagttgagccccatgctgatgagaaactgggccttgagttgaaccagagaactttgaaaaggtacttgacgaagataggcctccttgctggccacaggagggccaaggctccattttgtcccatccagggacctttttggcagggttggcttaccggcccaccccctgggggaaaaccttccccaaaacccttgcccccaaccccccggaaaaaaaccctaaaagggcgcggcccccctttcgccaaaaataaaatctttttaaaacccgcccccccccccctgtaaattgaagaccccccccccaaaaatttagc

SEQ ID NO: 76961 - DNA, 813 bp, Zea mays
  misc_feature: Ceres CLONE 1561811
  misc_feature: Encodes the peptide sequence at SEQ ID NO. 76962
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (348)..(348): n is a, c, t, g, unknown, or other
  misc_feature (413)..(413): n is a, c, t, g, unknown, or other
  misc_feature (414)..(414): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
ctggagctccccgcggtggcggccgctctagaactagtggatcccccgggctgcaggaattcgtctcacccctagaaaaacttctagaatcgtgtgcgagctggacagcaggaagagccgtagagttcgacgcgaggagcgagcgagtgattagctcgtgcgtgctgtgcaaggaaagtaacccagcagatcgatcggtcgaggcgggtaggacaggatccagaggtagctagccatggcggaggaagcgtctgcgcctgcggcggggacgtgatagcgccgnnnnncccggggggaagatgacgatggtggtaggggtcgacgagagcgagcacagcttctacgcgnctgcagtgggcactgcagcacattcttccctgccgggccagccgcagcagtacctgcctcgtcgnntcgtcaccgaccaagacccaaccgtccgnnncctccgccggtcgtgccctcgtccggggccctagggcgcccgccggatggtggctggccgtttacgtggaaggcgggatctcaagcgctcccgcccttgcgccgtcggtcgaaaaaagccaaaagcctcctggcacacatggcgaagcgaacgcttgtgttttgaaggccgcctggaaggggggaaccccttgggaaacgtcccctcccgccaaaggggttttttcccaaaaagggcacccgggggccccaaaaaaaggccccgccccgtttcggggggaacacaagggggggttttccccgggggggcccctttttaaaaaaaaggggggggggtggtttttctttgtggaaaaaaaaatttgggta

SEQ ID NO: 76962 - protein, 59 aa, Zea mays
  misc_feature: Ceres CLONE 1561811
  misc_feature (17)..(17): Xaa is any aa, unknown, or other
  misc_feature (39)..(39): Xaa is any aa, unknown, or other
  misc_feature (49)..(49): Xaa is any aa, unknown, or other
MTMVVGVDESEHSFYAXAVGTAAHSSLPGQPQQYLPRRXVTDQDPTVRXLRRSCPRPGP

SEQ ID NO: 76963 - DNA, 815 bp, Zea mays
  misc_feature: Ceres CLONE 1561812
  misc_feature: Encodes the peptide sequence at SEQ ID NO. 76964
  misc_feature (591)..(591): n is a, c, t, g, unknown, or other
ctccccgcggtggcggccgctctagaactagtggatcccccgggctgcaggaattcgtctcacccctagaaaaaagccgcaccgcgctcacttccgcaccctcttcccgccgcgccgccgccgccgccgcttcctccccgccgccgggcaagatgggtcgcgtgatccgcgcgcagcgtaagggtgcgggatccgtgttcaagtcccacacccaccaccgcaagggccccgcccggttccgctccctcgacttcggcgagcgcaacgggtacctcaagggcgtagtcaccgacgtgatccacgaccccggacgcggcgccccgctcgccaaggtcaccttccgccaccccttcaggtacaagcaccagaaggagctcttcgtcgccgccgagggcatgtacaccggccagttcgtttactgcggccgccgcgccacgctctccatcggcaacgtcctgccgctccgcgggatccccgagggtgccgtcgtctgcaacgtcgagcaccacgttggtgaccgcggtgtcttcgccagggcctctggggactacgccatcgtgatcagccacaaccctgacaacggaacctcgnagatcaagctgccatctggtgccaagaaaattgtccccagcagctgccgtgccatgattgggcaggttgcccggtggtggcaggactgagaaagcgatgctgaaggctggcaacgcctaccacaagtaccgtgtggaagaggaacgttgggccaaagggtcgtgggtggggccaatgaaccccgtggagcatcccccacggaggagggtaaccaccaactttta

SEQ ID NO: 76964 - protein, 175 aa, Zea mays
  misc_feature: Ceres CLONE 1561812
  misc_feature (11)..(90): Pfam Name: Ribosomal_L2 Pfam Description: Ribosomal Proteins L2, RNA binding domain
  misc_feature (96)..(174): Pfam Name: Ribosomal_L2_C Pfam Description: Ribosomal Proteins L2, C-terminal domain
  misc_feature (147)..(147): Xaa is any aa, unknown, or other
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSXIKLPSGAKKIVPSSCRAMIGQVARWWQD

SEQ ID NO: 76965 - DNA, 962 bp, Zea mays
  misc_feature: Ceres CLONE 1561815
  misc_feature: Encodes the peptide sequence at SEQ ID NO. 76966
  misc_feature (962)..(962): n is a, c, t, g, unknown, or other
ctccccgcggtggcggccgctctagaactagtggatcccccgggctgcaggaattcgtctcacccctagaaaaaagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccatgtcgtgctcatgggcgccgtcgaaggctaccgtattgccggcggggcgctcagggaggtcttctacccgctgtaccctggcggcagcttccaccccctcgggctggtccgacaaccccgatgccttcgccgagctcaagggggaagaaactcaagaacggccggcctcgccatgttttccatgttcgggttcctccgtccaggccatcgtccaccggcaaaggccccctccgagaaccttcctgaccacttcggttaacccagtccacaaaaatgcgaagtgggcctaccccaacatactttcgtccccgggaaattaagctcccagggtattgctaggccaccttcn

SEQ ID NO: 76966 - protein, 246 aa, Zea mays
  misc_feature: Ceres CLONE 1561815
  misc_feature (61)..(226): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACHVVLMGAVEGYRIAGGALREVFYPLYPGGSFHPLGLVRQPRCLRRAQGGRNSRTAGLAMFSMFGFLRPGHRPPAKAPSENLPDHFG

SEQ ID NO: 76967 - DNA, 838 bp, Zea mays
  misc_feature: Ceres CLONE 1561816
  misc_feature: Encodes the peptide sequence at SEQ ID NO. 76968
agctccccgcggtggcggccgctctagaactagtggatcccccgggctgcaggaattcgtctcacccctagaaaaaagccgcaccgcgctcacttccgcaccctcttcccgccgcgccgccgccgccgccgcttcctccccgccgccgggcaagatgggtcgcgtgatccgcgcgcagcgtaagggtgcgggatccgtgttcaagtcccacacccaccaccgcaagggccccgcccggttccgctccctcgacttcggcgagcgcaacgggtacctcaagggcgtagtcaccgacgtgatccacgaccccggacgcggcgccccgctcgccaaggtcaccttccgccaccccttcaggtacaagcaccagaaggagctcttcgtcgccgccgagggcatgtacaccggccagttcgtttactgcggccgccgcgccacgctctccatcggcaacgtcctgccgctccgcgggatccccgagggtgccgtcgtctgcaacgtcgagcaccacgttggtgaccgcggtgtcttcgccagggcctctggggactacgccatcgtgatcagccacaaccctgacaacggaacctcgaggatcaagctgccatctggtgccaagaaaattgtccccagcagctgcggtgccatgattgggcaggtttgccggtggtggcaggactgagaaaccgatgctgaaggcggggaacgcctaccacaagtaccgtgtgaaagagtacagttggcccaaaggtccgtggtgggggccatgaacccccggggagcttcccccagcggagggaggtaaccaccaacctttttcggtcacgccctctactag

SEQ ID NO: 76968 - protein, 175 aa, Zea mays
  misc_feature: Ceres CLONE 1561816
  misc_feature (11)..(90): Pfam Name: Ribosomal_L2 Pfam Description: Ribosomal Proteins L2, RNA binding domain
  misc_feature (96)..(174): Pfam Name: Ribosomal_L2_C Pfam Description: Ribosomal Proteins L2, C-terminal domain
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCGAMIGQVCRWWQD

SEQ ID NO: 76969 - DNA, 645 bp, Zea mays
  misc_feature: Ceres CLONE 1561817
  misc_feature: Encodes the peptide sequence at SEQ ID NO. 76970
  misc_feature (268)..(268): n is a, c, t, g, unknown, or other
  misc_feature (302)..(302): n is a, c, t, g, unknown, or other
  misc_feature (303)..(303): n is a, c, t, g, unknown, or other
ctggagctcaccgcggtggcggccgctctagaactagtggatcccccgggctgcaggaattcgtctcacccctagaaaaagcctccccagcgtaacaagtgtccttcctccatcttcctcctccactccactcccaagtccccaccacccccaaccccgtctctccactgcggcgcaggcttcgcttcggctccgctcggctcgagcagaagaaaagcaacgggcagtgcaggccgtcaggtcacacggcaatggttcttaaatatgnctgttctacaaacacatcagcgctccccaagccnnagcaatggcttccctgctgcctttttctcgttttcatggtcagtttcatcctgctccgcctaggagggatcgtgggatttttgaaacttgcccacctggtagcaaaaatgtcctttgaagtcccaaaaaggggaaaaaagggggcctaaaaggggaaccttggggcccctggggggggcacccaaaagaaaggaaataaaggggcctctaataagaaaaccccggttcacaaaaattctttttgagaaccttccggagcaccaaaaaagggtggggggggggagacacttttttgtgggggggggggggggtggggggaaaaaaaaaaaacccggggggggg

SEQ ID NO: 76970 - protein, 66 aa, Zea mays
  misc_feature: Ceres CLONE 1561817
  misc_feature (6)..(6): Xaa is any aa, unknown, or other
  misc_feature (18)..(18): Xaa is any aa, unknown, or other
MVLKYXCSTNTSALPKPXQWLPCCLFLVFMVSFILLRLGGIVGFLKLAHLVAKMSFEVPKRGKKGA

SEQ ID NO: 76971 - DNA, 952 bp, Zea mays
  misc_feature: Ceres CLONE 1561819
  misc_feature: Encodes the peptide sequence at SEQ ID NO. 76972
ggagctccccgcggtggcggccgctctagaactagtggatcccccgggctgcaggaattcgtctcacccctagaaaaaaccccaccagtctctggcaggttctcccccccacccctctccgtctccgatcccgtccgcattgcttcgcgccggaccaaggaggaagggtcggcgtcgcaggcattgcggcctgccagccacgagggccatggacccgtgcccgttcgtgcgggtgctggtcggcaacctggcgctgaagatgccggcatcagcgccccccgccgccgccgcgtccggctccggcgtgcacccggccacgccgccctgctactactgccgcatccgcctcaacaagctgccctaccagacggcgcccgcgccgctgctgccggccaccgaggagggctcggcgccggcgccggcgtcgtgcgcggccgccttccacgcctccaaggccgacctggaccgggccgccgccaggcccgcgctcttcctcggcggccgcctccgcaccgcgcgcctcaaggtggccgtgtacgccggccgcgggggcggtgaatgctgcgggaggctgctcggcaagctcgtcttccggttcgacctcatgcgcgccggggacgatcccttgggtcttcctcatcggcttggttcgacatcggtaagcgcggcgccgggaagccggcggtcaaactccgccgccgcgcgctctcagttcaacgtcaccctcctcggggaaccctgacccgaggttcttctttcaagttccatgggtatcccgagggcagcccgcatggtgcctccggtttatgggggagcatgtaacagcccatgttcactctgcaaagtctctcctggcggcattaaactggtacctggtatttgcgggcctaggcgtcccgtaatggggcgcccgttggtccctcacaacctgtctggcagaaactctgggtcc

SEQ ID NO: 76972 - protein, 177 aa, Zea mays
  misc_feature: Ceres CLONE 1561819
MDPCPFVRVLVGNLALKMPASAPPAAAASGSGVHPATPPCYYCRIRLNKLPYQTAPAPLLPATEEGSAPAPASCAAAFHASKADLDRAAARPALFLGGRLRTARLKVAVYAGRGGGECCGRLLGKLVFRFDLMRAGDDPLGLPHRLGSTSVSAAPGSRRSNSAAARSQFNVTLLGEP

SEQ ID NO: 76973 - DNA, 833 bp, Zea mays
  misc_feature: Ceres CLONE 1561820
  misc_feature: SWISSPROT Homolog: EC 1.1.3.15 (S)-2-hydroxy-acid oxidase
  misc_feature (199)..(199): n is a, c, t, g, unknown, or other
  misc_feature (778)..(778): n is a, c, t, g, unknown, or other
ctggagctccccgcggtggcggccgctctagaactagtggatcccccgggctgcaggaattcgtctcacccctagaaaaacccactcactgccactgtacttgtgttgtgttgtgctgtgctgcgagaagaaggagaagaggaggaagaagagcaggtgctgagaagcctgccggcgcgcgttacgacaagcatatatngggggagatcaccaatgtcatggagtaccaggccatcgcgaagcagaagcttccgaagatggcctacgactactacgcgtccggcgccgaggacgagtggacgctgcaggagaacagggaggccttctccaggatcttgttccgtccgcgcatactgatcgacgtgtccaagatcgacatgaccaccaccgtgctggggttcaagatctccatgcccatcatggtcgcccccactgctatgcagaagatggctcacccagatggggagaacgccactgcgcgcgcggcggctgcggcaggcaccataatgacactgtcgtcctgggcaacttcaagcgtcgaggaggttgcctcgaccgggccagggatccgcttcttccagctatacgtctacaggacaggaaggtggtggagcagctggtgaggcgagctgaaagggctgggttcaaggccatcgcgctcaccgtcgacacgccgcgccttggccgcagggaagctgactcaagaacagatttgtcctggcaccacacctgacgctcaagaaccttcgaaggtctgggactcggcaaaatggaccangctgctgattcagggctgggcttcctatgtcgccggccaagtcgaccgcacctga

SEQ ID NO: 76974 - DNA, 838 bp, Zea mays
  misc_feature: Ceres CLONE 1561821
  misc_feature: Encodes the peptide sequence at SEQ ID NO. 76975
ctggagctcaccgcggtggcggccgctctagaatagtggaacccccgggctgcaggaattcgtctcacccctagaaaaactactctagcatcaacgaattttgatcgcatgattgctcccccttacttcataccctaacaacgtctgggaccaaccaaaatcgcccaccctaccatacaccctaagcaacgatcgactcctcctccacctcacacctatcatctcgcctgctcacctcaccttcaccgccgacttcctccccctcttcccggccccagcccccgggtcctccttcccccgccccatctgcaacggcaagccatccccctccgaggcacaccccaccgacgacgcctcccccgcacccaacagctcccgggtcctcaacaccacatccagtcacttccccgaagcccccctgccccccggcgtctagtgcgccgctgcactaccacaccgaggaccaccgaataccctacttccacctgaccactctacatcccaatgcgatagatccactgctaagacgaaagagacctctgtatcccttcgtgacctacctctgcgaacactgggccgaacaacatcccgacagacccacttgtccaaaacatactcttcctcgacagctgaatatgctcgaccgtcatgcatcgagaatacgattcgccacagtcaccagttagcaccccactactagcaatgaagcgatggtccaactatcatgactgcacaatcctcgtaaagcaaagcgacaacctattcttggatgccttgggattggggggtcataaatcggtattcctcctcccaaatcattgatttgggaaaaaataac

SEQ ID NO: 76975 - protein, 39 aa, Zea mays
  misc_feature: Ceres CLONE 1561821
MKRWSNYHDCTILVKQSDNLFLDALGLGGHKSVFLLPNH

SEQ ID NO: 76976 - DNA, 807 bp, Zea mays
  misc_feature: Ceres CLONE 1561822
  misc_feature: Translation starting site: 347
  misc_feature: SWISSPROT Homolog: EC 2.7.2.4 Aspartate kinase
  misc_feature (699)..(699): n is a, c, t, g, unknown, or other
ctccccgcggtggcggccgctctagaactagtggatcccccgggctgcaggaattcgtctcacccctagaaaaaagtaaaagctcggcagtatgatgcatttgatcttggctttataactaccgatgatttcacaaatgcggatattctggaagcaacttatcctgctgttgcaaggaggctacatgtggaatggattaatgatcctgctatacctatagtcactggctttcttggcaagggatggagatctggtgcaataactaccttgggcaggggtggaagcgacttgacagctacaaccattggcaaagccttgggattaagagaaattcaggtttggaaagatgtttgatggtgttttaacatgtgacccaaatatccatcctaaggcaaaacctgtgccatacttgacatttgatgaggcagctgaacttgcctattttgggagcgcaggttttgcatccacaatcaatgcggccagctagagaggcgatgtaccctgtgaggggtttagaattcttataaccgcgaagccccctgggaccttatcactaagcaggagatatgagttaagactgttttgacctagcattggtttgaaatcaaatttacaatgccttgtatagtcagcacagcatgcttgggccagtacgttttcctaagctaagttttttcgatattgagaactgggcatctnccggtggattgggtggcttacagtgaagtcgctatctttgaccctgatccgccaaaacctttggagtttttgattggttcacccaaaatgaaccttgagaatgtcctt

SEQ ID NO: 76977 - DNA, 824 bp, Zea mays
  misc_feature: Ceres CLONE 1561824
  misc_feature: Translation starting site: 122
  misc_feature (554)..(554): n is a, c, t, g, unknown, or other
  misc_feature (616)..(616): n is a, c, t, g, unknown, or other
  misc_feature (632)..(632): n is a, c, t, g, unknown, or other
ctggagctccccgcggtggcggccgctctagaactagtggatcccccgggctgcaggaattcgtctcacccctagaaaaaatttttggggagggtgtgttccagccttgcaggccgccgagatggtgggaggcagcaagccgctgggggaaagcgtattcgcggtccaccccgtcgccggtgcggcggcgatcagcgcctccgccgtcgccgtgtaccccctcgatacggtgcaaaacctcctccagctgggagcgacggggcagaagcagaagatggggctccggcaggtggtggaccggctcatggccgcttccggccctgcaggtttttacaatggcattggatggtccatattgggtaaacttcctggattgggagcacgttttgggacctatgaacttttaacagccttctataaagatggaagggaggacaactatgtctattattctgaggctatgaaggctggcatagctgctggtgctgtagaggctgttttctgcacaccatttgaacttttcaacttcgaaaccacacccatggatgcttacnggctctgggaaacccccattaccgtctgatgtgcatcaacccttctagagtgaattgcttgnaaaagaatgggtgctncttttgagaagggctcaaaatcagggatagctcgaacggtgacgattttgggggtatgtttcttttcaccctggcaattcctaaccacagtaatgctcaccctggaaggcagtttattggagccctaaacttgaaatctaaaagcagcaggacctggtaccctctttttgccctctaatgtttgctggcagt

SEQ ID NO: 76978 - DNA, 932 bp, Zea mays
  misc_feature: Ceres CLONE 1561827
  misc_feature: Encodes the peptide sequence at SEQ ID NO. 76979
ctccccgcggtggcggccgctctagaactagtggatcccccgggctgcaggaattcgtctcacccctagaaaaagtgccacctgctgcagagtctctctctctctctctctctctccagcttcgcgccgctgccgcgacctaccatggagctctgcctcgccgcgcgcgccgggacgacggcggccgcgtgccggaggagggcaccgacgaatacaggcgtgccgaagaagaagaggcacggcggcggcacagtgcgcgtacgttgcgtggcgacggcgcccatgggggagaagacggagtaccgggacggcccgctggagcgcgcgttcatggggctgttcgcgcgcaagatggagaagtacgcggcgaagaagccggcggcgcaggcgaaggaggacacggcggtgtgggagtgggactacgagagcttcgtggacgtgtcgcggcgggtgatgttggggcgcacgcgcgcgcagcagcagcaggcggtgcgcgaggtgctgctgtccatgctgccccccggcgcgccggcgcagttccggcggctgttcccgccgacgcggtgggcctgcgagttcaacgcggcgctgaccgtgcccttcttccgctggctcgtcggcccctcggatgtggtggaagtggaggtcggcggcgtccggcagcgcaacggggtgcgcatcgaaagtgcccctacctggagagcaacggctgcgtggggatgtgcgtcaccatgtgcaagggcccacgcaggactccttaccaccaagtcgggcccccctcccatgaacccaatttcgaagaactgagctcctaaagatatacggccaggggcccgctccattgaaaaggacccggggtcaaaacagcttgttcccaacccctgttcatggttacgcctctgcccggccgttcgaagctcagaggccttact

SEQ ID NO: 76979 - protein, 220 aa, Zea mays
  misc_feature: Ceres CLONE 1561827
MELCLAARAGTTAAACRRRAPTNTGVPKKKRHGGGTVRVRCVATAPMGEKTEYRDGPLERAFMGLFARKMEKYAAKKPAAQAKEDTAVWEWDYESFVDVSRRVMLGRTRAQQQQAVREVLLSMLPPGAPAQFRRLFPPTRWACEFNAALTVPFFRWLVGPSDVVEVEVGGVRQRNGVRIESAPTWRATAAWGCASPCARAHAGLLTTKSGPPPMNPISKN

SEQ ID NO: 76980 - DNA, 840 bp, Zea mays
  misc_feature: Ceres CLONE 1561828
  misc_feature: Encodes the peptide sequence at SEQ ID NO. 76981
  misc_feature (30)..(30): n is a, c, t, g, unknown, or other
aaagctggagctccccgcggtggcggccgnattagaactagtggatcccccgggccgctgcaattcgtctcacccctagaaaaaatcctccgcgcaggctagagcagccttccgcctctggatcgggacgcggagacgggaaacgccaggcctcgactcctccccgcggcgccttggctccctcgcctctccgcgcccgcttcccgaggacggacccgaccacgaccccctccacgacgcagagagataaagactccttccccctcctccaacttttcccacggagacctcttctgccgcccccgaccaggacgcgctcgataccgacaccgccgccgccgacgacagagttgcctcgtacccggaccccgacgcagagaagctgctcccccacgatctgctccacctgctcgatgaccacaccgacacggcagcccccagctacctgccgacccccctgctgagccaggatgaggacataaacttctccacctatgacccccacgctgctcctcctcatcttccacagctgggtggcctgcacactgcctcagacgacaagctaggccatggctcggccggatccaccgccgcctcatcagaggaggcagggcgcatccggccatctgattaccacaagtccctcgccgtcgagctcgaaatgaccgatcaaacggctgagacgactagaatctaccgtatgctccaaggcccacatcgcccccaagaatggaaaccggcggatgtctaccaaacaaagagtgggggtaccaccaaaactctttgaggggacaggaccttgttggcacttttcagtcaaagcaccgacgagccggggca

SEQ ID NO: 76981 - protein, 37 aa, Zea mays
  misc_feature: Ceres CLONE 1561828
METGGCLPNKEWGYHQNSLRGQDLVGTFQSKHRRAGA

SEQ ID NO: 76982 - DNA, 793 bp, Zea mays
  misc_feature: Ceres CLONE 1561830
  misc_feature: Encodes the peptide sequence at SEQ ID NO. 76983
ggagctccccgcggtggcggccgctctagaactagtggatcccccgggctgcaggaattcgtctcacccctagaaaaacccggcgacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctcttcgatagggcgtcgcggctccacgccctggcctccagctccgccctcgaccaggtgcctccctcctctctcttctgggaactggggtcgtctcgcccttcttccgctcacccagagattgagatcgggtgagcggtgcttacgcgcttggtttttttttccgccgcgcaggatgggatccgcacgggggttgacctgctgcggcgctgcgatgacatggtcagcaagctcggcctcttctcccccaacgagaccaaggaggacgtctccacagcaaacctcaagtacctactggtcccatattaccttgcagaaatgaccgaaaagatagcacaggaggatcggatcccggttcttaagacgtcacaggaccatctgaaggagttcattgctctatgtgaagtactagagcttatcccagaggatgagctagaattgtctaggcagaaacagccagatactctgaccaacagaagagcgccgaaaggt

SEQ ID NO: 76983 - protein, 91 aa, Zea mays
  misc_feature: Ceres CLONE 1561830
MVSKLGLFSPNETKEDVSTANLKYLLVPYYLAEMTEKIAQEDRIPVLKTSQDHLKEFIALCEVLELIPEDELELSRQKQPDTLTNRRAPKG

SEQ ID NO: 76984 - DNA, 875 bp, Zea mays
  misc_feature: Ceres CLONE 1561833
  misc_feature: Encodes the peptide sequence at SEQ ID NO. 76985
  misc_feature (600)..(600): n is a, c, t, g, unknown, or other
  misc_feature (730)..(730): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (820)..(820): n is a, c, t, g, unknown, or other
  misc_feature (828)..(828): n is a, c, t, g, unknown, or other
  misc_feature (830)..(830): n is a, c, t, g, unknown, or other
  misc_feature (835)..(835): n is a, c, t, g, unknown, or other
  misc_feature (836)..(836): n is a, c, t, g, unknown, or other
  misc_feature (838)..(838): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
ctccccgcggtggcggccgctctagaactagtggatcccccgggctgcaggaattcgtctcacccctagaaaaagcaggacaggttgcatttgcatctgagttcctgatcgttgtattccagtttcttccgtgagttttgtgggatcgcgaggaagaaggatgtcgtgctgcggaggcaactgcgggtgcggcgccggctgcaagtgcggcagcggctgcggagggtgcaagatgtacccggacatggctgagcaggtgaccaccaccaccaccacccagactctcatcatgggtgttgcaccatccaagggcggggtcgaggcggccgccggagctgagaacggcgggtgcaagtgcggcgccaactgcacctgcgacccctgcacctgcaagtgagactacgacggtggcggcgatgacgctgcagggtctgcaggccctgatggggtcggaaggactctttatctctctagctaattaataagctctagctagtatataatattctagcagtgtcgtttgctgtgttttgttcgagtcagttagacagtcagccgcgtgccatgggccatggcatagcatgcctcgctctatctgcntcatcgccttgctctagtggtggtactgatgggggaacgaataatgtaccgagatgttggcgccgtgtcgtgtcgtgtcctgtcctgtcatgtccttcctggggctcatctagcagtcagactgtgttgntgttggggttggcctgggtggggccaaatgtgcattaaaacatcgggggcatggcccctgtttcaatcccaaaaannnnnnnnaaaaaanaaaaaaananaaaannanaaagggaaagaagaggaggnnnaaaggggagggggca

SEQ ID NO: 76985 - protein, 78 aa, Zea mays
  misc_feature: Ceres CLONE 1561833
  misc_feature (1)..(77): Pfam Name: Metallothio_2 Pfam Description: Metallothionein
MSCCGGNCGCGAGCKCGSGCGGCKMYPDMAEQVTTTTTTQTLIMGVAPSKGGVEAAAGAENGGCKCGANCTCDPCTCK

SEQ ID NO: 76986 - DNA, 856 bp, Zea mays
  misc_feature: Ceres CLONE 1561835
  misc_feature: Translation starting site: 101
  misc_feature: SWISSPROT Homolog: EC 1.14.13.90 Zeaxanthin epoxidase
  misc_feature (370)..(370): n is a, c, t, g, unknown, or other
  misc_feature (777)..(777): n is a, c, t, g, unknown, or other
ctggagctccccgcggtggcggccgctctagaactagtggatcccccgggctgcaggaattcgtctcacccctagaaaaattatacatggactggcaagaatggcagcaatcatggctaccacctatagaccgtacttgggtgttggtctagggcctttatcgtttttgaccaagttgcggataccacaccctggaagagtcggtggcagattcttcatcaagtatggaatgcctgcgatgctgagctgggtgcttggtggcaacagctcaaagctagaaggaagacttttaagctgccgactttctgacaaggcaaatgaccagctttatcaatggtttgaggatgatgacgcactggaagaagctatngggtggagaatggtacctcatcgcaacaagtgaaggaaactgcaatagcttgcagcccattcatttgattagggatgagcagaggtcactctttgttggaagccggtcagatcctaatgattcagcttcttccctatcattgtcctctccacagatatcagaaagacatgctactatcacatgcaagaataaagctttctatctgactgatctcggaagcgaacatggtacctggattaccgacaaatgaaggtagacgttaccgcgttccaccaaactttcccagttcgtttccatccctccaatgtcatttgagtttggttccgataagaaagctatgttcccggggtgaaggtgctgatacacgctccccgtatgaattctgcaaagaagtggggatcggcagncaacagcaagtcccttcaggcagcatggaatgggagacactgggctaccaccactattcatcagcccacactgttacgt

SEQ ID NO: 76987 - DNA, 1092 bp, Zea mays
  misc_feature: Ceres CLONE 1561839
  misc_feature: Encodes the peptide sequence at SEQ ID NO. 76988
gctctagaactagtggatcccccgggctgcaggaattcgtctcacccctagaaaaaattttcatcaatcaaacagaacctctggtcacacacacgcagcaaccaccgagcccagcgcccggcccagccagccagggccaacggcaaggcaacaccctcctcagcccgacgccgacgctcgccgtcatcctcgtaaatccacagcgcgcgcctcccgtcctcccaggcctcacccctagcgatgcgccactcccggcgctcgtgatccatggcctcactccccgttcctcacactcttccgcgggtctcgccagcgatagtgggcgccgcgagggggagggccgcggtgcgcgtacgcactgccaccgcggcattggagcggtgggtgcggcggctgcggcggaaatggagcagcgccactgggattgcccccgcacagcccagtgaaggagaagcctgtaatgtcaaacattggggaaatcgactaataattttatggcaccaattgccttgaattggaaaaatctgataagaccagaaaatttgctggggacaaaaaaaggctgtgtcggtatgggataaacagggactccactgggttccaggggaaaaaagtatctcctcggcatggtgccacttgaattcccttgaaggttgccatttggcataaaggcccaaccctcccacgttaatgtggaccttggagatgggtgggaacaagcccctcataaccatgggggccccagaataaagagaaatcttatagcctgcttaagggcgccaaaataaaccgttggccaaaaatactaataccgaagaaagtttcggggtgaaagtgggcaataatacttttctccgcatgaatggcccgggtggcccatattggatttgtcgatgacctgtgaaatcttccacaaacaggagagagaattcgggtatagactagcccacgtgccccaacttctcacttgtcgtacgttgtagctagagatgttgacgtggattgggccccaaaaaacattgatgagaactccggaaccctatatgccctataaaacgctttgatcgtcacgggagaataataacagttcca

SEQ ID NO: 76988 - protein, 81 aa, Zea mays
  misc_feature: Ceres CLONE 1561839
MASLPVPHTLPRVSPAIVGAARGRAAVRVRTATAALERWVRRLRRKWSSATGIAPAQPSEGEACNVKHWGNRLIILWHQLP

SEQ ID NO: 76989 - DNA, 824 bp, Zea mays
  misc_feature: Ceres CLONE 1561841
  misc_feature: Translation starting site: 374
  misc_feature (702)..(702): n is a, c, t, g, unknown, or other
  misc_feature (800)..(800): n is a, c, t, g, unknown, or other
ggagctccccgcggtggcggccgctctagaactagtggatcccccgggctgcaggaattcgtctcacccctagaaaaactcgccgctccgggctgaccaagggctcgccgcctcccgtgtcctccgactccgacagggaaaggcgaaaccttgggtcggctcgctagtggagtgcagggtacgttgatgacggagctgtggatggaggtgctgccgccgccctacttcgcggggcaggcggcgggcgggtggttcctgccggaccggcgggccgggcccggggcgtggacgctggaggagaacaagatgttcgagcgcgcgctggcgagggtcgactgggacgcgccggaaccggtgggagcgggtggccgcgatgctgcccgggaggacggcgtccgacgtcgcggcccactacgacgacctggagtgcgatgtcggctgcatcgaggcgggcttcgtgcccttcccctgctacggtagcggcggcggcggcggcgcgtcgcaatccgccgggttcacgttcgactgggacgccggcgggctgggctttaagcgctcctgctacgtggtcggcggcggcaagcgcgagcgcgggccggaccaggagcgcaagaagggcgtcccctggacggaggaagagcacaagcagttcttgatggggcctgaagaagtacgggcgaggggactggaggaacatctcgncgcaacttcgtgacgagccggacgcccgacgcaggtggccagccacgcgcagaagtacttcatcccgcctcaactcgggcggcaaggaacaagcgccnggtccagcatccaacgacatcacc

SEQ ID NO: 76990 - DNA, 833 bp, Zea mays
  misc_feature: Ceres CLONE 1561848
  misc_feature: Encodes the peptide sequence at SEQ ID NO. 76991
  misc_feature (810)..(810): n is a, c, t, g, unknown, or other
ctccccgcggtggcggccgctctagaactagtggatcccccgggctgcaggaattcgtctcacccctagaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccacccacttccgcaagcagctcactgtgcagctgaagatgctcgctgccgcccgcaagctgacgagggtgaaaaactccttcagctggcggccaccgacgcccaagcccaaggccgccaagccaaaggccccccaggccgcggccaagcccaagcccctcccccaaaggcaaaagccaaaacccctgcctaaccccaaagggggcgtccccccaaccccaaggccaagggccaagggccaagcccgggtcgctcccggccgcccgcggtccccccaaagcccccggggagggcgccccccccaaagtgtggccaagagacctccccccacagggcctcccccccccccaaaggggatgcccaaagaaaanggggggtgggctccctggcccaa

SEQ ID NO: 76991 - protein, 223 aa, Zea mays
  misc_feature: Ceres CLONE 1561848
  misc_feature (54)..(133): Pfam Name: Linker_histone Pfam Description: linker histone H1 and H5 family
  misc_feature (216)..(216): Xaa is any aa, unknown, or other
MSTEEAVVAEVPVTEVPAEVPAAQVAEAPKAKKAPKEKKAPKEKKLSAAKKPAAHPPYAEMIVEAIAALKERKGSSSVAISKYVEGKHGGKLPTHFRKQLTVQLKMLAAARKLTRVKNSFSWRPPTPKPKAAKPKAPQAAAKPKPLPQRQKPKPLPNPKGGVPPTPRPRAKGQARVAPGRPRSPQSPRGGRPPQSVAKRPPPTGPPPPPKGMPKEXGGWAPWP

SEQ ID NO: 76992 - DNA, 948 bp, Zea mays
  misc_feature: Ceres CLONE 1561850
  misc_feature: Translation starting site: 234
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaaaccagctcaaagctgaacgcggcatccttcctttcctcccctcttctgcccccatttcgttcctttcacaccggggaccggcgagcagagccgcgcacagcagaacgcggaagcaagaggaggcgatcgactactcgaccagccctctccgtgtctccgatggcggctcgcgtcctcgcggccctcgcccttgccctcgccctcgccctcgtcgccgtacccgctcccacgcgggcgtccaacgacgagggggacgcgctctacgcgctgcggcagcggctgtcggaaccccaacggcgtgctgcagagctgggatcccacgctcgtcaccccctgcacctggtttccccatctccttgcgacccagttcggccgggttcctcccccctgggatttggggaaatcccaacgttctcccgggtcccatccgggccctaaacttgggcccccctttgtgtcaccccccaagagaggctgggtcagggaaaccaaccccttggacgggggaggaatccccccaaggggaaattgggggcaaaccctcccaaaagaaaccttggatcacagccttgtgagattctgggtatgtgcccaaacaaagcgctccccgggggaggggaaaccccccacagaggtacccctttcccaaaagctctggaaccccgctcccaatattccttggggcccttgaggaaaaaaaacaaaagcgttttaagggaggaaaatttttcccggggggagattttttcccacaccttttctccaccccgcgaaaaaacactttccgtttttttctcaaaaaaaagaactctcttggggagaaatttccccgggggggggggggggctttttttaacacttttttctttctcaa

SEQ ID NO: 76993 - DNA, 906 bp, Zea mays
  misc_feature: Ceres CLONE 1561861
  misc_feature: Encodes the peptide sequence at SEQ ID NO. 76994
ccccgcggtggcggccgctctagaactagtggatcccccgggctgcaggaattcgtctcacccctagaaaaaatctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcagcgaggttttctggaactggacctggtgctggggacctgggtcgagcagcacgtgcacgccatggacgaggccaacatccgcgccctcctgcaagtgctcgacctcgaaaacccagatttgtggaaatggttgactagccaggagcagccaccagaggatctgaattctaatccggtgtttgctgccatcaaatcaaaggtcacagataacctgaccaagcatgcttctcctgagacccgatctacaccaggtcaaccatggggtagaggatgggacgacataaagaaagcaaagatgggacccagtatggaaatcagtgataagctgcttgaaaatggggatgacggcttttccatcctaaataatacctgttccccccacccacccccccaatatgcttggtttttgtaattgtggtagaaaaaagtggaactgcgcaccggcatgtgtgaaaagttttgttaaattggtagaatccagccttggaaccttatggaaggggactccctgaatgtttttccgtgggaattcccaagccttcccggg

SEQ ID NO: 76994 - protein, 210 aa, Zea mays
  misc_feature: Ceres CLONE 1561861
  misc_feature (60)..(144): Pfam Name: DUF339 Pfam Description: Protein of unknown function (DUF339)
MATALLRRALHLRRVLPSPAVTAAASQRLIPAFSTTPTPTPTTSQQNAATTTIDLSSDESRRRLLNRLVYRSKQRGFLELDLVLGTWVEQHVHAMDEANIRALLQVLDLENPDLWKWLTSQEQPPEDLNSNPVFAAIKSKVTDNLTKHASPETRSTPGQPWGRGWDDIKKAKMGPSMEISDKLLENGDDGFSILNNTCSPHPPPQYAWFL

SEQ ID NO: 76995 - DNA, 811 bp, Zea mays
  misc_feature: Ceres CLONE 1561863
  misc_feature: Encodes the peptide sequence at SEQ ID NO. 76996
  misc_feature (447)..(447): n is a, c, t, g, unknown, or other
  misc_feature (448)..(448): n is a, c, t, g, unknown, or other
  misc_feature (455)..(455): n is a, c, t, g, unknown, or other
  misc_feature (461)..(461): n is a, c, t, g, unknown, or other
  misc_feature (488)..(488): n is a, c, t, g, unknown, or other
  misc_feature (489)..(489): n is a, c, t, g, unknown, or other
  misc_feature (513)..(513): n is a, c, t, g, unknown, or other
  misc_feature (521)..(521): n is a, c, t, g, unknown, or other
  misc_feature (533)..(533): n is a, c, t, g, unknown, or other
ggagctccccgcggtggcggccgctctagaactagtggatcccccgggctgcaggaattcgtctcacccctagaaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccccgcgcgccnntgaggcngcggcngtgggtaccgtggtggccgtggaggcnngcgctacggcggtggcgggcgccntgatggcngtgggcgctacngcgggtggcggcggcttacgtggcggccggcgctaccgtggtggttgcgggcggctacggcgggtggaaacgggggggggggttacgggaacttccacgggaacttgaaggaactagaccggtggggccccccccgccaaattaccccggttcccccccggggagttttccccaacccccaagggggtttccccccctccccggccgcgttttttgtttcccccccccgggttttttaaaaggagagggcccccctttgtgacaatttttaaagcggt

SEQ ID NO: 76996 - protein, 89 aa, Zea mays
  misc_feature: Ceres CLONE 1561863
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSPAR

SEQ ID NO: 76997 - DNA, 1234 bp, Zea mays
  misc_feature: Ceres CLONE 1561864
  misc_feature: Encodes the peptide sequence at SEQ ID NO. 76998
  misc_feature (1)..(1): n is a, c, t, g, unknown, or other
  misc_feature (1019)..(1019): n is a, c, t, g, unknown, or other
  misc_feature (1034)..(1034): n is a, c, t, g, unknown, or other
  misc_feature (1234)..(1234): n is a, c, t, g, unknown, or other
nttttatttgtttgtgtttctggggtgttcctcttcttctcgtgggtgtgtggtgagggcggccagcagggggagtggagttgtgggtccccccggtggcggccgctcttcaactagtggatccccccgggcgtgcaggaattcgtctcacccctacaaaaaacagcggcatctatagcaaccgtgtccagcactttcacgctcagctcccggaatggcctgcctcggcgaggggcatcttgtccctctcgatggccgccttccccggcaaggcagtgtccttgccggagtgtctcttcggcagaggcccgagtgacgatgcgcaacacggcggcgagtgcgaagccggcctcgagctccggcagcccgtggtacggccccgaccgcgtgctctacctgggcccgctgtccggcgcgcccccgagctacctggacgagggaagttcccagggcgactacggctcgggacacccccccgggtcttgtgatggggaggccgggagacatctcgccaaagaactcgggggtgctgggagggttggatccgactccccagctggggaccaatggtctggggccgctgtgaggggccttagcatattatgcccatggaagcttgctctgccccgagcgataccagccttccctaatgttcctgggccggaaagggcccgcctggtgggctctccatagggacccctaagagttccctactagtaatctcttcaacaccccctacaacggggcggtgggtgagccctctggagtaaagtagtttaccattttacgcgcgtctcatatatattctcagcggttataggtcctctgtgagtgtattccgaagaggctcctagcgatggagagagaggattgtgcctctgtgaggtctcttattcccatggggggaatccatttttcacactatatggtattgcactctgtttccttcgcttgtgtggagcaccccttcccttgcgcatgaatatgtggggatgatattgtcgatagagatttcactnctctcaggtctcagntccagatctccctaggtgctccataatatcgcgtggtctcgtgaggtatatatcactgtcttccttcatgtgactcggctagggtcggagtgtgttcgttgtgtaaaaagctgtgagctgcttgtgggctgcgctctcacctgaggcccggttgccgctgcgaggagtgctctttcctcacacactacactctcataggn

SEQ ID NO: 76998 - protein, 124 aa, Zea mays
  misc_feature: Ceres CLONE 1561864
MRNTAASAKPASSSGSPWYGPDRVLYLGPLSGAPPSYLDEGSSQGDYGSGHPPGSCDGEAGRHLAKELGGAGRVGSDSPAGDQWSGAAVRGLSILCPWKLALPRAIPAFPNVPGPERARLVGSP

SEQ ID NO: 76999 - DNA, 962 bp, Zea mays
  misc_feature: Ceres CLONE 1561865
  misc_feature: Encodes the peptide sequence at SEQ ID NO. 77000
  misc_feature (535)..(535): n is a, c, t, g, unknown, or other
  misc_feature (536)..(536): n is a, c, t, g, unknown, or other
  misc_feature (623)..(623): n is a, c, t, g, unknown, or other
ctccccgcggtggcggccgctctagaactagtggatcccccgggctgcaggaattcgtctcacccctagaaaaagcgtcccgtgtcctcgtggcttggccgtgtcgatcgctgatcccaccggctgatagagttggcggccgggggagtgagtcgtcagggatggcgtcggagccggtggcgcgggcggtggcggaggaggtgggccgctggggcagcatgaagcagacgggggtgaccctgcggtacatgatggagttcggctcccgccccacccagcgcaacctgctcctctccgcgcagttcctgcacaatgagctccccatccgcttcgcgcgccgcgcgctcgagctcgactcgctgcccttcggcctctccaacaagcccgccatcctcaaggtgcgggactggtacatggactcattccgggacatcagatacttccctgaagtgaggagcatgaacgacgagctcgctttcacgcagatgatcaacatggtcaatgtgcggcataacaatgtggttccaatcatggnncttggggagtgcagcagctgaagaatgagctgggccgctcaaggaaggttccattcgagttcgatgagatcgacgagttccttgacnggttctacatgtcaaggattggcatccgcatgctgatagagcagcatgtggctttgcatgacccttaccgggagcctggtgtcataggcctcatccaatacagattatcccccattccaggtggctccagctgcttgcgtagatgccccgttctgtctgtttaagggaatattgatcagctccttgatattaacatgtttggcgatcccaatttttcgtttccctaagtccatttacccctaccccggaatgttttttgaattggggaggaaccccctccccgcgcggcaagaacggttttgtaactccggataaatgttcccccccttatgatttttg

SEQ ID NO: 77000 - protein, 131 aa, Zea mays
  misc_feature: Ceres CLONE 1561865
  misc_feature: SWISSPROT Homolog: EC 2.7.11.2 [Pyruvate dehydrogenase (acetyl-transferring)] kinase
  misc_feature (125)..(125): Xaa is any aa, unknown, or other
MASEPVARAVAEEVGRWGSMKQTGVTLRYMMEFGSRPTQRNLLLSAQFLHNELPIRFARRALELDSLPFGLSNKPAILKVRDWYMDSFRDIRYFPEVRSMNDELAFTQMINMVNVRHNNVVPIMXLGECSS

SEQ ID NO: 77001 - DNA, 816 bp, Zea mays
  misc_feature: Ceres CLONE 1561866
  misc_feature: Translation starting site: 96
  misc_feature (734)..(734): n is a, c, t, g, unknown, or other
ctggagctccccgcggtggcggccgctctagaactagtggatcccccgggctgcaggaattcgtctcacccctagaaaaaaatccataggcagcaatgtggatgactctgaagtcattgaaatcgttgggaaaaatccatttctgtggcctgaccactggccagtcaaagactatgccaaaatcttcgattgccttgtcttagttcctgagatagaaaccgaagtggtcaaggtgatatccaagattagagaggcaggccaaagagcaagacatgaagctgggggttctcatagtaagcagaggagagatagctcaacgaatccgcctgtaccgtatgttgctgttcacatgagaatagaaaaagattggatgatacattgcaagaagtgggagcagcggtccaagtcacatgaaatctgcagtagtaaagaagagatcattcataaggtctcacagatcactgacctacgtcggccggttgttgtttatcttgcggtagctgacagccttcttgaagacgattcaataaccatgggtgagagtggggtttatggttgcttacgagaagaagaagcttggtgttactgacatctacgatcgtcagccatatccttataaagtctgccatcgacttcgaggtgtgctcgagagcagacgtgtttgtcggcaacagcttctcaacattctccaaccctcgtagtgctgtcccagacagaaaggctgtacaacctgngaaaggcgagctcgtgtggcgagaacatcgggctttccctcgtatgcgtacaatgtcatggggcgacgatggtggacaacag

SEQ ID NO: 77002 - DNA, 872 bp, Zea mays
  misc_feature: Ceres CLONE 1561868
  misc_feature: Encodes the peptide sequence at SEQ ID NO. 77003
tggagctccccgcggtggcggccgctctagaactagtggatcccccgggctgcaggaattcgtctcacccctagaaaaaacctgtctcctccccttctcccatctctccccctctccctctcgacggccacgactgccgctgccgccctacgccaggtgtccaggtcatctccggcccattccccggccacaaacaccccactagatcgaccgacatatggacggcctgtggcatatgggggacgagctccgcgggcagcccaaggtggtggaggaccgccagtggtcgctcatgacgtccaagctggcagacatcaccatgtccagtggcgagaggacgaacgacctccactacgccaggatgaacgccgcccccgactccaagcggtggggcatggcagcatcctaccagcaccatcacgagggcaggatggaccacctcgatcagactcaggctcatgatgaacgatctctagatgaacaacgccgacgctgccgccaacatggatctacacttcaacggcatggcctacgacgtccacgctatgctacccattgggagctactcctacgccaatgtcgacgcattacagatgaatgtcggggtgaacaagtactcaggagcctgatacggaaacacccctgcaggtaaaaaaattgccgtggcaaccaaaatccactgaggcggccggaaggaacggttatggaaaccccaacgaacgttccggggggtcaaaaagcttttagaaagttaccaacaagggaaaggttcccaaaaaaaaaagtcttggggggttactttttgtgcgcacccggggacatccgggagaacccccgacccctttttgggtcccccgaaatttttggattct

SEQ ID NO: 77003 - protein, 144 aa, Zea mays
  misc_feature: Ceres CLONE 1561868
MDGLWHMGDELRGQPKVVEDRQWSLMTSKLADITMSSGERTNDLHYARMNAAPDSKRWGMAASYQHHHEGRMDHLDQTQAHDERSLDEQRRRCRQHGSTLQRHGLRRPRYATHWELLLRQCRRITDECRGEQVLRSLIRKHPCR

SEQ ID NO: 77004 - DNA, 980 bp, Zea mays
  misc_feature: Ceres CLONE 1561869
  misc_feature: SWISSPROT Homolog: EC 4.2.1.1 Carbonate dehydratase
ccgcggtggcggccgctctagaactagtggatcccccgggctgcaggaattcgtctcacccctagaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgggcatggaccccaccgtcgagcgcttgaagagcgggttccagaaattcaaaaacgaagtctatgacaagaagcccgagctgttcgagcctctcaagtcccgccaggagcccagggtacatggtggttcgcctgctcggactcccccctggtgccccgtcgggggaaatggggccttgcaagcccggggaaggatttcaccggcccgaaaaattcgccctccagggggccccccctacgaaaaaaatcaaataacgcccggggccccgggccccccatctaatttacccccgtgtggggccccccaaagggggaaggggactcctggggctattggccccaagcccgcgcggcgggggggaataaggggggctcccccccccccctcaagggaaagggggggcccccgaaaaaactttccacatttctgggaaaagaacagggggtccaagaaatcgggcaacccccgcccaaaaaaacaagggggaaaaaaaaagaccccccctccgggggccctttccaatgaacaaggggccccacccccggaaaaaaaagaggccccgaaaaaggttccccccaagacacccaaaaaagaacccctttctccaaaaaaagggctggccgggcggaacccccaaaatggttgggccccataaaaacttttcaaaaaggagatcctccacagggagaccccccagaaacactaaagccttataaaaagggtccacaatttagggaa

SEQ ID NO: 77005 - DNA, 859 bp, Zea mays
  misc_feature: Ceres CLONE 1561870
  misc_feature: Translation starting site: 119
  misc_feature: SWISSPROT Homolog: EC 2.7.7.9 UTP--glucose-1-phosphate uridylyltransferase
ctccccgcggtggcggccgctctagaactagtggatcccccgggctgcaggaattcgtctcacccctagaaaaaatctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacattccttgaccttattgtgattcaaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttacggaggacttcttgccacttccaagcaaagggaaatcttgggaaggatggctggtatcctcccagccatggttgatgtgttcccctcttttgataacagtggaaaactcgacatcttattggctcagggcaaagagtatgtctttcgtgctaactcagaacacttggggtgctatagtccgacatcaagatcctggaaccatctgatcaataacccgaatg

SEQ ID NO: 77006 - DNA, 778 bp, Zea mays
  misc_feature: Ceres CLONE 1561872
  misc_feature: Encodes the peptide sequence at SEQ ID NO. 77007
tccccgcggtggcggccgctctagaactagtggatcccccgggctgcaggaattcgtctcacccctagaaaaacccggcgacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctcttcgatagggcgtcgcggctccacgccctggcctccagctccgccctcgaccaggtgcctccctcctctctcttctgggaactggggtcgtctcgcccttcttccgctcacccagagattgagatcgggtgagcggtgcttacgcgcttggtttttttttccgccgcgcaggatgggatccgcacgggggttgacctgctgcggcgctgcgatgacatggtcagcaagctcggcctcttctcccccaacgagaccaaggaggacgtctccacagcaaacctcaagtacctactggtcccatattaccttgcagaaatgaccgaaaagatagcacaggaggatcggatcccggttcttaagacgtcacaggaccatctgaaggagttcattgctctatgtgaagtactagagcttatcccagaggatgagctagaattgtctaggcagaagcagccagatactctgacaaacagaagagt

SEQ ID NO: 77007 - protein, 87 aa, Zea mays
  misc_feature: Ceres CLONE 1561872
MVSKLGLFSPNETKEDVSTANLKYLLVPYYLAEMTEKIAQEDRIPVLKTSQDHLKEFIALCEVLELIPEDELELSRQKQPDTLTNRR

SEQ ID NO: 77008 - DNA, 781 bp, Zea mays
  misc_feature: Ceres CLONE 1561873
  misc_feature: Encodes the peptide sequence at SEQ ID NO. 77009
ctccccgcggtggcggccgctctagaactagtggatcccccgggctgcaggaattcgtctcacccctagaaaaaacacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgccgccgagggctcgtgggtgcccgaccccgtcacgggccactaccgccccgccaactgggccgccgccgtcgaccccgccgacctccgcgccgcgcacctcgcccgcacctacgcccgggcctgagcggccccggctccccttcacctgctccgcctcgtctcgtatgacatacgcgcaccgtaccagggtgagacgaggtgggggctggggggttcgtgtggcgaacggcgtgttgagccacgcgcgcgtgcggccgcgctctgcgacgcccgggaccgttcttgggagagcgcgagcgaagtcttctgtcctctcggggcgggtccctgtgccatgaaatgtgaccctgggtcgttttggggcccaaccaacgggagaagagccgcccgggggtcggtgggccccccccctggtggtggg

SEQ ID NO: 77009 - protein, 95 aa, Zea mays; identical to SEQ ID NO: 58232
  misc_feature: Ceres CLONE 1561873
  misc_feature (1)..(89): Pfam Name: LEA_3 Pfam Description: Late embryogenesis abundant protein

SEQ ID NO: 77010 - DNA, 861 bp, Zea mays
  misc_feature: Ceres CLONE 1561875
  misc_feature: Encodes the peptide sequence at SEQ ID NO. 77011
  misc_feature (667)..(667): n is a, c, t, g, unknown, or other
  misc_feature (668)..(668): n is a, c, t, g, unknown, or other
ggagctccccgcggtggcggccgctctagaactagtggatcccccgggctgcaggaattcgtctcacccctagaaaaaatcagccatcccctcccgcggcaagtctctctgaattgtgggtctccggcgatggcggctctagctccatccaagattctgggcaccaagctcaacttcgccggctcctcccgctacgccacggcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccggatgggctcttggaccgctcggaggtaccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcgtgcaacaagttcggcgctaactgcggccccgaggccgtctggttcaagaccggcgccctgctcctggacggcaacaccctcagctatttcggcaacagcatccccatcaacctggtggtcgcggaatccnncgggaaggccggtcctcgttcggcgggcgccgaagtacgaccgggatcaatcaacgggactgggacctcgagggacaagactgcacccccgggtgggcccccttcggaaccccctgggggcttgggcccagcgaacccccgaaccagggccggcccatccctccaagaggggaaggggagatccaagaacccg

SEQ ID NO: 77011 - protein, 244 aa, Zea mays
  misc_feature: Ceres CLONE 1561875
  misc_feature (83)..(237): Pfam Name: Chloroa_b-bind Pfam Description: Chlorophyll A-B binding protein
  misc_feature (180)..(180): Xaa is any aa, unknown, or other
MAALAPSKILGTKLNFAGSSRYATAAPTAGAQKIVSLFSKKPAQKPKPSAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLSYFGNSIPINLVVAESXGKAGPRSAGAEVRPGSINGTGTSRDKTAPPGGPPSEPPGGLGPANPRTRAGPSLQEGKGRSKNP

SEQ ID NO: 77012 - DNA, 781 bp, Zea mays
  misc_feature: Ceres CLONE 1561882
  misc_feature: Encodes the peptide sequence at SEQ ID NO. 77013
ggagctccccgcggtggcggccgctctagaactagtggatcccccgggctgcaggaattcgtctcacccctagaaaaagaaatacaatacctctcttcagaaattactgatgaatctattgatcgaaaatgcagggaagaattatcagaagaagactatgctgagatttccctcctacagaagagactaaaggaagagaagcagatcagaaatgagctgaaaaaaaagatggaactggagagaatggctgcatggaaaaatcggttagaggaatttgaaagtggccatcttcctttcatgtgcctgcaatacaaagataaggattcaattcagcacacgatccctgctgtatttattggaaacctcaactcatttgctgatcaaaagatcatgaacatggtggaagatgattcacttgtttctggcaagccgaaacgtgatagtggggaacaactttatcgcccatcttactatgtagctttaagttcagataattcatggtatctgttcacagaaaaatggattaaaactgtttacaagacaggtctacctgctgtccccttctgttgaagggggcacactcccctagagaaaccctgaaacagctccctcctgcgtgaaagagtgggtgtggggaataaagttgaaaaaatcagaatacgggctcttttgtaaaggcatgggaagggtccttttagacacatggggtcggtggaagtcctcaaattgtttccctggtgccttaaattagcccttttcggaaagaacaatggaagggtga

SEQ ID NO: 77013 - protein, 189 aa, Zea mays
  misc_feature: Ceres CLONE 1561882
GAPRGGGRSRTSGSPGLQEFVSPLEKEIQYLSSEITDESIDRKCREELSEEDYAEISLLQKRLKEEKQIRNELKKKMELERMAAWKNRLEEFESGHLPFMCLQYKDKDSIQHTIPAVFIGNLNSFADQKIMNMVEDDSLVSGKPKRDSGEQLYRPSYYVALSSDNSWYLFTEKWIKTVYKTGLPAVPFC

SEQ ID NO: 77014 - DNA, 757 bp, Zea mays
  misc_feature: Ceres CLONE 1561883
  misc_feature: Encodes the peptide sequence at SEQ ID NO. 77015
  misc_feature (537)..(537): n is a, c, t, g, unknown, or other
  misc_feature (542)..(542): n is a, c, t, g, unknown, or other
ggagctccccgcggtggcggccgctctagaactagtggatcccccgggctgcaggaattcgtctcacccctagaaaaaccccctcggaaggatggcggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcgtctatacagacgaccaaaaagagcaaatggcgcctcagtctcccgcgcgcaagctacaacggttcagggtccggtgctgcggcggctgagccgtctaccgtgggagacaccttggaacgggaggagggcggcggcacagaggcaggcgcttcggctgatgagtcatccaaccggaagcagccgccccctgttgaccccaagattgagaaggagctcaagaaagtagttcagaagactgcggncaccntttgccaccaagggccgtccacgaaaaacaagaaaccctgctgtccctggaaattacctgggaaacccgtcttttaaattccagggctttggtttccatggccggttggggggaaaaacttttccttcaaacccaaaatccccctcgaaaggggcccaaaactttgggggggtaaatggggaaaagggggcccctttgggggggggtcccaaaac

SEQ ID NO: 77015 - protein, 175 aa, Zea mays
  misc_feature: Ceres CLONE 1561883
  misc_feature: SWISSPROT Homolog: EC 2.7.9.1 Pyruvate, phosphate dikinase
  misc_feature (149)..(149): Xaa is any aa, unknown, or other
  misc_feature (151)..(151): Xaa is any aa, unknown, or other
MAAAVSRAICVQKPGSKCSRDREATSFARRTVAAPRPPRAKAAGVIRSDSGAGRGQQCSPLRAVVDAASIQTTKKSKWRLSLPRASYNGSGSGAAAAEPSTVGDTLEREEGGGTEAGASADESSNRKQPPPVDPKIEKELKKVVQKTAXTXCHQGPSTKNKKPCCPWKLPGKPVF

SEQ ID NO: 77016 - DNA, 891 bp, Zea mays
  misc_feature: Ceres CLONE 1561884
  misc_feature: Encodes the peptide sequence at SEQ ID NO. 77017
  misc_feature (561)..(561): n is a, c, t, g, unknown, or other
ccccgcggtggcggccgctctagaactagtggatcccccgggctgcaggaattcgtctcacccctagaaaaagaagcagcgcaggcgcagggcattccagaacgttcggcgccggcgaggccacacgcccaccatcagtcagccgccccgccaaagccatgcgcctccccgccggcgcacgcctcgcgctcctgctcgcccgccgctccctctcgtcctccccccgcatcccgcgggcgcacacagggatatggagcgaggcgccctcccggagctctcccttctctccgccgagcagcgcccgcaggtccttccacgggaccaggccggtggcggcaagggactactacgatgtgctcggcgtcagcaagagcgccagccaggcggagataaaaaaggcctattatgggcttgcaaagaagctccacccagacacaaataaaggtgatgcggatgcagaacgcaagtttcaagagggtcaacgagcttatgagactttaaaggatgaacaaaaagatcattatatgatcaggttggccctgatcagtatgagaaaactgnctctggcggaagcggaactggcttcgagggtggttttggaaaccatttgaggatattttggtggtggcggtggcggtggtagaattaatgatttctttaggacattttcggggatagggactttggaggacgagatgttaaggttgcactcctactatcattttgggggaacagttcaaggggggcagcaaaacgggcaccttccaaaacgtctgtaacatgggaaaaccgggggggggagcggtggggcctcctgaaacccaaccgaaaacagtcttacttgggaggggttcgggaattttatttctggaaaccggggcattcgggatg

SEQ ID NO: 77017 - protein, 150 aa, Zea mays
  misc_feature: Ceres CLONE 1561884
  misc_feature (62)..(123): Pfam Name: DnaJ Pfam Description: DnaJ domain
  misc_feature (135)..(135): Xaa is any aa, unknown, or other
MRLPAGARLALLLARRSLSSSPRIPRAHTGIWSEAPSRSSPFSPPSSARRSFHGTRPVAARDYYDVLGVSKSASQAEIKKAYYGLAKKLHPDTNKGDADAERKFQEGQRAYETLKDEQKDHYMIRLALISMRKLXLAEAELASRVVLETI

SEQ ID NO: 77018 - DNA, 799 bp, Zea mays
  misc_feature: Ceres CLONE 1561886
  misc_feature: Encodes the peptide sequence at SEQ ID NO. 77019
  misc_feature (708)..(708): n is a, c, t, g, unknown, or other
  misc_feature (711)..(711): n is a, c, t, g, unknown, or other
  misc_feature (745)..(745): n is a, c, t, g, unknown, or other
agctcaccgcggtggcggccgctctagaactagtggatcccccgggctgcaggaattcgtctcacccctagaaaaaagagccagcagcgggggctggagcactcaccactcagcagcgatcgcagcaccgcggcgagataatgagcagcagcctgtcctccggcatctctgcctcgccatctgcagcggccagcaccgctcggcgccgccatgacgcagcgccgcagcagctgacgagggtgaaggcggcggcgcggccacagctgctgcacgccggccgccggcgttcgagtgtcgggaggaggccgggcggcggcgcggtgggtggtgagggccgggcctgggccactgtcggagatcgagccggacctggaggaggacgccatcgacgtgtaccgcaccaacggcatcagcccggaggacttcgagtacgggaagtatgacggacaccacacctatttcgaaggtcaagacaagaagggctgtctgggaaggatgtctccgagtggtaccaagaagctgagcctcctcagggctttcaagcactcatctcctgggcatttcctcctgcgatcatcctcggcatggctttcaatggccggggggagtacctgtacatcgggggcggccgtcttccatcgtgggtgttctgcgtcatcgagatgggcaagcccgacaagctgcacaacttcgaagccggagatctcnttnaattggagaagtcggccccgcgacaagctcatcngccgactacaactcccatggacatctgggacttccaacgaagaagtacggcgaa

SEQ ID NO: 77019 - protein, 71 aa, Zea mays
  misc_feature: Ceres CLONE 1561886
  misc_feature (42)..(42): Xaa is any aa, unknown, or other
  misc_feature (43)..(43): Xaa is any aa, unknown, or other
  misc_feature (54)..(54): Xaa is any aa, unknown, or other
MAFNGRGEYLYIGGGRLPSWVFCVIEMGKPDKLHNFEAGDLXXLEKSAPRQAHXPTTTPMDIWDFQRRSTA

SEQ ID NO: 77020 - DNA, 1302 bp, Zea mays
  misc_feature: Ceres CLONE 1561887
  misc_feature: Encodes the peptide sequence at SEQ ID NO. 77021
aactctctaccagtctaccctaaccagcccgacagccgccgccgtttctccatcttcctcgcagcgccggcactacatcttcgctcccaccccgactcgcgctcaacacgcaggcgacggcggcagcgctcaggctcgggctctcagggacggcggggcagtcccagactcggcgtcgtcgtcagcggctacccttcccgcctctcgccaatcgcctcgcgcccgcgactccggtcctccgcacaccggcctgcgaccctgccaatagtgtataacttggagatatggatttgcaagagaagacgaccccaactcataaaggaaaaggaaagaaaaaagaaagcgcaaagaaaaaagaaagatcaaggaagagaacgtcatctgttttggattccactaatgacacagtcatcagcgaggaaatgtcagagtataatcttgatgaacctactatggaggaaaaactggcaaccctgaatttaatcaatagagagaatgaaatacatggtactgagaagcaatcgctctctgtggcaccaccaagtgcagattcagtccatatcttgctgaagcaagctcttcgtgctgatgataatgtagcactgttaacttgcttgtataatagagatgagaaggttattacgaagtctatatcactcctaacaccagcagatgttgtgaagcttctcaagttctttgtcttgcaaatacaatctaggggtgcagtattggtttgtttactcccgtggctgcaaactttattgaatcgacacatgagcagcatagtgtctcaggagtcttctctgtcattgctcaactcgctctaccagcttattgatgcaagaacgtcaacatttaagtcagcattgcaactctctaccactctagattaccttttcagcgagattgctgaggatgaagctgatgaggaggtaccgccaccgataatctatgaagacaaggacactgatgatgacgagtctgaagttgatgctatggaaaccgacagagaagaggctgaagagctaggtgctgttactgatgcctctgaaagttcagatggaagtgagatcatgagcgactgattgccttttactctcccaactgctgaagtccaaatatcgacatcaattattcacgtaagatggaattcacgataattgcttaagatagttgtgcttgtactttgtggatcttaattgagtgaatgtttcaaatagcttttggatgacatattgacatttgagctgagaaaagggtagttaatgcaattgattgagtaaagcaaaaaaaaaaaaaaaa

SEQ ID NO: 77021 - protein, 266 aa, Zea mays
  misc_feature: Ceres CLONE 1561887
  misc_feature (119)..(205): Pfam Name: NUC189 Pfam Description: NUC189 domain
MDLQEKTTPTHKGKGKKKESAKKKERSRKRTSSVLDSTNDTVISEEMSEYNLDEPTMEEKLATLNLINRENEIHGTEKQSLSVAPPSADSVHILLKQALRADDNVALLTCLYNRDEKVITKSISLLTPADVVKLLKFFVLQIQSRGAVLVCLLPWLQTLLNRHMSSIVSQESSLSLLNSLYQLIDARTSTFKSALQLSTTLDYLFSEIAEDEADEEVPPPIIYEDKDTDDDESEVDAMETDREEAEELGAVTDASESSDGSEIMSD

SEQ ID NO: 77022 - DNA, 833 bp, Zea mays
  misc_feature: Ceres CLONE 1561889
  misc_feature: Encodes the peptide sequence at SEQ ID NO. 77023
  misc_feature (762)..(762): n is a, c, t, g, unknown, or other
ctggagctcaccgcggtggcggccgctctagaactagtggatcccccgggctgcaggaattcgtctcacccctagaaaaaattcccattcccacccgtccatccatcctccgaagctcctcggcagacaagcagcagcgagagaaagcaagcaaggcagaggcagttgtgttgctggtcggtccgtccatggcgcccaagagaccagtgtcggcggcggcggcggcggagcagccgaggctgcgcggcgtgcggaagcggccgtggggccggtacgcggcggagatccgcgacccggtgcggaaggcgcgcgtgtggctgggcaccttcgacacgccggagcaggcggcgcgggcgtacgacgccgccgcgcgcaagctccgcgggcccggcgccgccaccaactaccccgccccggagccgacggcggaggcgttggcggaggctccagcggcgagcgggagcgggagcgccgtggtgtacgagtcgtcgtcggcgtcggcgtcggcgtcgtcgtgctccctgccgctggcggccccgtcgctgggactcaacctggccctgcccggctgccgcggcgggccccaaagccctacccaacttgtttccgggaacccggcgggcgggggggcccccccttgaaaccccggggcccttttttgcaacttttttttgcccccccccaaaaagcgaggggaaacccccaaaaacctcccctcggggggttaaacggcggggggggcccccccccgcggcgtgttgnttttttttaagggttttaaaaaaaggcggggcccccccccctggggggggcctccccgcggtgtgggacac

SEQ ID NO: 77023 - protein, 150 aa, Zea mays
  misc_feature: Ceres CLONE 1561889
  misc_feature (16)..(67): Pfam Name: AP2 Pfam Description: AP2 domain
MAPKRPVSAAAAAEQPRLRGVRKRPWGRYAAEIRDPVRKARVWLGTFDTPEQAARAYDAAARKLRGPGAATNYPAPEPTAEALAEAPAASGSGSAVVYESSSASASASSCSLPLAAPSLGLNLALPGCRGGPQSPTQLVSGNPAGGGAPP

SEQ ID NO: 77024 - DNA, 929 bp, Zea mays
  misc_feature: Ceres CLONE 1561891
  misc_feature: Encodes the peptide sequence at SEQ ID NO. 77025
ctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactaccctcgggaacccgagcctcatccacgcgcagagcatcctcgccatctgggccttgccaggccgggctcaatgggcgccgtccaagggttaccgaatcgcccggggcccgctccgggaaggtcgtcaaacccgctctatcccggggggaagttttcaaccggttgggccctcgcaaaaaaccccaaggccttccctgaacctcaaggggaagaactccaaaaacggcccccccgccagtgtccccaggttcggaacttccgcccaggcccatgtacccgggaagagcccctcaagaaaccccgtgaaaatttggcaaccccctaaaaaaaaagttggggccccccccca

SEQ ID NO: 77025 - protein, 253 aa, Zea mays
  misc_feature: Ceres CLONE 1561891
  misc_feature (65)..(219): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYPREPEPHPRAEHPRHLGLARPGSMGAVQGLPNRPGPAPGRSSNPLYPGGKFSTGWALAKNPKAFPEPQGEELQKRPPRQCPQVRNFRPGPCTREEPLKKPRENLATP

SEQ ID NO: 77026 - DNA, 898 bp, Zea mays
  misc_feature: Ceres CLONE 1561892
  misc_feature: Encodes the peptide sequence at SEQ ID NO. 77027
  misc_feature (415)..(415): n is a, c, t, g, unknown, or other
  misc_feature (477)..(477): n is a, c, t, g, unknown, or other
ctggagctccccgcggtggcggccgctctagaactagtggatcccccgggctgcaggaattcgtctcacccctagaaaaaacctcgcccccgaaccttggcgtctgccctaccaaccgcagcagcgacactagaatggccgcggcgccgtcatccctcgcgtcctcccacctctccccaatcgcggcggtgtccactcccgccgtcccacatcagcttcgcatcggctgctcccgccgccgcgcccagcgcatcgttgccatggctggatccggcaagttcttcgtcggaggcaactggaagtgcaatggaacaaaggactccattagcaaacttgtctctgaattgaatgctgctacccttgaaactgatgtagatgttgtggtggcacctccattcatctatattgatcaggntaaagaatcactaactggtcgcattgagggttctgctcagaatgtgtggattggaaaaggangagcctacaccggagagatcagtgcagaacaactgggtgaacatcggctgtcaatagggtaatcctgggacacccctgacgtaaaccttttattggggaaaatgatgagtttatttggaaaaaaagctgcctttgcctggacccaaaaggtaaaggtttttgccccgcctagaaaacctcctggaaaaaagggaaccgggaaaacttttttatttttttttaaggaaaaaaaggctttttcaaaaaattttttcaaaccggggaaaatggttaattttcttaacaaccccttttgggggaattaaaaaacaaaaaaatttttttctccctgaaaacccccgaaaaatttcgggccgttaacccaatgtggggaaaaaaaaatttatcccccggggtgggcccccacccaccaaaaaaatag

SEQ ID NO: 77027 - protein, 134 aa, Zea mays
  misc_feature: Ceres CLONE 1561892
  misc_feature (49)..(133): Pfam Name: TIM Pfam Description: Triosephosphate isomerase
  misc_feature: SWISSPROT Homolog: EC 5.3.1.1 Triose-phosphate isomerase
  misc_feature (94)..(94): Xaa is any aa, unknown, or other
  misc_feature (115)..(115): Xaa is any aa, unknown, or other
MAAAPSSLASSHLSPIAAVSTPAVPHQLRIGCSRRRAQRIVAMAGSGKFFVGGNWKCNGTKDSISKLVSELNAATLETDVDVVVAPPFIYIDQXKESLTGRIEGSAQNVWIGKGXAYTGEISAEQLGEHRLSIG

SEQ ID NO: 77028 - DNA, 766 bp, Zea mays
  misc_feature: Ceres CLONE 1561893
  misc_feature: Encodes the peptide sequence at SEQ ID NO. 77029
  misc_feature (704)..(704): n is a, c, t, g, unknown, or other
ctcaccgcggtggcggccgctctagaactagtggatcccccgggctgcaggaattcgtctcacccctagaaaaaacctgctgctcgagctcgacctacgagcgcgcgcaccaccacccccacccacacccccacccgatcccgatctcaccgtctccaccccgaccccctcccaccaatctccaacagcatctaatcaatcaagacagccccgcgctagctcacccgccggggctcgccacgatgagaggcctcctcgcgtgcgccaccctcgcccgccgcgccgccgcctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtggcccacatgtgcggcctcagcctcaagggccgcggggccatcccccttctcgagtccctcgtcgtcgccgacgtcgccgcgctcaaggacgggcaccggcaccctcaacgtcttcaccaaagagcaaggcgggggcatcgaagactccgttatcggccaaggtcacggaccaccacatcttacctcgtcgtcaacggccggatgcanggaacaaggacctccgccaccatgaagggcgcacatgggaggctttcaaccaggaagggggg

SEQ ID NO: 77029 - protein, 174 aa, Zea mays
  misc_feature: Ceres CLONE 1561893
  misc_feature: SWISSPROT Homolog: EC 2.1.2.10 Aminomethyltransferase
  misc_feature (154)..(154): Xaa is any aa, unknown, or other
MRGLLACATLARRAAASSAPARVRHLAGAAEAAEAELKRTALYDFHVAHGGKMVPFAGWSMPIQYRDSIMDSTVNCRANGSLFDVAHMCGLSLKGRGAIPLLESLVVADVAALKDGHRHPQRLHQRARRGHRRLRYRPRSRTTTSYLVVNGRMXGTRTSATMKGAHGRLSTRKG

SEQ ID NO: 77030 - DNA, 1089 bp, Zea mays
  misc_feature: Ceres CLONE 1561894
  misc_feature: Encodes the peptide sequence at SEQ ID NO. 77031
  misc_feature (219)..(219): n is a, c, t, g, unknown, or other
  misc_feature (234)..(234): n is a, c, t, g, unknown, or other
  misc_feature (239)..(239): n is a, c, t, g, unknown, or other
  misc_feature (248)..(248): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (269)..(269): n is a, c, t, g, unknown, or other
  misc_feature (302)..(302): n is a, c, t, g, unknown, or other
  misc_feature (972)..(972): n is a, c, t, g, unknown, or other
tccccgcggtggcggccgctctagaactagtggatcccccgggctgcaggaattcgtctcacccctagaaaaagttccagcacgtactcaccgcaccccccgacggcccgacacgtccgtgctggcttgtacttgcacgccacaccaccacccagcccccaacgatgacggcggcggcggcaccggcaccggcggtcgctagcagggtgtgggagtggngtaggggaaggtggnttttnttttttttntatttnnnnnnnnttttattnttttttttttttttggatttctttgtttttttntcctttttttttttttttttttgtttttttgtttttggtgttggtggtatctgttttgtgggggtagggaaggaggtaactataatattggaccccccccctgtgtgcttgtcaacccgggatatgcatgcaagtaatcgcgaacgccttcgcttaatcgttttgtctttgatcccgatgtttatcggggctttgattcacttttttttcgaccttgtctccccgcgctactatagggaaagttctaggggaaagaccggaagtaatcactagaccatcgctctacaataatttaatttcttgatggtttatagagttttacacccccgagtgatattggtagcccccctttagtcccccgggtatgatgtgctaccgccgtgtttacggcggtaatggatagtatcatatagctactaattcatgatacatcatcagttagaggtgtgcacgctgattatctttagttgcctgcccacctcttggagacagtaccattagaaatcggtacagagattattaccgctggtgtgtatggtatctaacaacccatatgatctctcccccgaaataatatcgtacgctgacgctgctgtatggttctataggcactacgcaaagcactatgtccttgctccaccgtcgtatttagagttcatttaatgtgtcnagccactatcacatctataggctgaccctcttgattattgatcaccacctgtcctgcgtttagtggaaacatatatgcggcacgttgttatgaattagtagcttagtggacccggtg

SEQ ID NO: 77031 - protein, 136 aa, Zea mays
  misc_feature: Ceres CLONE 1561894
  misc_feature (19)..(19): Xaa is any aa, unknown, or other
  misc_feature (24)..(24): Xaa is any aa, unknown, or other
  misc_feature (25)..(25): Xaa is any aa, unknown, or other
  misc_feature (28)..(28): Xaa is any aa, unknown, or other
  misc_feature (30)..(30): Xaa is any aa, unknown, or other
  misc_feature (31)..(31): Xaa is any aa, unknown, or other
  misc_feature (32)..(32): Xaa is any aa, unknown, or other
  misc_feature (33)..(33): Xaa is any aa, unknown, or other
  misc_feature (35)..(35): Xaa is any aa, unknown, or other
  misc_feature (46)..(46): Xaa is any aa, unknown, or other
MTAAAAPAPAVASRVWEWXRGRWXXFFXYXXXXLXFFFFLDFFVFXSFFFFFFCFFVFGVGGICFVGVGKEVTIILDPPPVCLSTRDMHASNRERLRLIVLSLIPMFIGALIHFFFDLVSPRYYRESSRGKTGSNH

SEQ ID NO: 77032 - DNA, 802 bp, Zea mays
  misc_feature: Ceres CLONE 1561895
  misc_feature: Encodes the peptide sequence at SEQ ID NO. 77033
  misc_feature (732)..(732): n is a, c, t, g, unknown, or other
  misc_feature (734)..(734): n is a, c, t, g, unknown, or other
ctccccgcggtggcggccgctctagaactagtggatcccccgggctgcaggaattcgtctcacccctagaaaaagcgacgaactcatcactgcactggtggtgcccgtggtgctccacagagtgaagcgatagccaggagaggcgacgatgcgcaagtgggcgctctcctccgcgctcctcctcctctttctcctcaccacactccccgacccagctaagaagctacaagtgaatgccgaggagagcagcgatgacttggctaacccaccgaaggtagaggagaagtttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttctcttactgataaggaagttctaggtgaaggggacactgcaaagcttgagattcagattaagttggacaaagagaagaaaatcctctccattcgggatagggggtattggtatgacccaaggaagatctttattaagaaccttgggaacgattgctaaaatctggcactttcagctttttgtggaaaaagatgcagtcctggaggtgacctcaatcntnattgggaacagtttggtgttgggcttctactctggggtacttggtttgctggactattgtttgaagtg

SEQ ID NO: 77033 - protein, 174 aa, Zea mays
  misc_feature: Ceres CLONE 1561895
MRKWALSSALLLLFLLTTLPDPAKKLQVNAEESSDDLANPPKVEEKFGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGYWYDPRKIFIKNLGNDC

SEQ ID NO: 77034 - DNA, 945 bp, Zea mays
  misc_feature: Ceres CLONE 1561898
  misc_feature: Translation starting site: 194
  misc_feature: SWISSPROT Homolog: EC 1.11.1.11 L-ascorbate peroxidase
  misc_feature (496)..(496): n is a, c, t, g, unknown, or other
ctccccgcggtggcggccgctctagaactagtggatcccccgggctgcaggaattcgtctcacccctagaaaaaccttcccatcccccactgctcagcagtcagtcagcactcgccacccacacgcctccgctccgcccacggttccactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacacccatggttcaaatgctggtttaaagattgctatcgatctccttgagcctatcaaagcaaagatccaaagataacatatgcagacctgtatcagctttgctggagtgggntgcagtcgaagtgactggggggcaaactggttgaatttatccctggcagaacgtgattcgtccgtgtgccccccgtggaggggcgtctgccagatgcctagaaaaggtgcaccacatctgaaggacatccttttatcggaatgggcttatcggacacaagatattgtagctctattcagggggacattactctgggaaaggctccaccctgagaagtctgggattccaatgtgcctggacaagggagccccttaagtttgatacccatacttttcttgagctgttggatggagaatctgaaggactttttaagctcccaactgacaagcacggttatcagatctgaatttaggggctaccggagctcttgccagggatgaaaagcctcctttcaaattatgctgaatcaccagaaaccccctgacttgggtcacgctcgagccagcacc

SEQ ID NO: 77035 - DNA, 824 bp, Zea mays
  misc_feature: Ceres CLONE 1561900
  misc_feature: Encodes the peptide sequence at SEQ ID NO. 77036
ctccccgcggtggcggccgctctagaactagtggatcccccgggctgcaggaattcgtctcacccctagaaaaacttccaaagccttcgcattttcctctcgtcttcccctcccccttactccaaattaccaccccctgctatctacatatcctgtccacactctccctccctgcgctgggccttgcagtttttggttgtgtatcggggaaatggcaatcgacgacgaatcgccgatcagagtcaacagcagaggcggcggcggcatgggaggaggggagcgcgacggggcggagaaccagcggtggccgccgtggctcaagccgctgctggggacgagcttcttcggccaatgcaagctgcacgcggacgcgcacaagagcgagtgcaacatgtactgcctcgcctgcatgaacggcgcgctctgctcccagtgcctcgcctaccaccgcgaccaccacgccatccagatacggaggtcctcctaccacgacgtgatccgggtgtcggagatccagaaggtgctggacatctccggcgtgcagacgtacatcatcaacagcgcgcgcgtggtgttcctgaacgagcgcccgcagccgaggcccggcaagggcgtcaccaacacctgcgaggtctgccagcgcagcctcctcgacaccttccgcttctgctccctcggggtgcaagatcgtggggacctccggtgaacttgcgcgtccggaaaaagcaggcccgtcgtcagaagaacagaagaagaagccggcgcagcagcagcagcagcacaaggggcgccgcgttggactcgggaggacgactcttccgtcc

SEQ ID NO: 77036 - protein, 164 aa, Zea mays
  misc_feature: Ceres CLONE 1561900
  misc_feature (48)..(157): Pfam Name: PLATZ Pfam Description: PLATZ transcription factor
MAIDDESPIRVNSRGGGGMGGGERDGAENQRWPPWLKPLLGTSFFGQCKLHADAHKSECNMYCLACMNGALCSQCLAYHRDHHAIQIRRSSYHDVIRVSEIQKVLDISGVQTYIINSARVVFLNERPQPRPGKGVTNTCEVCQRSLLDTFRFCSLGVQDRGDLR

SEQ ID NO: 77037 - DNA, 883 bp, Zea mays
  misc_feature: Ceres CLONE 1561904
ctccccgcggtggcggccgctctagaactagtggatcccccgggctgcaggaattcgtctcacccctagaaaaattccgtactgctcgactgctctgcgtgtccgcctctgcctctctctctctctctctctctgtccacattgatttggtggccgcggccagtgacgaccgtggcaggccgacggtcggcctcaggtcgactgcgttctctaggacttcgttgtccccttcacagggggctaccaacgagctttgcaaggtcttcattgtcaccttcggcttcgactgtcgcagccacttccacagctcttggtgctgccccttccccggtcacgggactgaagataatatggctgcctcaccattgatcaccgcagaagactgtgatgctaatgctgctatcattaaaaattggagatcaatctgctctccaaaactatcttccaaatcgaagggaggcccctagacttttctcgggggcccggttttccaaactaaaaaatattttaaaagatgaaactttccccctccgggaagtttcccttaaagcaaaaaagggccccggaggggggtccctgggggggtttaaacccccagtggggaaccctgggctttggggaaaaattttgggggggggaaacccttggcccctgccgaatggcaagaaccaaaggggggggggaggggaaccagtgggctacatggggcgagaatcccatagttggtgcgggccaaaacaaacctgggaggggcaaggttttgcctccccatggttctccccaaaattaaaccccccttttagaaaaccccctaaccagaaaaagagggcctcagtggccaaaaaacccctgccccccccttgtaaacatttgttaagggggg

SEQ ID NO: 77038 - DNA, 904 bp, Zea mays
  misc_feature: Ceres CLONE 1561905
  misc_feature: Encodes the peptide sequence at SEQ ID NO. 77039
  misc_feature (888)..(888): n is a, c, t, g, unknown, or other
ctggagctccccgcggtggcggccgctctagaactagtggatcccccgggctgcaggaattcgtctcacccctagaaaaacatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcgaactgaaacatctgagtagctaaaggaaggaaaatcaaccgagaccccgttagtagcggcgagcgagagcggaacaagggttttcatcaaaagaaatccgaagcggtttcattcgatttgttgtggattggatgatggaaaaaccagcaagcagcaagcgtaggctgtgttgccgtagcgcgccctacggagttgtacaaagtcagcattggggcgcaagcataggcaacacaggacggggtggggcgcgcagtgaactggttttctaaaaagattggaagatccggccaaagaaggtgatagccctgttcattcgttcccatggttcgatccttcccagtaaaacgcggcgtgttcgaatgatgatcgcttttacgcgagaaagggggaccaccctctaagcctaagtattcctcaatgaccgatagcgtacaagtaccgtgagggaaaggtgataagaaccccaatcggggagtgcaatagagaacctgagatccgatgcgaacaatcattctaaggagcggagcgcgggcgcactcactctaacggcgtacctttcgcatgatggttcagcgtagaaatgggtacagcgggctaagccattacgtgtaagcgcctttcagaggtggaatggaagatttaccgtcntcctatttgaccccaa

SEQ ID NO: 77039 - protein, 54 aa, Zea mays
  misc_feature: Ceres CLONE 1561905
MHWMDARALRRKDAFRGERPWGERASVIHGSPIGKPYPSSVASLRSLDFSNLAN

SEQ ID NO: 77040 - DNA, 731 bp, Zea mays
  misc_feature: Ceres CLONE 1561906
  misc_feature: Encodes the peptide sequence at SEQ ID NO. 77041
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (253)..(253): n is a, c, t, g, unknown, or other
  misc_feature (254)..(254): n is a, c, t, g, unknown, or other
  misc_feature (264)..(264): n is a, c, t, g, unknown, or other
  misc_feature (265)..(265): n is a, c, t, g, unknown, or other
  misc_feature (282)..(282): n is a, c, t, g, unknown, or other
  misc_feature (283)..(283): n is a, c, t, g, unknown, or other
  misc_feature (299)..(299): n is a, c, t, g, unknown, or other
  misc_feature (322)..(322): n is a, c, t, g, unknown, or other
  misc_feature (702)..(702): n is a, c, t, g, unknown, or other
nnnnnnnnnnnnnnnnnnnnnnnnnnnnnnnnnnnnnnnnnnnnnnnnnnnnnnnnnnnnnnaaaagtggactcccgcggggcggccgctctgaactatggatcccccggctgcagattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagnncttcctcggnnctaggccctgggtcgcnnccgcgccgccgggcgntcggatggcccgggcgggcccgncaatcaacccatggccgccggccaaccgtttccaaaagaagccgttttcccccccaagaaaggccatttaatggggggtaaacccggggccccctttggaaacccgggcccccccccaaaaaagggttttccccccctttttgggggggccccccccccgggtttttttttcttttttcccccccgggaaaaaagccccccccccgggaaaaaaaagggggccccccccccgggtgtttccccccccgtttttaaaaccacccccccctttttgtggaaaaaaacacccccccccgggggggggcgccccaaaaaaaaaaaaaatttttttttttttccttcccccccccccccccgcccgggggggggggggccccccnaaaaaaaaaacacccccccctcctttttt

SEQ ID NO: 77041 - protein, 29 aa, Zea mays
  misc_feature: Ceres CLONE 1561906
  misc_feature (7)..(7): Xaa is any aa, unknown, or other
MARAGPXINPWPPANRFQKKPFSPPRKAI

SEQ ID NO: 77042 - DNA, 999 bp, Zea mays
  misc_feature: Ceres CLONE 1561907
  misc_feature: Encodes the peptide sequence at SEQ ID NO. 77043
acccgcggtggcggccgctctagaactagtggatcccccgggctgcaggaattcgtctcacccctagaaaaaatttcgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccttgaacatgtgctccaagtgccacaaggagatgataatgaagcaggagcaggcccagttggctgcctcctccatcgatagcattgtcaatggcggtgataatggaaaaggacctgcaattgctgcaactgtaggtgtggcagttcccccacccgaggagaagactatcgccgtgcagcctatgcattgtcgctgaaaccagcgaggctgctgctgttatcgtcgaaggccaaggaaggcccaaaccggtgcgccacctgtaggaagcctgtttgggttgacgggtttttaactgcctatgcgggaaacacgtactgttcgatgctccgcttactccgacaaacacgaattgcctgttccgaccttctgacctgcagcttagggaaggctttccgccaagggcaaatcacttaggttgaaaggcggaaaaagcttgtaaaaatatccggatgcgtgggggctttgtggttaacgaaaataggcttgcccattttttaaaaaattcaacctgttctctcttgctggcattgcccatgcaaactttccattctttttttttgccgtttacgcccccctaggggttcatatattctgattcgaccccgaactcctgttgcctccgcgaaaatattccttctacagcccaactccacaaaatgggttgccctgtttcatctttttccccatgatcccttatctccgtctatctttgtaggtgtttgttgtcgttacacttggtaagatccctcttaattag

SEQ ID NO: 77043 - protein, 93 aa, Zea mays
  misc_feature: Ceres CLONE 1561907
  misc_feature (14)..(38): Pfam Name: zf-A20 Pfam Description: A20-like zinc finger
MEHKEAGCQQPEGPILCINNCGFFGSAATLNMCSKCHKEMIMKQEQAQLAASSIDSIVNGGDNGKGPAIAATVGVAVPPPEEKTIAVQPMHCR

SEQ ID NO: 77044 - DNA, 864 bp, Zea mays
  misc_feature: Ceres CLONE 1561908
  misc_feature (578)..(578): n is a, c, t, g, unknown, or other
tccccgcggtggcggccgctctagaactagtggatcccccgggctgcaggaattcgtctcacccctagaaaaaaaaaaccaccggtgcggtgcggccatggttggccttggcgactccaacacacttgcccaaccatccacacgcgcatggtctgatggtcctgccctttccccttgcttgtatagttagttgccaattgccatcgccaactacctcctctcctcgctcctccaaccaaacaagccaccccccacgaaacccgcaatcccagccgaagccggacgatgaagaggggacggatggcagcacggcgtctgtctggggcagccgcagcaaagtgctgaaagaccgcctcccgggcgacaaccaacttccgacgcccaacacggtcctttgaaaaacggcggcccgcccggggggcaaagaaacccaaaaaaacccttccccgaacacggggaaaatgcccggcggggccccgggggcccgggtttccccccccccccccgggtttccaaggggccgccaaaaaagggccaaggggggccccccaaaatttgtccccccttggaaaaatttncctttaaacaaaacccccttcttgtgtcctggggggggttttttaaaaacaagggccccccgggggaaaagagggggggggtccccccctcttctcctcttttggggggaaaatttggggggcggggaaaaccaccttttccacaccggggggggggggggggggcccaccccccggggggggggagaaggggcccccacaaaaaagggggggtttttttgaagactcttaaaaaaatctttttttttttcccgccccgggggaaaaaaaaaagaaaaaggtgggt

SEQ ID NO: 77045 - DNA, 885 bp, Zea mays
  misc_feature: Ceres CLONE 1561909
  misc_feature: Encodes the peptide sequence at SEQ ID NO. 77046
ctggagctcaccgcggtggcggccgccctcgaactagtggatcccccgggctgcatgacattcgtctcacccctagaaaaaatcccccggagctccacaaaaatctcccctcccaggctcccacccgcgcggagggggctgcaccgcagcagccagcagccgcgcggcgccactgccttgccctcacccaaacgcctcgctttggccgccccccacaaggccactcacccaaaaaatcttcactcctcgaccgcaccgagcagaggatcacatggcatccgccgtttcgcttctcctctcgcccccgcgcctgctccaccgcgacggcacatcccgcctcctcagcatcccgcaccggagggtcctcctcgccgcccccaacaacgcgacccctcgtcggctcctcgcccccgcgccgcgcgcctccaacaacaacgacaacagcggggccgtggaggcgcccgaccgcctcgtggccgcggtcgcctacctatacccgttcctcgacggcgcgcaccacgggcgctttcttctcacgcagttccccttcttcggggcgcttgctccgcccgctgggccccgggggctcgggtctttcaattattggcggttaagcccttccctctttttcctaaaggtttatttcgccgttgtggggaaaccagaaaggggttttccccgtttggtccggttaaaaagaaaaaaagggccgcttgggtaaaaagggcagatcaaatttttcccaaccgggttccccgaattattttccccccccccgggggggggtggggtttcaaaaattcctcaaaaaaaatggaaaaaaaaaggggtttccctctttgaggggggatccccctcggagtacaccggagagggcccccccca

SEQ ID NO: 77046 - protein, 149 aa, Zea mays
  misc_feature: Ceres CLONE 1561909
MASAVSLLLSPPRLLHRDGTSRLLSIPHRRVLLAAPNNATPRRLLAPAPRASNNNDNSGAVEAPDRLVAAVAYLYPFLDGAHHGRFLLTQFPFFGALAPPAGPRGLGSFNYWRLSPSLFFLKVYFAVVGKPERGFPRLVRLKRKKGPLG

SEQ ID NO: 77047 - DNA, 759 bp, Zea mays
  misc_feature: Ceres CLONE 1561910
  misc_feature: Encodes the peptide sequence at SEQ ID NO. 77048
  misc_feature (731)..(731): n is a, c, t, g, unknown, or other
ctggagctcaccgcggtggcggccgctctagaactagtggatcccccgggctgcaggaattcgtctcacccctagaaaaattccattcctatctgaagaaagtatttccttcctcctgaatcctgatctctcacggagttcccctgtatggcgacgcctcgctcaccgagccccagcgccgccgcgcgtctcgattctgcgccgctgctgggcgccgcctccggcggcgggtcccgtcgccgaggtggagcgcttcgccggccctccctccgcggcgcggcgcggctgctgcgtcgcggcgggcggcgggccatgcgggagccctcggtcctggtgcgggaggccgccgcagagcacctcgaggagcggcaggctgactgggcctattcccgccccgtcgtggcgctcgacctgctgtggaacctcgctttcatcaccgtcgctgcggtcgtgctcgtgctcagccgcgacgaggactcgcccatgccgctccggacttgggtcgccggctacacccttcagtgcgtcgtacacatgatttgcgtcgcaatcgagtacaggatgcgccacggccagcggggcggcgccggcgctggcgcagcgcccgcagacgtggaaaggggcagcgacgcatcgtcctcatccagtgacgaggatgacagggagctcgatctccatggtcgccgcactgattacgccagtattgcgaagcacttggagtctgctaatancatgttctccctcatatggtgggatatt

SEQ ID NO: 77048 - protein, 149 aa, Zea mays
  misc_feature: Ceres CLONE 1561910
  misc_feature (140)..(140): Xaa is any aa, unknown, or other
MREPSVLVREAAAEHLEERQADWAYSRPVVALDLLWNLAFITVAAVVLVLSRDEDSPMPLRTWVAGYTLQCVVHMICVAIEYRMRHGQRGGAGAGAAPADVERGSDASSSSSDEDDRELDLHGRRTDYASIAKHLESANXMFSLIWWDI

SEQ ID NO: 77049 - DNA, 1041 bp, Zea mays
  misc_feature: Ceres CLONE 1561911
  misc_feature: Translation starting site: 205
  misc_feature: SWISSPROT Homolog: EC 2.5.1.18 Glutathione transferase
ccctgtgcggcatgtcctccctcttttcctcttgcctctcactttttttttttttgttgtttcaaagctggagctccccgcggtggcggccgctctagaatagtggatcccccgggctgcaggaattcgtctcacccctagaaaaaagctcattaccacctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccgtacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaacaaccaggtgaaaggtgagagtttggatctggtcaagtacattgacagcaactttgaaggcccatcgttgctcccagaggatccttcaaaaaagcagttcgctgaggagctgcttgcatatactgatgcatttaacaaagcattatacttttgtatagtctccaaggaagatgtgtctgaggaagctgtcgctgctttggataaaatagaagacgccctcgggaaattcaacgagggtccattctccccttggtcagttcagtctggtggacattgcgtatgtaccattcatcgagaggtttcagaaattccattccaacataaggaactttgatattacaaaggggagaccccaccttcaaaagttcttggaggaagtggacaaaaaggatggtttcccccggactaaccgggacccccggttttttacttgaacagaacaaagaagcgccttgggatgccttaaaacttgcggcccaagaagaccttcgcacgaatatcccggctagtagaccgacacctgttatggcaattgggggctcggataagggatcccaccttgtgggtgtaa

SEQ ID NO: 77050 - DNA, 817 bp, Zea mays
  misc_feature: Ceres CLONE 1561912
  misc_feature: Translation starting site: 537
  misc_feature (423)..(423): n is a, c, t, g, unknown, or other
  misc_feature (722)..(722): n is a, c, t, g, unknown, or other
tggagctccccgcggtggcggccgctctagaactagtggatcccccgggctgcaggaattcgtctcacccctagaaaaaattcccaatctcgtcttgtgttgttcggagcgggcagcagcacacagccccatcccaatcctagtcgatcttcttcccctcctcaagccggttccttcgtccacacgaccgcgcgctcggaaaactccgcggagggcgaaggaggcgaaccaagggcgacgtatccgccgctggagaaggtagccctcgatccgccgtctcccgcgattcgtttgtcttgcgacagctgggcgaccgtcgtcgccgccgcccttctccaggtgcccaggtcttcgccggtccctttgccgcctccttgccgccgacgagcaccagccaggaagaaaagaagctgaaccatgggngaagagaaagtcagctgctaagccacctcctaagaagcagatggacaagcttgacactgtcttttcctgcccattctgcaaccacgggagttagtgttgagtgccgaattgacatgaagaatctgattggcgaagcatcttgtagaatctgtcaggaaaacttcagcacaactgttaatgcactcactgagcctattgatatatatagtgaatggatttgatgaagtggtgagcgtgtcaacactgttgaaggcgaacgatgatgcgtgagcttgccccatgtgatgaaactgttaccntacatcgtaatggtaaggtgctggtattctcgaatgccatagcccatagtcagcatggcctgggaattacgtagtggctgaatggatatgccaga

SEQ ID NO: 77051 - DNA, 787 bp, Zea mays
  misc_feature: Ceres CLONE 1561914
  misc_feature: Encodes the peptide sequence at SEQ ID NO. 77052
ctccccgcggtggcggccgctctagaactagtggatcccccgggctgcaggaattcgtctcacccctagaaaaagcgctgcgctcgcgtctctcgtccccctcagatccaccgactcgctctgagtctctgaccgccccttccgtcgtccccgttcgaaggcgcggcaagcgagcgattcagccagattcgattcgacatgaatcccgagtacgactaccttttcaaacttctgcttattggtgattctggtgttgggaaatcatgcttgcttctcagatttgcggatgattcatatttggacagctacatcagcacaattggggttgattttaaaattcggacagtagagcaagatgggaagaccataaaacttcaaatttgggatactgctgggcaagagcgcttcaggaccatcactagcagctactaccgtggagctcatggaatcattattgtatatgacgtgacagaccaagaaagcttcaataatgtgaagcaatggttaaatgaaattgatcgttatgcaagtgacaatgttaacaagctccttgttgggaacaagagcgacctaactgccaacaaagttgtggcaactgagacagcaaaggcatttgctgatgagatgggcatcccgttcatgggagacgagtgccaatatacgcaccaaacgtggagcagggctttcattggctatgggctgcatccatcaaaggacaggatgggccaagcaaaccagccgcgggcaacgcaaggccagcgaacggtgcagatccggcgggcaaccc

SEQ ID NO: 77052 - protein, 196 aa, Zea mays
  misc_feature: Ceres CLONE 1561914
  misc_feature (10)..(154): Pfam Name: Ras Pfam Description: Ras family
  misc_feature (10)..(124): Pfam Name: Miro Pfam Description: Miro-like protein
  misc_feature: SWISSPROT Homolog: EC 2.7.11.1 Non-specific serine/threonine protein kinase
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMGDECQYTHQTWSRAFIGYGLHPSKDRMGQANQPRATQGQRTVQIRRAT

SEQ ID NO: 77053 - DNA, 1048 bp, Zea mays
  misc_feature: Ceres CLONE 1561915
  misc_feature: Encodes the peptide sequence at SEQ ID NO. 77054
  misc_feature (1048)..(1048): n is a, c, t, g, unknown, or other
ctccccgcggtggcggccgctctagaactagtggatcccccgggctgcaggaattcgtctcacccctagaaaaaattcccccccttccgtccgctgcatccctccgccgccaccgccgcccaagccaggtgctgaggctttcgttggtctcttcgccggcgacgagcacccaccagggcacgggcctcaggatgcagtccttggtccggaatgtctgccgagccggaagccgtggagcggcggcgaggctcctggaggccgccgcggttcatccgggggcggcgcagccgtcctcggccgtcagacacctcaggcatccttgcgggttcgctcgtccgatcggggtagatcaacccaagcctgtgcagcgccggaccattttgcgtgatggcggccgcgttccggctgccgcctccggattcggtctctgcgcgaaaagtctcgttgcgacgaggggtctgtcgacggcgggaaatgctgctgaagttgcctctgattcggacgattccacctcctcctgcggtttgaagccccccccgcgccatcaagtttcaagaaggcctggacaagaaccgctaggaaccatttattgaatatccctgaaaaaaaaaaggccggttccaaaaaggtcccccctccggaaaaaaggcaaattccctggtatgtccaccccgtggaatttttcctctttcgaaaataaaatttcccagatttcctgtaaaaaaacaaatggggccggaggttcataccctctaaaagggatttgttcctttgtgaaagggccccccccttgggagaacataaaaaaccctcttaaattggggagataattattgggccggccggggggaatacaaatatttgttttttcccctttttctcccccaaatattaaataaaaacatcgggcttttgggccggaaaaatatacgggagaatctccccgtttttcccccgggggacggagtacacctctttaaaagaagggagatcccccttgtttgcgtagatattctttccgccggcgaaaacaaggttttcaaaatan

SEQ ID NO: 77054 - protein, 133 aa, Zea mays
  misc_feature: Ceres CLONE 1561915
MQSLVRNVCRAGSRGAAARLLEAAAVHPGAAQPSSAVRHLRHPCGFARPIGVDQPKPVQRRTILRDGGRVPAAASGFGLCAKSLVATRGLSTAGNAAEVASDSDDSTSSCGLKPPPRHQVSRRPGQEPLGTIY

SEQ ID NO: 77055 - DNA, 798 bp, Zea mays
  misc_feature: Ceres CLONE 1561916
  misc_feature: Translation starting site: 162
  misc_feature (424)..(424): n is a, c, t, g, unknown, or other
  misc_feature (451)..(451): n is a, c, t, g, unknown, or other
  misc_feature (648)..(648): n is a, c, t, g, unknown, or other
ggagctcaccgcggtggcggccgctctagaatagtggatcccccgggctgcaggaattcgtctcacccctagaaaaaaaccggcaggtttgcttggtgccctcgatttgcctgctactcgtggcgcgccgctcctaggcgaagggaaggatccgactcaacatggccgccgccgcttctaccatgtccctgctcccgatctcccagcccaggaagcagcagcaggcaaggcgcgggcgccgtggtcgtgttccagcggcggccctgggacgcgcggcggaggcgatacgtcgtcccgacggcgaggctgttcgggccagcgatcttcgaggcgtccaagctgaaggtgctgttcctgggcgtggacgaggggagcagcaagcatctgcatgcgcaccacccggcgccggcgccggcgctgctgnccgcggacgtacacgctgacgcacagncgacgtgacggccagcctggacgctcgccgtctcccacaccatcaaccgcgcgcagctgcagggctggtacaaccgcctgcagcgcgtacaaggtgggtggccgaagtggaagaaggtgcgccggccggatgttcgctgcacgtgcactgccacatctcccggcggacacttgctcctggaactcatccgccggccntccgctactacatctttcgcaagggagctccccgtggtgcctccaaggcgttcgtggcacggcgaacggcgaacttgttcagccgtcaccccgaagctgaggaaaaccccgcgggttggggtctacttccacttcaaaccgggccgcttc

SEQ ID NO: 77056 - DNA, 903 bp, Zea mays
  misc_feature: Ceres CLONE 1561917
  misc_feature: Encodes the peptide sequence at SEQ ID NO. 77057
  misc_feature (547)..(547): n is a, c, t, g, unknown, or other
  misc_feature (616)..(616): n is a, c, t, g, unknown, or other
  misc_feature (622)..(622): n is a, c, t, g, unknown, or other
ggagctccccgcggtggcggccgctctagaactagtggatcccccgggctgcaggaattcgtctcacccctagaaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaagggagattngttgactgtggccctgaccgcatcaggaagctttgcagaataattgcacttggtctccaggggcttccntcgtcnttcaacgctggtggggggaaggaacgggctcctggggcttgggttctcttcttccttggaacggcttggtctgtttgactatggggcagaaagctcaaagctcgggttttccccggggtaaccatacccccccgggggggtccacattcgggggttggaacccataaaaaaaaggggcctgggcccccccacttttttcctctaaagaaaactgagaagtgtgcttgtccccgccccacaaaaatgaggcccctctattgaaaatattggcgccgccgttc

SEQ ID NO: 77057 - protein, 128 aa, Zea mays
  misc_feature: Ceres CLONE 1561917
  misc_feature (115)..(115): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKGDXLTVALTASGSFAE

SEQ ID NO: 77058 - DNA, 1048 bp, Zea mays
  misc_feature: Ceres CLONE 1561918
  misc_feature: Encodes the peptide sequence at SEQ ID NO. 77059
gctctagaactagtggatcccccgggctgcaggaattcgtctcacccctagaaaaaaccatcggcatctatagcaaccggtccaacactttcacgctcaggcgctcagctctagcaatggctgcctccaccatggcgatctcctccacagcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggatgggacaccgccgggctgtccgccgaccccgagaccccccccaagaaccacgagctggaggtgatccactcccagctgggccatgctcagcgacgctcggctgcgtctttccccgagctgctactcccgcaaagagcgtctagttccagcgaaagcctttctgggttccaaggcccggcctcccacaatctttcaacaaagggccgggcatgggacttaccttgagaaaacccccagccctgaatccaacgcctcaaaagccatccatcgacacatcatggggacctgcctcaggttatttgcctccacgagggcccccctttctatggggccttaacccttaatttcgacctggcgagggccaacctctggcaaaaggtcgctcagatacccgcctggtaacactctgggagagcatgcttttttaaccccccttcgggcctggtgtcgaatattaccccccaaggcccctatctcccttatcttctaaggtgtaatgtaaccttatataaacgggccgccctcccgcattagttttccatatgttcatgatttgattcataccgggcccatcgtttaaccggctaatggtcccaccctcaaagaatttcctaaaaaccaaccggcgttacccctgttaccaaccaacgaatgtggccattcgcatccaatctctcgtcgccttgcacactaaggctatcaggtgg

SEQ ID NO: 77059 - protein, 149 aa, Zea mays
  misc_feature: Ceres CLONE 1561918
MAASTMAISSTAMAGTPIKVGSFGEGRITMRKTVGKPKVAASGSPWYGPDRVKYLGPFSGEPPSYLTGEFPGDYGWDTAGLSADPETPPKNHELEVIHSQLGHAQRRSAASFPELLLPQRASSSSESLSGFQGPASHNLSTKGRAWDLP

SEQ ID NO: 77060 - DNA, 764 bp, Zea mays
  misc_feature: Ceres CLONE 1561919
  misc_feature: Encodes the peptide sequence at SEQ ID NO. 77061
  misc_feature (750)..(750): n is a, c, t, g, unknown, or other
caaagctggagctccccgcggtggcggccgctctagaactagtggatcccccgggctgcaggaattcgtctcacccctagaaaaagaggcggccaggctccctcctcctccctgcaaatcctgcagacaccaccgctcgtttttctctccgggacaggagaaaaggggagagagaggtgaggcgcggtgtccgcccgatctgctctgccccgacgcagctgttacgacctcctcagtctcaggagcaagatgggtgccggcggcaggatgaccgagaaggagcgggagaagcaggagcagctcgcccgagctaccggtggcgccgcgatgcagcggtcgccggtggagaagcctccgttcactctgggtcagatcaagaaggccatcccgccacactgcttcgagcgctcggtgctcaagtccttctcgtacgtggtccacgacctggtgatcgccgcggcgctcctctacttcgcgctggccatcataccggcgctcccaagcccgctcggctacgcggcctggccgctgtactggatcgcgcaggggtgcgtgtgcaccggcgtgtgggtcatcgcgcacgagtgcggccaccacgccttctcggactactcgctcctggacgacgtggtcggcctggtgctgcactcgtcgctcatggtgccctactttctcgtggaagtacagccaccggcgccaccactccaacactggggtccctggagcgcgaacgaggtgtttcgtgccccnagaagaaaggaggc

SEQ ID NO: 77061 - protein, 171 aa, Zea mays
  misc_feature: Ceres CLONE 1561919
  misc_feature: SWISSPROT Homolog: EC 1.14.99.33 Delta(12)-fatty acid dehydrogenase
MGAGGRMTEKEREKQEQLARATGGAAMQRSPVEKPPFTLGQIKKAIPPHCFERSVLKSFSYVVHDLVIAAALLYFALAIIPALPSPLGYAAWPLYWIAQGCVCTGVWVIAHECGHHAFSDYSLLDDVVGLVLHSSLMVPYFLVEVQPPAPPLQHWGPWSANEVFRAPRRKE

SEQ ID NO: 77062 - DNA, 914 bp, Zea mays
  misc_feature: Ceres CLONE 1561920
  misc_feature (228)..(228): n is a, c, t, g, unknown, or other
  misc_feature (229)..(229): n is a, c, t, g, unknown, or other
  misc_feature (252)..(252): n is a, c, t, g, unknown, or other
  misc_feature (253)..(253): n is a, c, t, g, unknown, or other
  misc_feature (276)..(276): n is a, c, t, g, unknown, or other
  misc_feature (277)..(277): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (284)..(284): n is a, c, t, g, unknown, or other
  misc_feature (285)..(285): n is a, c, t, g, unknown, or other
  misc_feature (287)..(287): n is a, c, t, g, unknown, or other
  misc_feature (288)..(288): n is a, c, t, g, unknown, or other
  misc_feature (290)..(290): n is a, c, t, g, unknown, or other
  misc_feature (291)..(291): n is a, c, t, g, unknown, or other
  misc_feature (300)..(300): n is a, c, t, g, unknown, or other
  misc_feature (301)..(301): n is a, c, t, g, unknown, or other
  misc_feature (304)..(304): n is a, c, t, g, unknown, or other
  misc_feature (306)..(306): n is a, c, t, g, unknown, or other
  misc_feature (316)..(316): n is a, c, t, g, unknown, or other
  misc_feature (331)..(331): n is a, c, t, g, unknown, or other
  misc_feature (748)..(748): n is a, c, t, g, unknown, or other
  misc_feature (765)..(765): n is a, c, t, g, unknown, or other
  misc_feature (766)..(766): n is a, c, t, g, unknown, or other
ggagctccccgcggtggcggccgctctagaactagtggatcccccgggctgcaggaattcgtctcacccctagaaaaagctccgagttcctcgcctggttttcggcaaggccaaggaaaggtggtcacttcacttctgttttttttttttactgccgccgcaaacctccgctcctgtgccataccgccattccattcttaatctgggcgccgaagaagaagagacggnnagcgagtccggtcgagatcttanncgaatttggggaagggggaaacnncnnnngnngnngnngaaggccgnnggnanaaatcactgngggtccccgggccgntccccggagggcgccgggggccttctcctcctggggaaagttggggccccttccgagaacctccaattcccccccctggaacacatgaaaaaaaggcaaagggccccggccccgggaaaaaaacccgggggaaacacccctcccgaaaccccatattccaaggtttcccccgattctcttaaaaatccaaaaaaaggggggttaaaatttgggcccccttaaccccccttgaaacaaagggtctcttaaaagaaaccccccccccccaagggggccccctccaaagaaaaaacacccccttcccctcgcccttttttaaaaaaaaaaacgggggtgcccccccctctttgggaaaagggttttttatatttttgggaaaaaaaataccccgcgcccccccccccccccacccctccnaaaaaaaaaagggggtnnaaaaaaaattttggctccccctcaaaaaaaaaaaaaaaaaaaaaaccccccccctctaaaagaaaaaaaaattttttctccaaaaaaaaaaaaggcccttttttttattggggggtgtaaaaaaaaaaaaaatatttgtttcccgcct

SEQ ID NO: 77063 - DNA, 786 bp, Zea mays
  misc_feature: Ceres CLONE 1561923
  misc_feature: Translation starting site: 205
  misc_feature (676)..(676): n is a, c, t, g, unknown, or other
  misc_feature (688)..(688): n is a, c, t, g, unknown, or other
  misc_feature (729)..(729): n is a, c, t, g, unknown, or other
  misc_feature (748)..(748): n is a, c, t, g, unknown, or other
  misc_feature (756)..(756): n is a, c, t, g, unknown, or other
  misc_feature (760)..(760): n is a, c, t, g, unknown, or other
tggagctccccgcggtggcggccgctctagaactagtggaacccccgggctgcaggaattcgtctcacccctagaaaaaactccgttccgagagccaaaaactccactgctttcatcaactccggcgacttggagaagacgaagttccagaatccgatcggaagtttggtgctcgcgccttgacggattgatttcggtgcgccgatggggcaggcgttccgcaagctgttcgattccttcttcggcaccagcgagatgagggttgtgatgcttggtctggatgctgccggtaaaaccaccatattgtacaagctgcatactcggggaggttttgtcgactgttcccacgattggtttcaacgtcgagaaagttcaatacaagaatgtgatgtttactgtgtggggatgttggtggccaagaaaagttgaggcccttgtggaggcactacttcaacaatactgatggcttgatctacgtagttgattcgttggatcgggagagaattggaaaagccaaagctgaatttcaggcaataatcaaagatcctttgatgcttaacagtgtaatactggtacttgccaataagcaagatatgaaaggggcaatgacccaatgggagtgttgtgtgagggtcttggcctctacgatttgaagaaccgcatctggcacatcccnaggttcttgtgncgctcaaaggtgatggccttttatgaaggccttggactggnctggcaagcaccactgaangaattgcnagcnttcaggtcgcctaacttctggaaagg

SEQ ID NO: 77064 - DNA, 1048 bp, Zea mays
  misc_feature: Ceres CLONE 1561924
  misc_feature: Encodes the peptide sequence at SEQ ID NO. 77065
  misc_feature (770)..(770): n is a, c, t, g, unknown, or other
  misc_feature (1007)..(1007): n is a, c, t, g, unknown, or other
  misc_feature (1048)..(1048): n is a, c, t, g, unknown, or other
tggagctccccgcggtggcggccgctctagaactagtggatcccccgggctgcaggaattcgtctcacccctagaaaaaactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtggctgatggatctttggctctggcgcaccacagaaggatagcgtctattgacgctggtcaaatctatgactccaccacaaccgtggggagcttttgggtgggttgtccaaacccgggacagaataaaatcaatccccctgggcatttgtcccctggagagaaaattattcccccggaaaaatcatagttggcagggggaaaggtcctttccaaagtctcaactaaagggtttgggcgaaccttcattggacctggaagaaaaaaacaaaacctgaatccccaaggggaaatcccccgaacacacccaaggggtcccttggcagaggcaaaatgcccgccttccattggaacaggaaaaaaaccggcggtccaagaacaaacatttcccccggttggatatcnaaccggccaacggggggaaatgcgcttgggggggaatagttcttccccatatcgggccgaaccttcttttgtccccctccgcggtggggtggggcctcaaaccaccacgcgggaagggaagacttgaaaaccgcgggctcaaataggaactaaccactcccaagggaagggctttcctctaagggacgggggttgttgtgtaaaggaaactaaaacccccctcccgaatatccccgnccaggatccagagtgaaaatctcccccctctttgaaaatcn

SEQ ID NO: 77065 - protein, 67 aa, Zea mays
  misc_feature: Ceres CLONE 1561924
MQRAVQAVRSHGNVLKYAVLQHISAPKPAMLPAAFSRFMSVSSARLEDRGFETATVADVLKSKGKSG

SEQ ID NO: 77066 - DNA, 830 bp, Zea mays
  misc_feature: Ceres CLONE 1561926
  misc_feature (822)..(822): n is a, c, t, g, unknown, or other
ctggagctccccgcggtggcggccgctctagaactagtggatcccccgggctgcaggaattcgtctcacccctagaaaaaagtcacacgtgtctgagggaacagattgcttgggctctgaaacttaagccaaatcaacacatgtctgagcgagatgtgtgtgcctgccaaccttgggtgcttggctccgaggatctccttctggccgtacttcctccagctatggccgtcctcgaccgggttctcgccgccggcagagctcaccctctgcctccgctgttccatcaccttcctgcgagcgaacacacacacacgcgacgggttcagtttagcaaagagtcagcctaacttgttgctgtttctgtttcgaccgattatctatatacatattaattccttgatcgagcaagcagcaagcgttcgtggcgaggtcacctcttcttcttggtggtctggaaaggcccgtcggtgacgtcgctggtgggcgtcgccgagagcggcgaggcgaggccggcgtcgcccgcgggtcgcttccgccgccgggcgccgtcgaggttggaggagggtgatgaggccgatggagcgctcggtgaagggagaagatctgcgaggccaggtgcttgcacaggtccggggacccgccgaggtgcacctccagctgcctcaccagctccttgatgtggctcagctccgtcaccacagcccgccgcagctgcctccctcactgctattgacgccgccgcctacgacgcccatctccatctccgtcgacgccaggggacgatggtgagaactgagaatgcccctctggttgtgttggcanggccgtca

SEQ ID NO: 77067 - DNA, 842 bp, Zea mays
  misc_feature: Ceres CLONE 1561928
  misc_feature: Translation starting site: 191
ctggagctccccgcggtggcggccgctctagaactagtggatcccccgggctgcaggaattcgtctcacccctagaaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcggacgtggcggcgggcggacccccggcggcgacagccgcggccagctgctgctcgtcgtggtggcgcccgccatcgggtgggtgctgtacaacatcctgcagccggcgctgaaccagctgaaccgcatgcgcagcagccaggccgtggccgccggcctgggcctcggcgccgccgccgccgcccgggatggcggccccgcccgaagcctccgccgccgtggtgcaggacctcgcgggaatcgccgccgccgcgcccgccgacgacagccgcggcctcctcctgctcatcgtcgtcgcgcccgccattccggctgggtgctcttcaacatccctccagccggcgctcaaccagctcaaccgcatggcggcccgactgaaagctagctaactagcgtcccgttttccgtatccccgggcgtgccgttgtaaaacctggaagcaacggg

SEQ ID NO: 77068 - DNA, 797 bp, Zea mays
  misc_feature: Ceres CLONE 1561931
  misc_feature: Encodes the peptide sequence at SEQ ID NO. 77069
  misc_feature (666)..(666): n is a, c, t, g, unknown, or other
  misc_feature (723)..(723): n is a, c, t, g, unknown, or other
ctggagctccccgcggtggcggccgctctagaactagtggatcccccgggctgcaggaattcgtctcacccctagaaaaattccaacttccgttccgcaaattgaaagctcggcgttgccctgcgcccctgcctcgagctcgaaggactttgtccctatacgtcgttgtccagctcctcgcatattgtggcctggtgcagattggagatccgcccggacttggatcgagtcctcctgtctttggacattcattggagtgctccattcattgagacagcatgcctaagataaagacaagccgtgtcaagtatcctgaaggatgggagcttattgaaccaacaatccgtgagttggatgccaaaatgagagaagctgaaaatgatccacatgatggaaagagaaagtgtgaagctctctggcctattttccgcatttctcatcaaaggagccgctacatatacgatctttattacagaaggaaggagatatcacaggagctttatgagttctgcctagaccagggttatgcagaccgtaacctgattgcaaagtggaaaaagccaggttacgagcgcctttgctgcctccggtgcatacagacacgtgatcacaacttcgcaacgacatgcggtctgccgcgtccccaagcatctgagggaggagcangtgatagaatgtgtccactgcggctgccaggggttgtgccagcggtgactaatcttngtcatcatgtcgttcggctcacgactcaccatcgcaccttaaacgggatgaagtgccctgcgttaaacatgatc

SEQ ID NO: 77069 - protein, 173 aa, Zea mays
  misc_feature: Ceres CLONE 1561931
  misc_feature (1)..(136): Pfam Name: G10 Pfam Description: G10 protein
  misc_feature (130)..(130): Xaa is any aa, unknown, or other
  misc_feature (149)..(149): Xaa is any aa, unknown, or other
MPKIKTSRVKYPEGWELIEPTIRELDAKMREAENDPHDGKRKCEALWPIFRISHQRSRYIYDLYYRRKEISQELYEFCLDQGYADRNLIAKWKKPGYERLCCLRCIQTRDHNFATTCGLPRPQASEGGAXDRMCPLRLPGVVPAVTNLXHHVVRLTTHHRTLNGMKCPALNMI

SEQ ID NO: 77070 - DNA, 1234 bp, Zea mays
  misc_feature: Ceres CLONE 1561932
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (496)..(496): n is a, c, t, g, unknown, or other
  misc_feature (964)..(964): n is a, c, t, g, unknown, or other
tttatttttacccggagaaacaaatgatacaaacaccaaacaacacaaattcgaaaannnnnnnnnnnnnnnnnccaaaactggagctccccgcggtggcggccgctctagaactagtggatcccccgggctgcaggaattcgtctcacccctagaaaaagcactcatccattccaacatcccttgcaagtatagtctcggtcggctctacaatacgatgggcaaggactacgtgatcaagagcggcgctggcggctgccagttcgctggcaaggactacatggaccctcccccggcgccgactaatcgacgcggttgaactggggtcctgggcgctggaccgcaccttgaatcggtgaagttatcgctagggtgggtggtcctgtaaatccacacggggcacccatgattcgggtacagctcccaaaaggaaacgtcccgctccgggggcccaaaaccggaatgggggggggagggtgtgcccccgggggggttnttgggggtttttcccggccagaaaatttaaaacccctccctgaaagaaaggcagccccggaatttttctggggggggcaaaaaaaaagacccccccccctttcaccaattatggccccctctttcttatggggcccaaacaagggaattcccctttagtacccgccgccggaaaggaacaaacattatttgggggagcacggagggccccccccttcgactcaaattttataggggccctccaagagaccattctcataaaaagaggttttttccacaaagaaacgcccctcaagcttttctaaaaaaatatttcacggcggggaggagtcacccccccaccaaaactacgagcggtggggtccgctcccgcgggaaataaccacctcaccgggagggaccagagagttcctatctctggggagattcagagagaaaatatacatcgcggaggcccctctgtgggggnggtgggggacatttaagacaggggagggctctatttcgtcgcgcgccacactggaaagcgcctccaaatagcggaggatacaccgtcgcgcggcgaagaaattctgccacaacaatctcgccaatataatttgtggggaaacatcatcccgcacctctccaatacagagagattattttgccgcagggaggagtacgatagggggggggggaagcaatgtgtgagtgccacacattagatcgctcgctggtccacacagcgaggggcgct

SEQ ID NO: 77071 - DNA, 823 bp, Zea mays
  misc_feature: Ceres CLONE 1561936
  misc_feature: Translation starting site: 140
  misc_feature (526)..(526): n is a, c, t, g, unknown, or other
ctggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttggagctgcgtgttcccggagctgctcgcccgcaacggcgtcaagttcggccgaggccngtgtggttcaaaggccggggtcgcagatcttcaagcgaagggtggggctgggaactacctcggcaaccccgagcctgatcctacgcgcagagcatgcctcgccatctgggccttgccagggtcgtgctcatgggcgcccatcgagggggtaccgccgtcgccgggcgccgctccgggaaaggtcgtcgaacccgctcttaccccgggcggcagcttcgaccccgttcggcctccgccgagtaccctgaaggcctcgcggaccctcaaggtgaagagctcaagacggcgcgctcgccc

SEQ ID NO: 77072 - DNA, 868 bp, Zea mays
  misc_feature: Ceres CLONE 1561939
  misc_feature: Encodes the peptide sequence at SEQ ID NO. 77073
  misc_feature (393)..(393): n is a, c, t, g, unknown, or other
ctccccgcggtggcggccgctctagaactagtggatcccccgggctgcaggaattcgtctcacccctagaaaaatcacactctgcccagctaagctaagctccctccgtccatcggcatggcgactaccactactaccatcctcctcctcctcctcgtcgcagccacagccgtctcggcggccgacctctccgtgtaccacaacgtgcacccgccgtccccgtccccgctcgagtccatcatcgcgctcgcccgcgccgacgacgcgcggctcctcttcctctcatccaaggcggcctcgtccggcggcgtcacctccgctcccgtcgcctccggccagactccgccctcgtacgtcgtccgcgcgggggtcggcaccccgggtcaacacctnctcctcgcgctcgaaacagcgccgacgccacctggtcgcactgcgcgccgtgcgacacgtgccccgccgggagccgctttcatcccggccagtttctccctcgtacggcatccctcccgtggcgcctccgaactgggtggcccgctctttcgaaggggccaacccgtggcccgggcgaaattcaaggacgcccttcgggccccccctggccggggggggggccccttttctccaaagcccttttccgggggaaaaccccctttttccaagggggttttcttggggggaaggaaaaaaaactcttttgtccctggggggaaagggaaaacaatattctccgggttaaaccattttttgggtgtgtcttggggggcccctggggtgcctgggccaaaaaaaaaataacttttttaaaaaaaaggggggggtccctctcgcgcctccgggccgggggggcccctttgttttttttttt

SEQ ID NO: 77073 - protein, 226 aa, Zea mays
  misc_feature: Ceres CLONE 1561939
MATTTTTILLLLLVAATAVSAADLSVYHNVHPPSPSPLESIIALARADDARLLFLSSKAASSGGVTSAPVASGQTPPSYVVRAGVGTPGQHLLLALETAPTPPGRTARRATRAPPGAAFIPASFSLVRHPSRGASELGGPLFRRGQPVARAKFKDALRAPPGRGGGPFSPKPFSGGKPPFSKGVFLGGRKKNSFVPGGKGKTIFSGLNHFLGVSWGAPGVPGPKKK

SEQ ID NO: 77074 - DNA, 791 bp, Zea mays
  misc_feature: Ceres CLONE 1561940
  misc_feature: Encodes the peptide sequence at SEQ ID NO. 77075
gctcaccgcggtggcggccgctctagaactagtggatcccccgggctgcaggaattcgtctcacccctagaaaaaaccggggattagggatggcggcgaagaaggtgctcatgctctgcggcgactacatggaggactacgaggtcatggtcccgttccaagcgctgcaagcgtatggggtgtccgtggacgccgtctgccctagcaagaaggccggcgacatctgccgcaccgccgtccatcagctgaccggtcaccagacatactctgagacaaaaggccataatttcacactgaatgcttcatttgatgagattactgctagtgaatatgatggattggtaattcctggagggcgtgcaccagaataccttgcgatggatgaaaaggtgcttgacctagtcagaatgttctctggtgctaagaagcctattgcatcagtttgtcatggacagttgattttagcggcagcaagagtagtcgagaaccgtacctgcacagcatttccggctgttaaaccagttttggttgctgctggtgccaagtggggagagcctgacaccatggcaaaatgcactgttgattgcaatctcttcacagcagcgacttataaattctcatccccgaattctccaccctatttggtcaaaccactccgaagggtccatgggcaggccccaaaataaaaaaaatactggtttccattgttgggggcttacatggggaggaattttgggggtcatgggtccccttttcccggggtcttccaaagtcttttgggggggcccagt

SEQ ID NO: 77075 - protein, 198 aa, Zea mays
  misc_feature: Ceres CLONE 1561940
  misc_feature (32)..(194): Pfam Name: DJ-1_PfpI Pfam Description: DJ-1/PfpI family
MAAKKVLMLCGDYMEDYEVMVPFQALQAYGVSVDAVCPSKKAGDICRTAVHQLTGHQTYSETKGHNFTLNASFDEITASEYDGLVIPGGRAPEYLAMDEKVLDLVRMFSGAKKPIASVCHGQLILAAARVVENRTCTAFPAVKPVLVAAGAKWGEPDTMAKCTVDCNLFTAATYKFSSPNSPPYLVKPLRRVHGQAPK

SEQ ID NO: 77076 - DNA, 773 bp, Zea mays
  misc_feature: Ceres CLONE 1561941
  misc_feature (280)..(280): n is a, c, t, g, unknown, or other
ctggagctccaccgcggtggcggccgctctagaactagtggatcccccgggctgcaggaattcgtctcacccctagaaaaatatattctatattatatttttgtatattcagtctcgtttaattgctttcagacttaatgttagataattgtttacattttctacaattcagtctggactaattgctttgggactaatgttggagatatccatatgtatctgcgtctaagcatttttcatttgtatttatcatgttttgtcaatagggatacttgtttcntgtaaagatctgttaggcatgttttgaacccatagcaaattgccgggacgttgtgtaaaaaactgccggaattgatgggatttcccactatttccattcaacccccaaaatttattgggggcgggctttttcaaaatccggggggggtaaacccccctaaaaaaaggggggggaaccccccgggaaacccccccccttattaaaggggggggggggggcccttttaaaaaaaaaaaactgcggggggggttttttttttgagaaaaaaaaaaatttttttttgggaaaaaaacaacccccccccgggggggggggaaaaaaaaaaaaagaaggggggggcgcgccgtttctttttcttttttttaaaaaaaaaaaaaaaagggggaggggggggggggggcgataatcacctcccccccccctcgttgggggggaggagaaagagaaaccaccccctctcttcttttttttttttttttcccccccccccccc

SEQ ID NO: 77077 - DNA, 742 bp, Zea mays
  misc_feature: Ceres CLONE 1561945
  misc_feature: Encodes the peptide sequence at SEQ ID NO. 77078
ctcaccgcggtggcggccgctctagaactagtggatcccccgggctgcaggaattcgtctcacccctagaaaaacgccgcacccgaagccgcatgcccctgctcccccgactccgagcccgcgccaactgaaggccaaccgacgaaccccattgtccgttcttcatcgcgtgtaatggagctttactgcggccgtttctcccccaaagatatgtccttttcaactatacgcagttcaagttgtgctgcagatcgttttcagcaggagtgcatgcttattagttgttaccactgttagttaattattagtcgaatacaaccactctgaataatagcgtaatggtgcaggtgatgcatacctgatgagaacgagaacgagactgcgcgacccctagcttctcagccaagtacttcatcaccacctccaccttcatgttgctgtccctgcagcgtgtgcgccgaagatcagcaagagaagaaggaagaagacaagtcagacaaaacagaagacgagaagaactgatgtagccatgttcatgcttccactgttgaaatgcatattcaacatagcttgctcagctcctatttgttgtttcaacgtttatttaaaagaagagcaggtagttgtgggcttttgaacaatagctggagtgatatgaaacattagtgatgtagttgtaggcttttgaactgcttcaagctggagtgatgttgctgtgtgcttttgtgactgatcatctctg

SEQ ID NO: 77078 - protein, 31 aa, Zea mays
  misc_feature: Ceres CLONE 1561945
MLLSLQRVRRRSAREEGRRQVRQNRRREELM

SEQ ID NO: 77079 - DNA, 829 bp, Zea mays
  misc_feature: Ceres CLONE 1561946
  misc_feature: Encodes the peptide sequence at SEQ ID NO. 77080
ccccgcggtggcggccgctctagaactagtggatcccccgggctgcaggaattcgtctcacccctagaaaaaagctcattaccacctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccatacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaacaaccaggtgaaaggtgagagtttggatctggtcaagtacattgacagcaactttgaaggcccatcgttgctcccagaggatccttcaaaaaagcagttcgctgaggagctgcttgcatatactgatgcatttaacaaagcattatacttttgtatagtctccaaggaagatgtgtctgaggaagctgtcgctgctttggataaaatagaagacgccctcgggaaattcaacgagggtccattctcccttggtcagttcagtctggtggacattgcgtatgtaccattcatcgagagggttcagatattcgattccaacataaagaaacttgatattacaaagggcagacccaacctccaaaagttccttgaggaagtggacaagattgatgcttacccacagaactaacatggacccccagtcttttccttg

SEQ ID NO: 77080 - protein, 224 aa, Zea mays
  misc_feature: Ceres CLONE 1561946
  misc_feature: SWISSPROT Homolog: EC 2.5.1.18 Glutathione transferase
MAAAAPASSVKEVLPSPLTSASEPPPLFDGTTRLYVAYHCPYAQRAWIARNYKGLQDKIKIVAIDLADRPTWYKEKVYPENKVPSLEHNNQVKGESLDLVKYIDSNFEGPSLLPEDPSKKQFAEELLAYTDAFNKALYFCIVSKEDVSEEAVAALDKIEDALGKFNEGPFSLGQFSLVDIAYVPFIERVQIFDSNIKKLDITKGRPNLQKFLEEVDKIDAYPQN

SEQ ID NO: 77081 - DNA, 811 bp, Zea mays
  misc_feature: Ceres CLONE 1561949
  misc_feature: Encodes the peptide sequence at SEQ ID NO. 77082
  misc_feature (802)..(802): n is a, c, t, g, unknown, or other
tggagctcaccgcggtggcggccgctctagaactagtggatcccccgggctgcaggaattcgtctcacccctagaaaaaagccatcacacgcatactgcatacacaacgcagagcatcagaagcagctgcgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctcgactacctcggcaacccgagcctggtccacgcgcagagcatcctggccatctgggcgtgccaggtggtgctcatgggcgccgtcgaggggtaaccgcgtcgccggcggccgcttccggggaggtggtcgacccgctgtaccctggcggcagctccgacccgctcgggctcgccgacgaacccggaagcgttcgccgagctcagggtgaaggagatcaaagacgggccgcctcgnccatgttct

SEQ ID NO: 77082 - protein, 172 aa, Zea mays
  misc_feature: Ceres CLONE 1561949
  misc_feature (63)..(173): Pfam Name: Chloroa_b-bind Pfam Description: Chlorophyll A-B binding protein
MAAATMAITSRALVGKPAAGTRDVFGEGRITMRKTAAKPKPAASGSPWYGADRVLYLGPLSGSPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEG

SEQ ID NO: 77083 - DNA, 862 bp, Zea mays
  misc_feature: Ceres CLONE 1561950
  misc_feature: Translation starting site: 251
ccccgcggtggcggccgctctagaactagtggatcccccgggctgcaggaattcgtctcacccctagaaaaaacacgtctatgtatatactatatatgcgtttcacccgtaactactacctccatagcatggatcgcaagaaccctggacctgctacatgccctgacgcttaatacgttggccggcactctgatcggcatcagatcaaagatggcgacgataagatggggagaatgtgaatagcgcctgcatgccggcatcagataacatgtggtgcgctggtctggacttgtgcgcggtacatgtgtcggtggtactagatctcatcgttccggtctttcttccagccgaggtactgctgcgacacgcgagacatctacaggctgctggaggactgcccctcgatgaagtgctagtcaagacgtggtgcaagggcaagaccgactacttcggagggcaggtcctacaggtctaaccccggcggcaaataagcccaacttaaggtcaagtttgtcctccggacttccttccctttaacccaattctggaaaactacgggggggggcccctgaaaaaaacccccgctaacctttttaggcatacccccaaaaaaaccttttaatccctggaaaaaaaaaaactcccccaaaaactggttcccaccggggtgttaactggaaaagaaaaaaagggttttattgggcccccctccaaggtaaccccctgggggagcccaccccgagaaaaatacccccccccccaaaaaaaaaaggggggtggggggggacacaaaaattttttgagaaaaaaattttctttttccccaaaagggggggtttccttcccttttgagaaagagagg

SEQ ID NO: 77084 - DNA, 822 bp, Zea mays
  misc_feature: Ceres CLONE 1561951
ctccccgcggtggcggccgctctagaactagtggatcccccgggctgcaggaattcgtctcacccctagaaaaatgactgaattgcccaattatgcaacaacaacaacataaccttttattcccaagcaagttggggtaggatagagttgaaacccaacaagatgtcaccaaaaagagaaagcgagagaaacgggaggggaaaaagcttttgagagcactaaaagggaaaaagcctaatcacggttcgggcacatggatagcttttttctaagcatttctatccaaacataactctattgggatatttcattccttcaagtcccttttgattgtctcctctcatgtcaagtttggctgtcctctacctctcttcacattattgtcccgtcttatgatgcccattgggatattctattcctccaagtccttttttgaatgctcaattatgcaatgctacaaaattaaatttgaaaagtattctgctgcatgtagatgatcagacaaaaggtattctttgttgtagacattagacaacttctattaactggctcttatgttgacatgttttaccggcattctgccacagttattgttttctggggaactttggtttttttccggatggccccctaaaaaaaagcccccccccaacggcccccctggtggaaagccaaaccttgggggccctttttttttcctccccaaaaatttgcaccaaggggagaattttcttggtggggaaaaaaaattttaaattttccccccctgtgggggggggtgttaaaattccccaagagggcggggggttttttttccccccc

SEQ ID NO: 77085 - DNA, 803 bp, Zea mays
  misc_feature: Ceres CLONE 1561956
  misc_feature: Encodes the peptide sequence at SEQ ID NO. 77086
  misc_feature (477)..(477): n is a, c, t, g, unknown, or other
ctggagctccccgcggtggcggccgctctagaactagtggatcccccgggctgcaggaattcgtctcacccctagaaaaatcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaacctccaggtgtcgcacccgaccaaggaggcgcccgtcatcgactacaagctcgcgttgctcttccagcccatgcttatgctcggcataaccatcggcgtagagctcagcgtcatcttcccatactggctaatcactgtcctcattataatcctcttcgtaggcacctcgtcgagatccttctacaagggaattctgatgtnggagggaggagaccaggattctgacggagacacgcgggcgagaagagcaatccaagtctacctgcgctgcaggtgatgtggtcattgatcccagttatggggagcccctcctgactcaacctcagcccaagaagtctgcatgggagactttcatgttcaatctgaggtggaagaaatatccttgtgttaatgtctgtctgggtcattgttcttgggtgctgcaagttctcaagaataattcaaaatcatgcagctcttttctactggggtgataaacgttcttacaggttcccagttgcgagtaggtgtgttccttgtggggagcc

SEQ ID NO: 77086 - protein, 123 aa, Zea mays
  misc_feature: Ceres CLONE 1561956
  misc_feature (99)..(99): Xaa is any aa, unknown, or other
MLNLVVGFDTKSAAALSKCMIMGASASSVWYNLQVSHPTKEAPVIDYKLALLFQPMLMLGITIGVELSVIFPYWLITVLIIILFVGTSSRSFYKGILMXEGGDQDSDGDTRARRAIQVYLRCR

SEQ ID NO: 77087 - DNA, 1083 bp, Zea mays
  misc_feature: Ceres CLONE 1561958
  misc_feature: Encodes the peptide sequence at SEQ ID NO. 77088
  misc_feature (52)..(52): n is a, c, t, g, unknown, or other
  misc_feature (61)..(61): n is a, c, t, g, unknown, or other
  misc_feature (62)..(62): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (88)..(88): n is a, c, t, g, unknown, or other
cccctccttttctttttcttccccccccgcgtcgggcatcctcctgtttccnataccgccnnccttccacccacaatnnnnnntgtcntttttttcaaactggagctccccgcggtggcggccgctctagaactagtggatcccccgggctgcaggaattcgtctcacccctagaaaaagtcccgcactcccgccccttttccttttgctccttccttcctcgggaagcctagggcttaggctttaagcgccgcgatgtacggcggcggcggcggcgggcactacgacggaggcagcggtggcgccgggtacgctaacgcgctcttcggcggcgggggcttcatgccctcacagtccacggtggtcccggagaacagcggcctctcttagggtcggagcgcgcagacgctgctcccgctcaacgtggaaacgatcattgaacccggcgcaaacaagcggggacaggtccaattccccctccacggggtttaagggcccccccaaaaaggcttgtttggaacccctgcctagggaaagggttaaaccgggcccaaaaagttgggttttccccccctggataaaggggcccgggccaaaaaaaaagtgggaaaacccccggggaaaaataaaaggcctcccaaaaatcccaaaggagaaaggggggttattgcccccaaaaaaaagaaaaaaacattgggccaaaaatacactttttggggcggggttttaaaaaagagtttcttccaagaaaaaaaaccccccctcttttttttttgggcccccatttttttgtgggggggggggtggggggaaaaaacctccttatggaaaaaaaccccgcggggccttttttttgcgcgcccgttttttatggggggggtgaatggggagcccccccccggggggaaaaaaacaaatattttcttccccccgcggcggcatcatggggggagggggggcccccctggccccccaccccaaaaaaaaaaaaaaaaaggggggggtggggaaaaaaaaacattcccccccccaaacggtggtgagaggaggtttttttttaaaaccacccacctgtcggggggg

SEQ ID NO: 77088 - protein, 44 aa, Zea mays
  misc_feature: Ceres CLONE 1561958
MYGGGGGGHYDGGSGGAGYANALFGGGGFMPSQSTVVPENSGLS

SEQ ID NO: 77089 - DNA, 872 bp, Zea mays
  misc_feature: Ceres CLONE 1561960
  misc_feature: Encodes the peptide sequence at SEQ ID NO. 77090
  misc_feature (762)..(762): n is a, c, t, g, unknown, or other
  misc_feature (763)..(763): n is a, c, t, g, unknown, or other
ctccccgcggtggcggccgctctagaactagtggatcccccgggctgcaggaattcgtctcacccctagaaaaagctagtaccagtagtcgtcgcgtttgcagctaggcagatctgagttagccaggcggatccgatccgtgcgcgtgcgcagtgtgtgtgtgtgtgtgtgtgtgtgtgtgtgtcggttggagagatggccacagcttacgctcccatggcgagccaggtgatgaagagcagcctcgtcgtgcactcgaggccgaggggcctgtcaagcgctgctgcgctccgagcggcccagccggttcacgtcaagccatccagccgagatggcacgtaccatgtgtgcagcccatcaacgcgaaccttccatcggaagcctgaagaccccgggcacctccaagccgctcggtggcggggtacctttccaaacttttcggccttaccgaaccccccttgaacccccctgcttgcggggggcctccaaaggtcgggcctccccccacaggttttccctcccccgtgggggggccccttttcggccttcaagaggggccccctctcccacaaaaaaaccccccttgtgacaaaggccacaagggccgggggggcccttttggtgggcccccccggggctctctttcccaatttccttaaagggtgtgtggcctaacaaatttttaggggggggggccccccctttttaaaaaaagggggggaaaaccccttaccagggggcccttctttttttattttcctnnggttgtaaaaaaaaaaggggcgccaaaaattttttaaaccccccccaagggggggggcaatttttccccggagtgagatttttttttgggggggattctcccgggtggg

SEQ ID NO: 77090 - protein, 88 aa, Zea mays
  misc_feature: Ceres CLONE 1561960
MATAYAPMASQVMKSSLVVHSRPRGLSSAAALRAAQPVHVKPSSRDGTYHVCSPSTRTFHRKPEDPGHLQAARWRGTFPNFSALPNPP

SEQ ID NO: 77091 - DNA, 974 bp, Zea mays
  misc_feature: Ceres CLONE 1561962
  misc_feature: Encodes the peptide sequence at SEQ ID NO. 77092
ccccgcggtggcggccgctctagaactagtggatcccccgggctgcaggaattcgtctcacccctagaaaaagccgcaggccacgcatcttggagatggacaggtacgcgcccgcgctcctctgcctctgcctttgcctttgcctcggcgcgctccgtgccggttccgccgcgcctaccaccaccgggacccccgacggctcggagctgtgggggtacgtcgaagtccggccaaaggctcacctgttctggtggtactacaagagcccgcatcggacgtcgacgcccagcaagccatggccgaccatcctctggctgcagggcggcccgggcgcgtccggcgtcaggctcggcaactttcctggagtggggccgcctggacgtggacctgaagccgcggtagcccgacgtggctgcagaaggcccgacctcatcttcgtggacaacccggtggggcgtcgggttacagctacgtggaggacgacagccctgctggtggagacccaactggggagcaggggggcggaccccaccccccctggctcaagcgctgggccaaggaagtggccaaacctgcagaacagccccctggttcctgggtccccccaatcctaccgggggcaagttacccgccacgccttgggggtggtccctttccccagggcccgtcggcgcccgcggaaactcaaggtgaacccctgggcgggggttgcccccccgggaaaaccttccccccccccggggggattttaccgggtctcctacctggccgctgctctccgaaactgtgttaagggcgtgattaaaaacccccccggcgaacaaaaaaaggacccttaacgggggaaaggacaaaatacccccggggcaagtcccgggggttctcaggggtcgtgggaaaaaccttggtgccttcttaaaaccaaaaaagggcacccggtgaaatttataaatccctttcgaaaggggataggg

SEQ ID NO: 77092 - protein, 247 aa, Zea mays
  misc_feature: Ceres CLONE 1561962
  misc_feature: SWISSPROT Homolog: EC 3.4.16.5 Carboxypeptidase C
MDRYAPALLCLCLCLCLGALRAGSAAPTTTGTPDGSELWGYVEVRPKAHLFWWYYKSPHRTSTPSKPWPTILWLQGGPGASGVRLGNFPGVGPPGRGPEAAVARRGCRRPDLIFVDNPVGRRVTATWRTTALLVETQLGSRGADPTPPGSSAGPRKWPNLQNSPLVPGSPQSYRGQVTRHALGVVPFPRARRRPRKLKVNPWAGVAPPGKPSPPPGGFYRVSYLAAALRNCVKGVIKNPPGEQKKDP

SEQ ID NO: 77093 - DNA, 1093 bp, Zea mays
  misc_feature: Ceres CLONE 1561964
  misc_feature: Encodes the peptide sequence at SEQ ID NO. 77094
  misc_feature (961)..(961): n is a, c, t, g, unknown, or other
ctccccgcggtggcggccgctctagaactagtggatcccccgggctgcaggaattcgtctcacccctagaaaaaggaccacggtctccagggaccagggcggtgagccagcatcttctttttccgtcccctcctgcagccgccgcccgccgagacgccaagcgcgagcgggaggagaccatgtcacggtggcgcgccgccgcctacagcatctccgcagctgccgcgtcccgcaactctgcggcggagggccgcgccctctccaggggcttggcgaaggctccctcgccgccttcgcttcctctccaaaccctcacgagaaaactttgccaaagtcgctggcgccgccacgggcacggtggcccgggcctggggctttcctctcccccccgccgggcccagggcccgagatttaacccgaagtcctttgttctttatcccaagccccggtgttctttagcgtttgccccctggaaccccccccctaaagaggagggggatcccccctatataggggggagccaaggggatttccccccctcccctttggttggtgggttgtcccccggtaaagcaaaaaaacagggcccctccaaaaggggagcaaaaaggggtggggtttttgaaaaggaaaaaacccctttccctccaagtggtgtaggccgccccccccccatcattttttatgaaagagtcttttcttcccgggcggggggggagaaaaacatcctcttatagaaaaaaaaaatttcttttccatgaggcgggtggggggctctccacatatagtggggggtgtggtctccttatcccccctctttgttaagggacaaaaagcggggacggggcggttggggtgttttaattttgcgaacagttaccccctcccgaaatatgggtgaacccccccgatggttagaggctcccaatgtgtctctaagacggtggggggaaaattcggntctctgcgaacaaagggtcgagaggcgtgctctataaaaatttctctgtggcagaacaattcggagataattgggcgccgcataaacccccaggcgctcgcctaaaattatttttgttaagtccctctcggg

SEQ ID NO: 77094 - protein, 185 aa, Zea mays
  misc_feature: Ceres CLONE 1561964
MSRWRAAAYSISAAAASRNSAAEGRALSRGLAKAPSPPSLPLQTLTRKLCQSRWRRHGHGGPGLGLSSPPRRAQGPRFNPKSFVLYPKPRCSLAFAPWNPPPKEEGDPPYIGGSQGDFPPSPLVGGLSPGKAKKQGPSKRGAKRGGVFEKEKTPFPPSGVGRPPPIIFYERVFSSRAGGEKNILL

SEQ ID NO: 77095 - DNA, 1013 bp, Zea mays
  misc_feature: Ceres CLONE 1561967
  misc_feature: Encodes the peptide sequence at SEQ ID NO. 77096
  misc_feature (282)..(282): n is a, c, t, g, unknown, or other
ctccccgcggtggcggccgctctagaactagtggatcccccgggctgcaggaattcgtctcacccctagaaaaagcactgaacattctacaagcctattctgcctctctctctctctctttctctctcaatcgcaagccataagagctagcaaggcagcgcaccctcttcaggcggcaagcaagggaggctgtggcggccggcatacaaaatatatgcagcacatgttccctctgctcagcaccgtcagcagcatgcaaaggacctcctcccggccccccgncagcagcagagcagcaagcagctgatgaggacggtgtccatctcggtgctggtgatgtcgcttgccgtgctctacgtctcccttcctccaagttccgcccggcggggtcgcccccaaaacacccttctggtttctccaggtccaactccaataataatcggtatcccccgccaaatccgggaatggtctttttttcggttcctcctcctcctcccctgcccgaagacagcgaacgtttgaaaggggaaacgggggcctttcaaagcgccgccccccggggaaagaccaaccagggcttctttttggggttggcggggggggcccccccacccccaaaaaaggggggggaaaaaaaaaccccccctttaaccatttgtgtggttcgaaaggcgcggaacccaacaaaaaaccccctttggggggccggggggggaaaaacaaaaccaccgcgggcccgaaaagaaaaaaaaaataccttccttcctttaaccccccacaggggaaccccgaaacccggacccccgccccgggaaaacaaaaaaaccaccggggcggcaaaaaagggtgaggccccccgggggccccggggaccccggcccttctaattttaatactcgttaaaggccccttttcccccctatacttgtgagaaaaaaaaaagtgggccccccagggaaaaaaaaccaagaggggggtttccgtgggcccgcaataaaaaaaaaaaagaaaga

SEQ ID NO: 77096 - protein, 71 aa, Zea mays
  misc_feature: Ceres CLONE 1561967
MRTVSISVLVMSLAVLYVSLPPSSARRGRPQNTLLVSPGPTPIIIGIPRQIREWSFFRFLLLLPCPKTANV

SEQ ID NO: 77097 - DNA, 758 bp, Zea mays
  misc_feature: Ceres CLONE 1561968
  misc_feature (657)..(657): n is a, c, t, g, unknown, or other
ccgcggtggcggccgctctagaactagtggatcccccgggctgcaggaattcgtctcacccctagaaaaaaggatccctcccttccgcgtggtgtgctctctgttcccctttacgccgtttcctctcccgactctctcctcgccggcgacgccgcggagtaggtgcaacagaaactgctcgaggcggaggcggagcctgcggctgcacagacatgggtgatcacgaggcgcgcggtgatgacttctagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggctgcctcagcgtacgtcgaggcagcaaattgctacaaaaagttttcacctcaggaagctgcgcaagcgctaaaccagtctgttaatcttttcttggaaattggtatgttgaacatggctgcaagatacagcaaggacattggtgagatatatcagcaagaacagatttagagaacgctacaattacctggaagggcagctgacctttttgacagtgacggacagtcgtctncatcaaacacagtcaacagaaagtgcagaaatggctgctcagtttggaaagtacccaaagcgactgagattttggaagcgattcctccgcaagcaatcaaa

SEQ ID NO: 77098 - DNA, 766 bp, Zea mays
  misc_feature: Ceres CLONE 1561969
  misc_feature: Encodes the peptide sequence at SEQ ID NO. 77099
  misc_feature (679)..(679): n is a, c, t, g, unknown, or other
  misc_feature (680)..(680): n is a, c, t, g, unknown, or other
ctccccgcggtggcggccgctctagaactagtggatcccccgggctgcaggaattcgtctcacccctagaaaaaatccgtccaatcaaccgggctgctctgctgcctctccggcgccattgacgagcaagagagtgctccgacacctggtccgtcgcgtgccgtgcccacccgctaaggccagggcgccccgactcgagctcaccgcgtcgaactcgaaccgctgctgttcctcggcagggggcagggtcgtcgaggatgccggagcactcagagaacgcggcggcggacctgatgggcaacatcatggagaccatcgcggagaacctcccgaggcagaagtccgtgcggttcgacgacggcgacggctcctccatctccgagcaggccaagaagctgttcagcggcggcgagagcaggaagaagtcggtccaccacgtgctgggcggcggcaaatccgccgacgtgctgctgtggcggaacaagaagatctcgtccagcgtgctgggcgtggcgaccttggtggtgggtggttcttcgagtggctggactaccacttcctcaccatccctctgcttcgtgctcgcgctcggcatggccgtccagttcgcctggtccatcttctcgtccagggtgcctcgcgtgcagctgccggaggagctgtttcgcgagcgccgggnnccgcccgcgggcgcccagtgaaacagggcgcttggcttccctccaaggacgtggcctggcggagcgacctccagcgggtgggtctc

SEQ ID NO: 77099 - protein, 147 aa, Zea mays
  misc_feature: Ceres CLONE 1561969
  misc_feature (141)..(141): Xaa is any aa, unknown, or other
MPEHSENAAADLMGNIMETIAENLPRQKSVRFDDGDGSSISEQAKKLFSGGESRKKSVHHVLGGGKSADVLLWRNKKISSSVLGVATLVVGGSSSGWTTTSSPSLCFVLALGMAVQFAWSIFSSRVPRVQLPEELFRERRXPPAGAQ

SEQ ID NO: 77100 - DNA, 792 bp, Zea mays
  misc_feature: Ceres CLONE 1561970
  misc_feature: Translation starting site: 236
  misc_feature (581)..(581): n is a, c, t, g, unknown, or other
  misc_feature (590)..(590): n is a, c, t, g, unknown, or other
ctccccgcggtggcggccgctctagaactagtggatcccccgggctgcaggaattcgtctcacccctagaaaaagcattagcacagaagacgagccgtgccttccgcccttcccttggctacctctgtctgtctgtgtcttgtccagtccgggtctccagggctccggcaccggcaggcagagagctaccaaaccccaccaccacgaacggccgccgccgacgagacgggggcgcatggcgactgcatcctccttcaccgccatcttcttcagcagcgccttcgcggcctgcttcgcggagccaaagtgcggctccagctgcaaaggaaggcaccactaccgtcgccaccagtggctgcagcagctgctgctggaggcacgctagccacaatcatgtgcatcgccagggaaggaaggggttgccgcgctctggaagggcgtcatccccggcctccaccgtcagttcctctatggcggcctccgcatcggcttgtatgagcctgtgaaggctttcttcgtcggaggcgctgttgtgggtgatgtcagtttactaagcaagatccttgctgcacttaccacangtgtgatangcgattgttgtggcaaatccaactgatcttgtcaaagttaggttgcaagctgatgggaaagctaacactatcaagaaggagttattctggagccccttaatgcatacgctacaataatcagacagggagggattgggagctttttggaccgggccttgggcccaaatgtcgcacgcaatggccataattaaaccctgccgaa

SEQ ID NO: 77101 - DNA, 838 bp, Zea mays
  misc_feature: Ceres CLONE 1561972
  misc_feature: Encodes the peptide sequence at SEQ ID NO. 77102
ctccccgcggtggcggccgctctagaactagtggatcccccgggctgcaggaattcgtctcacccctagaaaaaattccatccatggattaattagcaggtcgagagaggaagaagagagcaggaggaggacgacgatggttggaggccgtcccctcttcgtgctcttcggctcctccatcgtgcagtacagcttcagcaacggcggatggggcgctgtgcttgccgacatctacgcccgcaaggctgatatcctgctaagaggatatactggctggaacacaaggcgggctgttcaagtcatggataaagtgttccctaaggattcagcagtgcagccgtctctggtgatagtttactttggtgggaacgactccatcgctgcccattcctccggcctcgggcctcatgtgccgctagacgagtacatagccaacatgagaaagatcgcggagcaccttcagagcctctccgagaagacgcgggtcattttcctgagctgcccgcctctgaacgaggagatgcttcggaagtccacccgtagcatagcccatactgagtgagatcgtccgggaccaacagaccctgccgcctggtcctccgaagcccggctggggctcttttccaggggatggggcctcagggggggggaatttttggggtgtcccttccaaaaaaggggggaaccggaaaaaccccctcctcccccgggaggggggttcctttttttttttaaaaaggggggagccaactgtgggggggggggaaaaaaatatccctccgggggccgttctccaaaagaggccccaaaatagggagacaccctctctctctctccc

SEQ ID NO: 77102 - protein, 141 aa, Zea mays
  misc_feature: Ceres CLONE 1561972
  misc_feature (8)..(140): Pfam Name: Lipase_GDSL Pfam Description: GDSL-like Lipase/Acylhydrolase
MVGGRPLFVLFGSSIVQYSFSNGGWGAVLADIYARKADILLRGYTGWNTRRAVQVMDKVFPKDSAVQPSLVIVYFGGNDSIAAHSSGLGPHVPLDEYIANMRKIAEHLQSLSEKTRVIFLSCPPLNEEMLRKSTRSIAHTE

SEQ ID NO: 77103 - DNA, 1333 bp, Zea mays
  misc_feature: Ceres CLONE 1561975
  misc_feature: Encodes the peptide sequence at SEQ ID NO. 77104
  misc_feature (1)..(1): n is a, c, t, g, unknown, or other
  misc_feature (323)..(323): n is a, c, t, g, unknown, or other
  misc_feature (1103)..(1103): n is a, c, t, g, unknown, or other
ntttttttttgcccgtggaaatcctacaaaacacccaattttaacccttacactttttaaacaaaatttatggtactcaccgcggtggcggccgctctagactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcntccggaagcccctggtacggccccgaccgcgtcaagtacctcggccccttctccggcgagcccccgagctacctcaccggcgagttccccggcgactactgctgggacaccgccgggctgtccgccgacccctagaccttcccccacaaccgcgagctggaggtgatccactcccgctgggccatgcttcggggcgctcggctgcgttctttccctagctgcccctcccgcaaacagcgttaaagttcaggtgaggcccgtctggtttaaggggcggcctcccatatccttcaaccaaagggcagggcctggatttttcttctggccaacccccaatccctggattccacagcgccaggaggaattccctccgcccattttggggggccttgcccaagagtcagtggccctccatgtgggtggtcccacgtccgagtggggcctaacactgcttatttgttccggggacagggccccggctccgcgcgcgcacagaagtccgcttgcgaaaacaccgcccgctgagttagacactcccttgaggtcgatggacataggattttttctattaaaacccccctccctatctctgtatcccgaggggggccctcaatacagataacacccaccgggaggagagctccttttcttcccgcgaaaataccctacaaagagggggggtaaaatgagaaaaccctcccaagaataatacggagcccggcccctcccctcgtccccactggtgtttttttctcataaggtgtttgagggagacgtttntctttaacgactctcaagggggcacaatatcgtgtttctacccactgtatacaatgggggtgcaccaccgccctcgtaaaaaaacacactctcccctagatacaaatatatagtcgcggggaaaaccgcgatatcaataaagactataacgaggattgtggggtcggtactcacacaactaataatttatattccccgcgctgcacactaatatctccacacgccgtgct

SEQ ID NO: 77104 - protein, 85 aa, Zea mays
  misc_feature: Ceres CLONE 1561975
MAASTMAISSTAMAGTPIKVGSFGEGRITMRKTVGKPKVAASGSPWYGPDRVKYLGPFSGEPPSYLTGEFPGDYCWDTAGLSADP

SEQ ID NO: 77105 - DNA, 772 bp, Zea mays
  misc_feature: Ceres CLONE 1561976
  misc_feature: Encodes the peptide sequence at SEQ ID NO. 77106
  misc_feature (590)..(590): n is a, c, t, g, unknown, or other
  misc_feature (605)..(605): n is a, c, t, g, unknown, or other
ctggagctccccgcggtggcggccgctctagaactagtggatcccccgggctgcaggaattcgtctcacccctagaaaaaaccgggtgacacacaggcacaaagacaccgcccgtacacaggctcgttggcttggctgctgtgtgttgcgctcagccattcagacttgagagctactagctaactgctcgttgggtgtgggtgcgctcccggcctagaccgtggaggaaaggagtccagtccactcactaccccctctgctccgttcgggttccaggccagcacagccgagggttccgcacagcgataagcgcgaagcggaagagatggagcatatcgccaggttcttcttcggagtttctgggaatgtcattgcgctcttcctcttcctgtcgcctgttgtcaccttctggagggtcatcaggaagcggtcgacggaggacttctccggcgtgccctacaacatgacgctgctcaactgcctcctatcggcttggtacggcctagccgttcgtgtccccgaacaacatcctggtgtcgacgatcacgggacgggggtcggtgatcgagccatctaccgtggtgatcttncctcatctccgcggntggaccggcgggccaggctcaacatgctgggcctccctgggcatcgtcgcctcatcttcaacaccggtggtgctcgtctcgctgctggcccctcaacgcaacgcccggcaatgatcttcttgaggcctcgccgcccacatcttctccaatttgcatgtacgcctcgc

SEQ ID NO: 77106 - protein, 149 aa, Zea mays
  misc_feature: Ceres CLONE 1561976
  misc_feature (7)..(68): Pfam Name: MtN3_slv Pfam Description: MtN3/saliva family
  misc_feature (89)..(89): Xaa is any aa, unknown, or other
  misc_feature (94)..(94): Xaa is any aa, unknown, or other
MEHIARFFFGVSGNVIALFLFLSPVVTFWRVIRKRSTEDFSGVPYNMTLLNCLLSAWYGLAVRVPEQHPGVDDHGTGVGDRAIYRGDLXSSPRXDRRARLNMLGLPGHRRLIFNTGGARLAAGPSTQRPAMIFLRPRRPHLLQFACTPR

SEQ ID NO: 77107 - DNA, 775 bp, Zea mays
  misc_feature: Ceres CLONE 1561980
  misc_feature: Encodes the peptide sequence at SEQ ID NO. 77108
ctcaccgcggtggcggccgctctagaactagtggatcccccgggctgcaggaattcgtctcacccctagaaaaacttgacctcacaaaggcagtaaaggatacagttaatgtaagcgctggagatgttgcttctctcatatatttgtggaacccttgggcaatagtcacttgtgtgggatcatgtacatcaccaatcgagaatctaatggttgtaataatgatctacggatcctgttcacgtctggctcctcttgctgcttttggatatgttatggccacacacctctctctttatcctgcaattctcatagtaccggtcattctgttgctgggttatggtctagatgctcctcctccaaaagtatttgttataaaagggtcaattgccagaaaaagtgatgtgtcagacaatgataaaacaagcagacagagagttgttcagcagttttcatggaaaccagtacttcactttatattttggctgttcatctggtcgtgccatgtgttgttattgagcagcgtgattttgaagaagttgggtggcctcacgagatgtttgaaaagacgtatggttttatacttacagtgaaaagactatcacaaaatatttggtggttttgtgggtactcctttgcctgaagttttcgactttctttagaaatttcctttcctaaggggattccaatatgaaccatcaatttttatggggccctaacctttggggccatcccaatttgaaaacatccggcccggtggcctttcctttggatttta

SEQ ID NO: 77108 - protein, 195 aa, Zea mays
  misc_feature: Ceres CLONE 1561980
HRGGGRSRTSGSPGLQEFVSPLEKLDLTKAVKDTVNVSAGDVASLIYLWNPWAIVTCVGSCTSPIENLMVVIMIYGSCSRLAPLAAFGYVMATHLSLYPAILIVPVILLLGYGLDAPPPKVFVIKGSIARKSDVSDNDKTSRQRVVQQFSWKPVLHFIFWLFIWSCHVLLLSSVILKKLGGLTRCLKRRMVLYLQ

SEQ ID NO: 77109 - DNA, 832 bp, Zea mays
  misc_feature: Ceres CLONE 1561982
  misc_feature: Encodes the peptide sequence at SEQ ID NO. 77110
  misc_feature (621)..(621): n is a, c, t, g, unknown, or other
  misc_feature (754)..(754): n is a, c, t, g, unknown, or other
ctccccgcggtggcggccgctctagaactagtggatcccccgggctgcaggaattcgtctcacccctagaaaaaatcctacgacaaaagcaaagcaaagcagctcaaaaaagtttagccagctagcaagacatggctccacttgttgctgctgccacgaatcacactgcccatagaagccacatatagtaggacccaacaatgagaattttccaaggcaccaaccttgttcatcacaaaacagaaacaaaagactcaggcttaggtcacgagcacaaaggataagcagtcagctgcttgcaagccaaaagctgatgccatggcaaatccctaaaagggactggtttcctcctagcttcatctttggtgccgccaccgcagcataccaaattgagggcgcctggaatgaagatgggaaggggccaagcaattgggatcacttctgccacaattatccggattggatactggacggaagcaatggggacactggagccaattcctatcatatgtaccctgcggatgtcagattgctaaaggaaataggcatggacgcgtacagattctccatctcttggtccagaatactgccgaagggaacgctcgaaggaggcattaatcnaggccggcatcagtactacaaaaagctcatcaacttattgatagagaacgacatagagccatttgtaaccatttttcattgggacgtcccctcagcactggaaagacaagtacgggtggctttttaggcgacnggattgtaaaggatacacagactttcgcttaagtggggctttgagaacttccgtgacaagttgaagaaattgttgacc

SEQ ID NO: 77110 - protein, 144 aa, Zea mays
  misc_feature: Ceres CLONE 1561982
  misc_feature (7)..(144): Pfam Name: Glyco_hydro_1 Pfam Description: Glycosyl hydrolase family 1
  misc_feature: SWISSPROT Homolog: EC 3.2.1.21 Beta-glucosidase
  misc_feature (103)..(103): Xaa is any aa, unknown, or other
MPWQIPKRDWFPPSFIFGAATAAYQIEGAWNEDGKGPSNWDHFCHNYPDWILDGSNGDTGANSYHMYPADVRLLKEIGMDAYRFSISWSRILPKGTLEGGINXGRHQYYKKLINLLIENDIEPFVTIFHWDVPSALERQVRVAF

SEQ ID NO: 77111 - DNA, 833 bp, Zea mays
  misc_feature: Ceres CLONE 1561985
  misc_feature (361)..(361): n is a, c, t, g, unknown, or other
  misc_feature (483)..(483): n is a, c, t, g, unknown, or other
acccgcggtggcggccgctctagaactagtggatcccccgggctgcaggaattcgtctcacccctagaaaaagggcgcaatcgggaacggggaaccctagggcagccggcagcgtcgctccgccccggccgtcgtcgtcgcgcgtcgccgtccactcgcttcctgctcgggccttcgcccctcggccacgtctctgccctcgccccttggtcgggaccgacgtcctcgctccatctagcaagctgatcagctcgactgcttgagctcgtcctcgccatcgccgctttgatttcttcctttcagcccgacccggctcaaagcagccagatcacggcactccgtccgaccctcgaagcgatcnacttcaccgcctctcctcctcgttacaggtggggaatgattccgcagaagcagagcagcttccctgcagcggctttcaacacgtcaagaaaacggaaaatggcgggtgcttgaagctttccnggagccgggaatggaggaagctgggaaaactcccagggcccttccaaccgatgcaatcagcggggaaccggccggggagttcatgaatcccctttgaagggaaattcaaacaacgtttgcctgaaggaaatctaaaaagggcttgtggaaaaaccccccattttaaaaaaggggggaataacacggccaaggaattgttaaatggaaaatatcctccaaaaaaccgggggattttttaatttagaaaaatttggaaacccttggcaaaaaaaccctttaaaaaattaccccggaggagaaagttttccccgggctcacaaaaaatttttctttttggggggaaaaaaaat

SEQ ID NO: 77112 - DNA, 809 bp, Zea mays
  misc_feature: Ceres CLONE 1561987
  misc_feature: Encodes the peptide sequence at SEQ ID NO. 77113
ctggagctccccgcggtggcggccgctctagaactagtggatcccccgggctgcaggaattcgtctcacccctagaaaaactgccccgccgcgccccctcgcgtccgttcctcccttcctttccgtgtcggtctccggcgcgcccgacgtagcgcccgcatccgacggccgtgggggcatcgacggccgggcgacgcgacgcgatgtgaccatgacccgtcagtcagcagtacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaaagatatgtgattttggtctcgcacgtacaaacagtagcaaaggccagttcatgac

SEQ ID NO: 77113 - protein, 175 aa, Zea mays
  misc_feature: Ceres CLONE 1561987
  misc_feature (32)..(175): Pfam Name: Pkinase Pfam Description: Protein kinase domain
  misc_feature: SWISSPROT Homolog: EC 2.7.11.24 Mitogen-activated protein kinase
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKDM

SEQ ID NO: 77114 - DNA, 651 bp, Zea mays
  misc_feature: Ceres CLONE 1561989
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (27)..(27): n is a, c, t, g, unknown, or other
  misc_feature (29)..(29): n is a, c, t, g, unknown, or other
  misc_feature (41)..(41): n is a, c, t, g, unknown, or other
  misc_feature (55)..(55): n is a, c, t, g, unknown, or other
  misc_feature (58)..(58): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
gggggggggggnnnngggggggggggngncggggggtagtngggggggttgttgnganaggggcnnnggnnnnnnaaaaacggactcacgcggggcggccgctcagaactatggatccccggctgcaggaattcgtctcacccctagaaaaaactcaaatcacaaaaccccgctacctcttaactcttcacacgcacaccgtcgtcaaccatggttgctgacatgaaggagaaacggcggcgcggtgttggcggccgggcgagaaggcgccgcaagtgggtcgtcaaggcgcggcgaagccgaaacccttggggggcccccccgggccggaaaagcccaaacccccaaaccgggcccggggccaggtaacctaaccctgggtcccaaaaccctggggaaacccaggaaaaccatttcccccggggggggaaaaaccccgggggcaaaaaaaaagggggggaaaaacggggccaaaaaacaaaaaggcccccccaaaaaaacttggagcccccggggccccggggcccggggttccaaaaaaaaatttttggggcccgggggccccccgggcgaaaggttttttccccccgggggaaaaaaaaaacgggcccccccttttttgggggggagaaatagggagacgaccccttt

SEQ ID NO: 77115 - DNA, 935 bp, Zea mays
  misc_feature: Ceres CLONE 1561991
  misc_feature: Translation starting site: 153
  misc_feature (818)..(818): n is a, c, t, g, unknown, or other
ctccccgcggtggcggccgctctagaactagtggatcccccgggctgcaggaattcgtctcacccctagaaaaaacagaaccctgcaactgcaagctaaggagagtgtgatcaccaacagctagtgctagtcccccttccttccatccatccatggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacgatcagcgtggcgtggcgctcctgagcgagacatgtccacacccgtgctggtggccacagcagaccagaccctggaggacgtcgagtgccacttcgaggccgtgtcggggcttccggtcgtcgacagcggcctcagatgcgtcgggggtgatcgtcaagaacgacggggcaaagagcctctcatgggttcaagacgagatatcggaagtgatgacatctccagctatcacactatcgtctgacaaaaccgtgatggatgctgctgttctcatgctcaaagagaagatccacagataccagttggtaaccaggacgaaaaaggataagtataggtacccccgctgatgttctccccgtgttgaaagcattgtttaaaattangagcgcgaataccctgcttcgaagcacaacctcctgtaaataattaaatgtgcccgggcatgggggttctgaataccaccaagagacctcccaggttatggaagttctcccttggaa

SEQ ID NO: 77116 - DNA, 757 bp, Zea mays
  misc_feature: Ceres CLONE 1561992
  misc_feature: Encodes the peptide sequence at SEQ ID NO. 77117
  misc_feature (695)..(695): n is a, c, t, g, unknown, or other
ctggagctcaccgcggtggcggccgctctagaactagtggatcccccgggctgcaggaattcgtctcacccctagaaaaaatcccattccataccattccgccaaagaagaaccacagacgctcgctcccaactcccaagccaagccggatcccaaaatcggcacagcgcacccactccgctcagtcccttcgttcacccccatccatccagccagccagccagccatgggcggcaaggactgcggcaaccacggcgaggacgacctgcggcggtcgtgccggcgcctgctagcgatcctcctagtcctggccctgatcgtgggcgtgatcgcgctgatcatctacctggtggtccgccccacgcacccgcgcttctacctgcaggacgcgtcgctgcagcagctagacctctccaacgccaccaccaccaccaccacctccgcgtcctcgtccctcctctccacgacgctgcaggtgacgctggcctcgcgcaacccgaacgagcgcgtgggggtgtactacgaccggctggacgtgtacgcgtcgtacaagtaccagcatgtgacggtggccgcggcgctgccgcccgtgtaccagggccacggcgacgtggacgtgtggtcgcccgtgctctcgggccccgggcgtccccttcgcgccctaactcgccgacgcgctccggcagtactgccangcggggctacctcgtcctccaggtcaaagtccaacaggccgcgtgtcgatggtaaggtcggc

SEQ ID NO: 77117 - protein, 177 aa, Zea mays
  misc_feature: Ceres CLONE 1561992
  misc_feature (40)..(176): Pfam Name: Hin1 Pfam Description: Harpin-induced protein 1 (Hin1)
  misc_feature (157)..(157): Xaa is any aa, unknown, or other
MGGKDCGNHGEDDLRRSCRRLLAILLVLALIVGVIALIIYLVVRPTHPRFYLQDASLQQLDLSNATTTTTTSASSSLLSTTLQVTLASRNPNERVGVYYDRLDVYASYKYQHVTVAAALPPVYQGHGDVDVWSPVLSGPGRPLRALTRRRAPAVLPXGATSSSRSKSNRPRVDGKVG

SEQ ID NO: 77118 - DNA, 810 bp, Zea mays
  misc_feature: Ceres CLONE 1561995
  misc_feature: Encodes the peptide sequence at SEQ ID NO. 77119
ccccgcggtggcggccgctctagaactagtggatcccccgggctgcaggaattcgtctcacccctagaaaaaagttctcctgcccgctgctgccctccgtccgcgtccagatcccgccaccaaccgatccggcgccctccagcatggcgggggcgggagcggggacgaaggcggcgggagccctggctctggcgctcgtgctcgcgctcgcgggggccaactccgagggcgacgcgctctcggcgctgcgccggagcctcagggaccccggcggcgttctgcagagctgggaccccacgctcgtcaacccctgcacctggttccacgtcacctgcgaccgcgacaaccgcgtcacccgcctagatcttggtaatttgaacttatctggtcatctggtgcctgagcttgggaaactggagcatcttcagtatctggaactttataagaataacattcaaggaacaatcccttctgagcttggcaacttgaagaatctaataagcttcgacttgtacaagaacaacatttcggggacaatacctcctgcccttggaaagttgaagtcccttgtattcttgcgtctcaatggcaatcatttgactgggcccatcccaagggaactcgctgggatatctagtctcaaagttgttgatgtttcaagtaatgatttgtgcgggacaattcccacctctggagcatttgagcatattcctctgagccactttgagaagaacccccccttgggaagtccagagctacaggggctggccatatacgacacccactgctagaggcacaccaagataaaag

SEQ ID NO: 77119 - protein, 215 aa, Zea mays
  misc_feature: Ceres CLONE 1561995
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MAGAGAGTKAAGALALALVLALAGANSEGDALSALRRSLRDPGGVLQSWDPTLVNPCTWFHVTCDRDNRVTRLDLGNLNLSGHLVPELGKLEHLQYLELYKNNIQGTIPSELGNLKNLISFDLYKNNISGTIPPALGKLKSLVFLRLNGNHLTGPIPRELAGISSLKVVDVSSNDLCGTIPTSGAFEHIPLSHFEKNPPLGSPELQGLAIYDTHC

SEQ ID NO: 77120 - DNA, 855 bp, Zea mays
  misc_feature: Ceres CLONE 1561996
  misc_feature (758)..(758): n is a, c, t, g, unknown, or other
  misc_feature (796)..(796): n is a, c, t, g, unknown, or other
ctcaccgcggtggcggccgctctagaactagtggatcccccgggctgcaggaattcgtctcacccctagaaaaaatccaggtcagtacggcttggagccaagaagaaccactgaggctcgctccgaactcctgagccgagccggatacgaacatcctcacagtggacccactcggatcagtcacgtcgttgacccccatccttccagccagacagcaagccatgggcggcaaggactgcaggaaccactgcgaggacgacctgtgacagtcgcgccggaacctgccagcgatcctgatagcgatggacctgatcgcgggcttgatcgcgcttatcagctgcctggggggcacccccacgggcacgagctgatacctgcaggacgggtcgctgctgcgcctagacctgtgcaggccctcctgcagcacaacgtactggcggatcctacgccatcctgatgcccaacgctgacgaggggacgctggcctcgcccttaaccataacaagcaccgtggggggtggacttaaaacgcggtgggaagtgaaaacgggttcccacccagtacccagacaagggtaccagtgggccagctagcccggttcccccgggttttttcccagggctccccggcgaaacaagaaaacgtgtgcggggagcccgattgctccataccggccccggtggtaccacctttgcggccaaaagagccctccccaacggggggttccacccggggtttcgcggggtgaggggggtcncgccccattctgtttcaaaaggaattggtcccaaaggnccccgagagaaaatttagaaaagggtggggcccacatgttaaccttccgaaaaacctgt

SEQ ID NO: 77121 - DNA, 887 bp, Zea mays
  misc_feature: Ceres CLONE 1561997
  misc_feature: SWISSPROT Homolog: EC 4.4.1.5 Lactoylglutathione lyase
ctcaccgcggtggcggccgctctagaactagtggatcccccgggctgcaggaattcgtctcacccctagaaaaaagtgcatacgcagcgtatgctggtagcaagtggcgggggagaccaataatggcctggtgctgctggacttctgggtgagcccgttcgggcagcgctgccgcatcgcgctggcggagaagggcatcgcctacgagtactcggagcaggagctgctgggcggcgcctagagcgacatcctcctccgctccaacccggtgcacaagaatatccccgtgctcctccacgacggccgccccgtctgctagtccctcgtcatcctcgagtacctcgaggaggccttcccggaggcctcccccaggctgctccccgacgccgcctacgcgcgcgcgcaggcccgcttctgggcggcctactccgacaaggtctacgaggccggcacgcggctgcggaaactcacgggcgacgcgcgggcgcaagcgcgctcctagatcctgcaggtggtccggaacctcgacggggagctaggggacaaggccttcttcggcggcgaagcgttcgggttcgcggacgtggcgctcgtgcccttcctgccgtggctccccagcttccagcggtacggggacttcaccgtggcggagatccgcacccacgctagccgcatgtgctcaccggtgcgctcatcaggacagcgtggccaagacccttctcccggccggaaaggtgggacgagttcatcgccctgctccagaagaactacgggcttcgagtactagagcgggactactcctggcagaaggagatggttacgggccgctacgtacgtgggctgcccagtgcagtttttgtttcggggttgctttaacggggaacacc

SEQ ID NO: 77122 - DNA, 811 bp, Zea mays
  misc_feature: Ceres CLONE 1561998
  misc_feature: Encodes the peptide sequence at SEQ ID NO. 77123
tccccgcggtggcggccgctctagaactagtggatcccccgggctgcaggaattcgtctcacccctagaaaaaaagggaaacacaggaacgacaggcaattcgaggcgggcaatctaatcgtctgccatcccgtctcatcgttctcccaaatctgagagcgttcccaggacctagggttcttgagatccagccccaggatggatccgaaccctagagctcccctcctcctcgccatcgtcgttctcgcgcttggcgtatccgtggtggccagcgccgaggacgacgcgtcgggggtctctctgggccgccgcgccggggggttcttgcacggcctgaagaaggatgcactggcggagggcgatcatggggtggcactagacgaggttggaccggggctgttcgacgcactctttgccagcctctccatgatactagtcagtgagattggagatgagaccttcatcattgctgcgctgatggcgatgcggcaccccaagtcaattgtgttgtctggtgcactatctgcgctttatgtgatgacagtattgtcaactggacttggcagaatagtgcccaacttgatatcaaggaagcacactaatagtgctgctacagttttgtacttggtctttgggactacgggttgctggatattggctgggaaatctgacccccaagggattcccccaaaaaaagggaattgggaaaaaattttaaaaaaaaaaccttttggttccggggccaagggggaaaaacaacccccctccccggaggggtttttttttggcaaaaaattttttggaaaccacc

SEQ ID NO: 77123 - protein, 204 aa, Zea mays
  misc_feature: Ceres CLONE 1561998
  misc_feature (72)..(146): Pfam Name: UPF0016 Pfam Description: Uncharacterized protein family UPF0016
MDPNPRAPLLLAIVVLALGVSVVASAEDDASGVSLGRRAGGFLHGLKKDALAEGDHGVALDEVGPGLFDALFASLSMILVSEIGDETFIIAALMAMRHPKSIVLSGALSALYVMTVLSTGLGRIVPNLISRKHTNSAATVLYLVFGTTGCWILAGKSDPQGIPPKKGNWEKILKKKPFGSGAKGEKQPPSPEGFFFGKKFFGNH

SEQ ID NO: 77124 - DNA, 839 bp, Zea mays
  misc_feature: Ceres CLONE 1561999
  misc_feature: Translation starting site: 142
  misc_feature: SWISSPROT Homolog: EC 3.4.23.40 Phytepsin
ctggagctccccgcggtggcggccgctctagaactagtggatcccccgggctgcaggaattcgtctcacccctagaaaaagctggcacgtcagttgctacctttctcttctgctgctcgccctcggtttctgatcgcgaccatgggaccccgcggcgtcgccctagcgctcctcgcggcggcgctcctccaggccctcgcccccgcgtcggcggcggcggcggcggcggcggcggcggggggcctggtgcgggtcgcgctgaagaagcagcccgtcgaccagaacgcccgcgtcgccgcgcgcctctccgctgaggagaggcagcgcctcctcctccgcggcgcctacgccctgggctcggccggcggcgacgacgactccgacgtcatcgcgctcaataactagatgaacgcgcagtactttgggggagatcgagcgtcgggacgccgccgcagaagttcaccgtcatcttcgacaccggcagctccaacctctgggtgccgtcctccaagtgctatttctcgatcgcttgctacttccactcgcgctacaagtcagggcagtcaagtacttataagaagaacggaatacctgctgccattcaatatggaaccggtgcaattgctgggttttttcagtgaggatagcgttaaattaggtggatctgggatgtgaatgatcaaggaatttattgaaaccgccaagggagcaggccttacctttatgggttggcaaaatttgaatggcattctttgggcgtagggctttcaggaaaaatcctgttgggggatggcaacaaccggggtggggaaaaactgggtaaaaacaaaggtctcata

SEQ ID NO: 77125 - DNA, 824 bp, Zea mays
  misc_feature: Ceres CLONE 1562002
  misc_feature: Encodes the peptide sequence at SEQ ID NO. 77126
  misc_feature (502)..(502): n is a, c, t, g, unknown, or other
  misc_feature (793)..(793): n is a, c, t, g, unknown, or other
  misc_feature (794)..(794): n is a, c, t, g, unknown, or other
ctccccgcggtggcggccgctctagaactagtggatcccccgggctgcaggaattcgtctcacccctagaaaaaacccacagcccacctggtctgtcatcccctttgctacgctccccttgccctgtcccctcgccgcccgcgcccgtggagttcttcgatcgagtcctcggagcccggagcacctggtgcaacaatccggacccgcgcgaggaagggcggagagagagccgaatctgagcctcggcacaagttgggcacccgtcaagattctcggcccgatctgctgcggaacatggagctggacagcatcgagtgcatgtcctactccgacagcatgggggacgacgacaccgacgccgtcacctcgtcccagctccctcgccccttcctcaaatcctcctccaccgccggtactgccgccgtcaacgtggtcgtcgtctccgaccgcgtcggtgccgccgggccggtagcgggagcgggttcgctggtgatttcgccanccacgggcgtgcacgagctgctcgagtgccccgtctgcacaaatccatgtacccgcccatccacagtgccaaaatgtcatactctatgttcacctgcaaaactcggtgcacaaccgctgcccaactgttcgacagagctaggtgacatccggggtcggccattagagaggggggtgaaatactttgggctccccctgaaaaaacaactttctttggggggtttagaaaaaatttttccctcttttttggggggaaaattgttggggggggagaaaccacaacccggggggnnttatttttgttgggaagacatatccttttt

SEQ ID NO: 77126 - protein, 176 aa, Zea mays
  misc_feature: Ceres CLONE 1562002
  misc_feature (70)..(70): Xaa is any aa, unknown, or other
  misc_feature (167)..(167): Xaa is any aa, unknown, or other
MELDSIECMSYSDSMGDDDTDAVTSSQLPRPFLKSSSTAGTAAVNVVVVSDRVGAAGPVAGAGSLVISPXTGVHELLECPVCTNPCTRPSTVPKCHTLCSPAKLGAQPLPNCSTELGDIRGRPLERGVKYFGLPLKKQLSLGGLEKIFPSFLGGKLLGGEKPQPGGXYFCWEDISF

SEQ ID NO: 77127 - DNA, 799 bp, Zea mays
  misc_feature: Ceres CLONE 1562003
  misc_feature (564)..(564): n is a, c, t, g, unknown, or other
ctggagctccccgcggtggcggccgctctagaactagtggatcccccgggctgcaggaattcgtctcacccctagaaaaaagtcacacgtgtctgagggaacagattgcttgggctctgaaacttaagccaaatcaacacatgtctgagcgagatgtgtgtgcctgccaaccttgggtgcttggctccgaggatctccttctggccgtacttcctccagctatggccgtcctcgaccgggttctcgccgccggcagagctcaccctctgcctccgctgttccatcaccttcctgcgagcgaacacacacacacgcgacgggttcagtttagcaaagagtcagcctaacttgttgctgtttctgtttcgaccgattatctatatacatattaattccttgatcgagcaagcagcaagcgttcgtggcgaggtcacctcttcttcttggtggtctggaaaggcccgtcggtgacgtcgctggtgggcgtcgccgagagcggcgaggcgaggccggcgtcgcccgcgggtcgcttccgccgccgggcgccgtcgaggttggaggaangtgatgaggccgatggagcgctcggtgaagggagaagatctgcgaggccaggtgcttgcacaggtccggggacccgccgaggtgcacctccagctgcctcaccagctccttgatgtggctcagctccgtcaccaccagcccgccgcagctgcctcctccactgctattgacgccgccgcctacgacgcccatctccatctccgtcgacgcatgtggacgatggtgagaactgaaa

SEQ ID NO: 77128 - DNA, 803 bp, Zea mays
  misc_feature: Ceres CLONE 1562005
  misc_feature: Encodes the peptide sequence at SEQ ID NO. 77129
  misc_feature (599)..(599): n is a, c, t, g, unknown, or other
ctggagctccccgcggtggcggccgctctagaactagtggatcccccgggctgcaggaattcgtctcacccctagaaaaaaaaaaacctcgcccactctacaaacacgtgacacctccgcccaccctcgccccctccctaccggcaccgcccagatggcctgctcccacatcgccgccgcgggggtctcctcccccgccgcagcggcggctcgttccccggcgcattctcccgctgccgccttcgcgcgcctccggtcgacgcctcgtttcgcgagcgctggcttgtcggttaagggaaacggagcggcgttcccgttggtcgccgccgcggggccggccgcggcggcaccggtggccgacctggacggccgcccggccacggagaagcagcccatcatcgtcatcgacaactacgacagcttcacatacaacctctgccagtatatgggggagcttggattgaacttcgaagtataccgcaatgatgaactgaccatagaagatgtgagaaggaagaacccaagaggaatacttatttctccaggacctggtgaaccacaagattcgggaatatcattgcagactgttcttgaattangcccaaccatcccaatttttggagtttgcatgggtctgcaatgcattggagaagcatttgggaggaaagatatccgtgctcctttctggagtgatgcatgggaaaagctctcccagttattacgatgaaggattaggaaagggcattgttcatggcttgccaaacccttttacggctgcgaggtaccacagcttggtcattgac

SEQ ID NO: 77129 - protein, 190 aa, Zea mays
  misc_feature: Ceres CLONE 1562005
  misc_feature (82)..(191): Pfam Name: GATase Pfam Description: Glutamine amidotransferase class-I
  misc_feature: SWISSPROT Homolog: EC 4.1.3.27 Anthranilate synthase
  misc_feature (149)..(149): Xaa is any aa, unknown, or other
MACSHIAAAGVSSPAAAAARSPAHSPAAAFARLRSTPRFASAGLSVKGNGAAFPLVAAAGPAAAAPVADLDGRPATEKQPIIVIDNYDSFTYNLCQYMGELGLNFEVYRNDELTIEDVRRKNPRGILISPGPGEPQDSGISLQTVLELXPTIPIFGVCMGLQCIGEAFGRKDIRAPFWSDAWEKLSQLLR

SEQ ID NO: 77130 - DNA, 876 bp, Zea mays
  misc_feature: Ceres CLONE 1562009
ccccgcggtggcggccgctctagaactagtggatcccccgggctgcaggaattcgtctcacccctagaaaaagtcagacacgtgtttctgttaattcgtctcgttttctcccttcccctgcgggctggagagcggcggcgaacgagacaaggtcaccggtgacgctcctcacctactccctgccgcctttcgctttccggcccggcctgccgcaagctcgcgcgccgcctacatcgacccctccccgcgccgcaggccgcctcccacagacgcggggcagccacgtcgcccggctcggagggattcggttcggcccgtcgtgctcccctccgcactcttctattggcctggagagcagcggagatccaccagcaatttggattgctttctccttttttcttgatataactgggtctccctcgggtgttggctaggccatccagcttttccaaagtgtgattcggacaagttttattttggcctcttgagatggctgatgaaggactcattcgactttcaccttctggaagggttagttcttgccgaaaaaaaacggtcaaacccgaatctccctaaagccattcccttttggcaaggaatgacccctccaagggaattttcctgttttaaaaaggccaaaactttcaaaaaaaaatggggcttaaaaactgtttgatttccaaaaaaaaaaagggtttgggaaaacaaaaggttccggtgtttcccccaaaaaacgataaacattttaaaagcccccccttttccccccccaaaacggggggggggggagacaaaaaatacaaaatgggtcccctttttagggggggtaaaaagtttttttttcccaaaaaaaaactccccccccccaggggggac

SEQ ID NO: 77131 - DNA, 923 bp, Zea mays
  misc_feature: Ceres CLONE 1562010
  misc_feature: SWISSPROT Homolog: EC 1.6.5.5 NADPH:quinone reductase
  misc_feature (843)..(843): n is a, c, t, g, unknown, or other
  misc_feature (898)..(898): n is a, c, t, g, unknown, or other
acccgcggtggcggccgctctagaactagtggatcccccgggctgcaggaattcgtctcacccctagaaaaaaattacagcagctgctggtggaacaggacagttcgcagttcagctggcgaaattagcaggcaacaaggttgttgccacatgtggaggtgaaagtaaagctgaacttctggcttccttaagagttgatcgtgttatcaattacagaaatgaacgagtcaaagatgttctgaagaaagagtttccaagaggtgtagatatcatatatgaatctgtaggtggggaaatgtttgacttgtgcttgaatgcacttgcagtccatgggcatctcattgtaattggtatgatctcccagtatcaaggagaggatggctggaagccaaagaactacactggactatgtgagaagattctagctaaaagtcaaactgtggctggatttttccttgttcaatatgctcacttgtggcaagatcatcttaacaaacttttcgacctgtatgcctctggaaagctaaaggtttccctagaccccaagcaattcttgggtgttgcttcagtcgtagatgcggtcgaatatcttcattctggcaagagtgttggcaaggtagttgtgtgtattgatccatcatacggtcagatcgttgcaaaattataatccatggacatgatgcgcattatcttccatggtcacgtaggttactgtcttatagttaccacacatatacatcaagaccgtattttcccagcgggtgacaaatgaataaggaacatgttggtgtatagtttagtttcatttttccgaagtggaagagcacaactatactgaagggncagcatgggcatggaaatcgattaagttctaatccgtgcagtaggatatgcatcntgtggcctccttccccgttttgggt

SEQ ID NO: 77132 - DNA, 844 bp, Zea mays
  misc_feature: Ceres CLONE 1562012
  misc_feature: Encodes the peptide sequence at SEQ ID NO. 77133
  misc_feature (403)..(403): n is a, c, t, g, unknown, or other
  misc_feature (465)..(465): n is a, c, t, g, unknown, or other
  misc_feature (490)..(490): n is a, c, t, g, unknown, or other
ctggagctccccgcggtggcggccgctctagaactagtggatcccccgggctgcaggaattcgtctcacccctagaaaaaatcgtctgcaactgcatcgctcgctctctcctttcactgggaacatctatcagctcgcgctcattggccatctttggcttccatggagaggctcattgccggcctacttggcttcctattggttgcatcggtaggaagccatgcagctcgtgctccggatcagtactggaagtctgctcttcccaacactcccatgccgacctccctctcccaactcctcgacgccgctccagccggcggcggcacgaccgtcaacgtcggctggggcggtgttcacgtcgatgctgggcacggtaagcccgggggtacgacggttgacgtangcaagggcggcgtctgcgtcaacgttaaccctggcaggagcggcaagcccggcggcacgacngttgggcgtcggaagggcggagtcngcgttaacgtcaacccgggatacggaaagcccggcgggcacaccggttggcgtcggaaagggtgggcgttggcgttaacgtcaaccccgggcaggcccggtgggccaacgggtcggcgttcgcaaagggccgaaatgggcttcaaggttaatcccggaaaaccgggccgggggggcccgtaacaaccctttggcttttgcaaaagccccttgggcttggggcttaaatcccgggcaccgaaaagccggggggacccccctttcggttttgaaaaaggggggggtttggcttttcccttaaaccgcgaaaaaaaaccccccccacaaaaaaactcccccctttatatataaaaaa

SEQ ID NO: 77133 - protein, 169 aa, Zea mays
  misc_feature: Ceres CLONE 1562012
  misc_feature (81)..(81): Xaa is any aa, unknown, or other
  misc_feature (110)..(110): Xaa is any aa, unknown, or other
MERLIAGLLGFLLVASVGSHAARAPDQYWKSALPNTPMPTSLSQLLDAAPAGGGTTVNVGWGGVHVDAGHGKPGGTTVDVXKGGVCVNVNPGRSGKPGGTTVGRRKGGVXVNVNPGYGKPGGHTGWRRKGWALALTSTPGRPGGPTGRRSQRAEMGFKVNPGKPGRGGP

SEQ ID NO: 77134 - DNA, 779 bp, Zea mays
  misc_feature: Ceres CLONE 1562013
  misc_feature: Encodes the peptide sequence at SEQ ID NO. 77135
  misc_feature (743)..(743): n is a, c, t, g, unknown, or other
ctccccgcggtggcggccgctctagaactagtggatcccccgggctgcaggaattcgtctcacccctagaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtccgcaacatcgcctccatggtcccaccctacgacaagatcaagtacgccggcaccgggtccgccatcgagtacgccgtgtgcgcgctcaaggtgcaggtcatcgtggtcattggccacagctgctgcggtggcatcagggcgctcctctccctcaaggacggcgcgcccgacaacttccacttcgtggaggactgggtcaggatcggcagccctgccaagaacaaggtgaagaaagagcacgcatcggtgccgttcgatgaccagtgctccatcctggaagagaggccgtgaacgtgtcgcntcagaacctcaagagctaccccttcgtcaaggaagt

SEQ ID NO: 77135 - protein, 160 aa, Zea mays
  misc_feature: Ceres CLONE 1562013
  misc_feature (31)..(161): Pfam Name: Pro_CA Pfam Description: Carbonic anhydrase
  misc_feature: SWISSPROT Homolog: EC 4.2.1.1 Carbonate dehydratase
MDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFHFVEDWVRIGSPAKNKVKKEHASVPFDDQCSILEERP

SEQ ID NO: 77136 - DNA, 958 bp, Zea mays
  misc_feature: Ceres CLONE 1562014
  misc_feature: Encodes the peptide sequence at SEQ ID NO. 77137
ctccccgcggtggcggccgctctagaactagtggatcccccgggctgcaggaattcgtctcacccctagaaaaatagaaaaaatcacggcacttccactggagggccacacttctcttttgaggaccagtccaccggccactcccagagtccaaaaccctacgatccgcgccaccatgccgcgcctcgccggcgccgccgccgccgtctcacgccgcgccggcgaggccctgcgccgcggcgcgtttgggggactgcggcctctctcctccctgcaaccgttaaacgccgcctccagcgacgaggtgctcgttgaaggaaagacaagtgcgcgcgctgccgtgctcaaccgacctgggtacctccacgccctcaccaccaccatgggagctaggctcaataaattttatcaatcatgggaggacaacccacacattggctttgtcatgatgaacggcagcggccgagcattctgtgctggtggggatgttgttagattacatgaacttatcactgaaggcaagctggatgaatgaaaggattctttcaagactttgtacatgttcatttattctctgggcacatacttgagaccacatgttgccattcttgatggcattactatgggtggtgcgtgcatgtgtttccatccctgtgacagtccgtgttgcaactgatacgacagactctgcaactccagaagttcatattgaattccttcgtgatgccgacgactccctagacttggcgcatctaacggggcatgacggggaatatgtgggccttgaccggtgaaaaacgtaacggcaacataattgatggcccctgggcccggctaaggacctatttcatgagttggcccttgaggatttggttcgatcgaacgaacttgcaaaggtagggaccggaggcaccaaccggttgttcgcagtgcacccaatgcccaacagtggaaggaa

SEQ ID NO: 77137 - protein, 119 aa, Zea mays
  misc_feature: Ceres CLONE 1562014
  misc_feature: SWISSPROT Homolog: EC 3.1.2.4 3-hydroxyisobutyryl-CoA hydrolase
MPRLAGAAAAVSRRAGEALRRGAFGGLRPLSSLQPLNAASSDEVLVEGKTSARAAVLNRPGYLHALTTTMGARLNKFYQSWEDNPHIGFVMMNGSGRAFCAGGDVVRLHELITEGKLDE

SEQ ID NO: 77138 - DNA, 725 bp, Zea mays
  misc_feature: Ceres CLONE 1562015
  misc_feature: Encodes the peptide sequence at SEQ ID NO. 77139
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnaaaaagctggagctccccgcggtggcggccgctctagaactagtggatcccccgggctgcaggaattcgtctcacccctagaaaaaaaagctcacagcaaaataaaagccaggcggcggcatatggcgctcagcaaggagcaaaaactcacaattcctgatcaacaacacacaacaagcagcgaacagcaggtggcgctggatgccgagctccagctgtggaaccacactttcggctacgtcaagtccatggcgctcaaggccgcgctcgacctcggcataccccgaatgccatccacccagcacgggcgggctccggcccacccatccccaccagaataagtcacccagggaattcacggcttcccacccccgttcccaaagaacaacccaatggccctggccgggcgccccttccaatggcgcgccgggggttttaacccccttttaaacccggggggggtttcttttttcgggggcaaccccccaagggaaaaaccccccccccccacaaaaaaaaaaacccggggggggggccccggcccttttttttttaaaaaaaaaaccaaaaaagaccccccccggtgtataaaaaaaaaaagaggggttttttaaaaaaaccccccggggggggggggtttttttcccccc

SEQ ID NO: 77139 - protein, 72 aa, Zea mays
  misc_feature: Ceres CLONE 1562015
  misc_feature: SWISSPROT Homolog: EC 2.1.1.146 (Iso)eugenol O-methyltransferase
MALSKEQKLTIPDQQHTTSSEQQVALDAELQLWNHTFGYVKSMALKAALDLGIPRMPSTQHGRAPAHPSPPE

SEQ ID NO: 77140 - DNA, 850 bp, Zea mays
  misc_feature: Ceres CLONE 1562017
ctccccgcggtggcggccgctctagaactagtggatcccccgggctgcaggaattcgtctcacccctagaaaaaattgtcaggtggggagtttggctgaggcagcccaactctgaagttatgttttcctagactgcccatgttccgaggattagcatcagcattctagctacaaacatttcagatatctttcttgtaagggcaaacattatggcatacctagattcacttttcctgcttgtaattttgatcttcattttgaagtaataagtacttgagttaaggggacatttcttgtggaaaaaatgacgggaaatagctggacgttcctctaaactaaaaaaataaagaaaaaaaaaaaaaaaaaagaaagaaaaaaagaaaaaaactcaaaaaaagagcaaaaaaaaaaaaaaagggaaaaaaaaaaaatttttcccctctcgggttcccaaaaaaaacaaccttggagggcctttttattttgaaaaaaaaaaaaccactttttgggggccccaaaaaccattggggggcacacccccctcttttttccccacttggtccccaaaaatagggggggggttttaaatacgggaaggctggggaaaaaaatcacaacaaaaaatgttggaaaaaaatttcccactctattctggaagggaaacccacccttaaatatttgtttggggggcccccccttccctcccggggaaaaaaggggggaaaaaattccttttaagaagaccccaatgttgtcccccaaaaaatcccccaaaacccgggcccggggtaccccggggtttgggggcccaaatttttggggtttaaaaacaccccccgaaggctttaaa

SEQ ID NO: 77141 - DNA, 1011 bp, Zea mays
  misc_feature: Ceres CLONE 1562019
  misc_feature: Encodes the peptide sequence at SEQ ID NO. 77142
  misc_feature (404)..(404): n is a, c, t, g, unknown, or other
ctcaccgcggtggcggccgctctagaactagtggatcccccgggctgcaggaattcgtctcacccctagaaaaactctcacttctgtacccaaccagaagagcggcggcgcgggcggacaaggagcaggcggaggaggagttgtgccaagccacaatgggtatctcgcgtgactcgatgcacaagcgccgagccaccggtggaaagcacaatgcctggaggaagaagcgaaagtatgagcttggtcgccagccagccaacaccaagttgtcaagcaataagacagtgaggagggtccgtgttcatggaggtaatgtgaaatggagggctcttcgccttgatactggtaactactcatggggaagtggagctgttacccgcaagaaccgtatgggccaccccccnccacaatgcattaaaacaatgagcttggtgaggaacccaaccccttgtgaagaagtgcccattgtgccagtttaaaggctggccccctttcaggccagtgggtaccctcccttcccttatggaggtttgacctttggtttgggaaaaaagagaaaaccccccttgcttgcaaaaaaaagggatatatggttttaaggggaacaaataaggggttttaagggccaccccaccctcttaggggaaaaccctaaaaaaagaaacccccacgccctgggtttctccgcagagaaaaacctttcttgaaaaaaagcgcccaagggggaagggggacactttcccccctttgtgccccctcccacctttttggggggagaacaatttttgtgcacactcggaaccgggtttctactgggctattacattttctttttcccccccccttgggaaaatgatggggcgccaaaactccagatgggggcctctccccttggggggtgaaaaagacttggtgtttctccccttgaaaaaactttctcaagaaaaagaggccaaaaactcgtttcttctttaaagactcctgcggaggatggcccccgccccaaaagtt

SEQ ID NO: 77142 - protein, 107 aa, Zea mays
  misc_feature: Ceres CLONE 1562019
  misc_feature (1)..(107): Pfam Name: Ribosomal_S8e Pfam Description: Ribosomal protein S8e
MGISRDSMHKRRATGGKHNAWRKKRKYELGRQPANTKLSSNKTVRRVRVHGGNVKWRALRLDTGNYSWGSGAVTRKNRMGHPPPQCIKTMSLVRNPTPCEEVPIVPV

SEQ ID NO: 77143 - DNA, 851 bp, Zea mays
  misc_feature: Ceres CLONE 1562020
  misc_feature: Encodes the peptide sequence at SEQ ID NO. 77144
  misc_feature (711)..(711): n is a, c, t, g, unknown, or other
  misc_feature (765)..(765): n is a, c, t, g, unknown, or other
  misc_feature (781)..(781): n is a, c, t, g, unknown, or other
catagctggagctccccgcggtggcggccgctctagaactagtggatcccccgggctgcaggaattcgtctcacccctagaaaaagccctaaactcacaagcccgtcacagaccgacaacgcctaggcaagcagcaagcgtacacgtaaacgtacacctacctcggcgagcaaaaggcaaaacgctgatcggagcaaccaacgaagcccgcagccatgccgacggccacggccacggcggctcctcgccacgccgcgctcttcctgctgctgctgctcggcctccacgccacgttcgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcgccggcgggtggggcggcggctacggcgggcccgccggcgggtacgcccgcggcggcgtggtggcgcccaccgtgacgtgctccgagaaggggccctgctacaggaagaaggtcacctgccccaagaagtgcttctcctcgtacagcggcgccggcaagggatacggcggcggcggcggcggcggcagctgcaccgtcgactgcaaggtcaagtgcacggcctactgttgattcgactcgtccngctcttagcggtttgacagctagtgggctggcggtggcggcctgctagctgctngttggtggtgatggcncgtgttgcgtgtccggtgagctgagttaccggcggtgggtttaactttgtgttatccatcccaataagtt

SEQ ID NO: 77144 - protein, 160 aa, Zea mays
  misc_feature: Ceres CLONE 1562020
  misc_feature (13)..(148): Pfam Name: GRP Pfam Description: Glycine rich protein family
MPTATATAAPRHAALFLLLLLGLHATFAAAARAGVAVDAELTSTKPSPVPKKPSVKPPGPGAASPTFPGFGIPGMGGFGIPGMGAGGWGGGYGGPAGGYARGGVVAPTVTCSEKGPCYRKKVTCPKKCFSSYSGAGKGYGGGGGGGSCTVDCKVKCTAYC

SEQ ID NO: 77145 - DNA, 840 bp, Zea mays
  misc_feature: Ceres CLONE 1562021
  misc_feature: Encodes the peptide sequence at SEQ ID NO. 77146
  misc_feature (38)..(38): n is a, c, t, g, unknown, or other
ctccccgcggtgggcggccgctctagaactagtggatnccagaggctgcaggaattcgtctcacccctagattatagccaagctagcaactctctcgagtcgattcctaagcagctagccagtgactcgatcttagcgtgctacaatggcggcagctgctagtgccctgctcctcctgctctgctcagccttctgctcccttgcccaccgggcggccggcgtcgactacggctcgtggcagagcgcccacgccacgttctacggcggcggcgacgcgtctggcacgatgggcggcgcgtgcggctacgggaacatgtacagcacggggtacggcaccaacacggcggcgctgagcacggcgctgttcaacgacggcgccgcgtgcgggtcctgctacgaactgcgctgcgacaacaacaggcagccgtgcctgccgggcaccatcaccgtcacggccaccaacttctgcccgcccaactacggccccccccaccaacaacggcgggtggggcaaaccagccggcaccccgcccttcaacatagccccaaccgggccttcccccaaaaccaccaccaaaaacccaaaccggaagcaggcccccaccccccacaagaaagctgcccgggggtgaacaaaagggggggaacaggggggacaaaccagggggaaacaccaaacctaaaacccgggccgagacaaccaaacgaagccggcgcccggagaacaggagccaaccggggccattaaggggccccccccaccgagtgggaaacccccctatcccgggaccccgggcccggaaccctgcagaaggctcttctctttcctgttttgttttt

SEQ ID NO: 77146 - protein, 200 aa, Zea mays
  misc_feature: Ceres CLONE 1562021
  misc_feature (66)..(126): Pfam Name: DPBB_1 Pfam Description: Rare lipoprotein A (RlpA)-like double-psi beta-barrel
MAAAASALLLLLCSAFCSLAHRAAGVDYGSWQSAHATFYGGGDASGTMGGACGYGNMYSTGYGTNTAALSTALFNDGAACGSCYELRCDNNRQPCLPGTITVTATNFCPPNYGPPHQQRRVGQTSRHPALQHSPNRAFPQNHHQKPKPEAGPHPPQESCPGVNKRGGTGGTNQGETPNLKPGPRQPNEAGARRTGANRGH

SEQ ID NO: 77147 - DNA, 843 bp, Zea mays
  misc_feature: Ceres CLONE 1562023
  misc_feature: Translation starting site: 176
  misc_feature (491)..(491): n is a, c, t, g, unknown, or other
ctggagctccccgcggtggcggccgctctagaactagtggatcccccgggctgcaggaattcgtctcacccctagaaaaagttgttcaacgaaccaaccagcctagcgacgccgacgccgccacgtcccaacgaaaaagaaacaaaaaagaagaagaggacagactgccagagtcatggcggccacgagctccgcctgcgcgtgcgcggcggtagcgctcgcgtccttcccgtccgccgcctccacctccgccccttcccgcgtctcggccagcagccaccgcggtcagcggcactccagggccgccaccgtcagatgttccagcacgtcgcccaacgtgtcccagggcgcgccggcgccggcgccgcccaagccgcaaatcgagctcgagttcgtcgggccgaagcccggtgccgacggctccttcccggtggaccgggcggaggcgaccagcggcgagaagctcctccgtgacgtcatgaacgagaacnagatcgagctctacgccgcatacggcaaggtgatgaaactgcgtggcggcggaaagtgcggcacttgcatcgtcgagatatcgatggaaagagctcctgaatgagaggacgaacaccgagaatcggtacctgagagagaaaccagactcctggaggctagctttgccgaactattggaggccaacaagaaaaactcgtggcaaggttgggggtcaaacggctgcccttaatgggaaaaaaataacccgggccatggcaccccccccttgggggggaagaaaaccaaactcccccggtgtgaagttcaccaaaaaaccctttgtcccctggggcttttaaaaaaaagaacaaa

SEQ ID NO: 77148 - DNA, 785 bp, Zea mays
  misc_feature: Ceres CLONE 1562024
  misc_feature: Encodes the peptide sequence at SEQ ID NO. 77149
  misc_feature (579)..(579): n is a, c, t, g, unknown, or other
ctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaagccgtgtggttcaaggccgggtcgcagatcttcagcgaagggtgggctggactacctcggcnacccgagcctgatccacgcgcagagcatcctcgccatctgggccctgccaggtcgtgctcattgggccccatcgaggggggtaaccgcgtcccccgggcggcccccctccgggaaaaggggtgggtaaaaaccccgtttttaccccccccgggggggaggggttttaaaccccccccttgtggtccctcccccccaaaaaaaaaaa

SEQ ID NO: 77149 - protein, 216 aa, Zea mays
  misc_feature: Ceres CLONE 1562024
  misc_feature (64)..(172): Pfam Name: Chloroa_b-bind Pfam Description: Chlorophyll A-B binding protein
  misc_feature (148)..(148): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGWAGLPRXPEPDPRAEHPRHLGPARSCSLGPIEGGNRVPRAAPLREKGWVKTPFLPPPGGRGFKPPPCGPSPPKKK

SEQ ID NO: 77150 - DNA, 951 bp, Zea mays
  misc_feature: Ceres CLONE 1562027
  misc_feature: Encodes the peptide sequence at SEQ ID NO. 77151
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
ctccccgcggtggcggccgctctagaactagtggatcccccgggctgcaggaattcgtctcacccctagaaaaatagcggccgtcaggaaccccagcaagcaacccagccgcccattgccggcattgctcgcagcgctagcttcttgcgctcatcagtcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcctccgcccccttcccccaaatggaagcagcacaggctgccgcccaccccctccgggggagctcctcatcatcgggggaacttccacctcatcggggtcccacccgccaagttttcctttccgcgaaacttccaggccaaagtacgggccacaaacggggcttaatgcttggtggcaagggtcggcgcccgtggccccaccaaatccgtgggtgttccaccacccccaagggccccccccaagggccctggctcccccaaaccacccaaacaccagtgggctgggggggggctccccccccccgggaaaaacccccccccccacaaaaaaaatctgccgtgtataaaaattcaagggggaagggggggccctctcccgccccctaaacagggagaaaaacaggaatttcgcccccccggccccaaaaagggaggggtgcaaaaaacccaccttggcttttaagcccaaaaaagggtttgtttcccaacaaccgcgggggagacccggggaaaaaaagagaaggaggggggcccctcctggggggggggcccccaaaataatannnnnnnatttttatatcctccccctcccccacccgaggggttttggccccggggggagcgccggggggggaaaa

SEQ ID NO: 77151 - protein, 73 aa, Zea mays
  misc_feature: Ceres CLONE 1562027
MLGGKGRRPWPHQIRGCSTTPKGPPQGPWLPQTTQTPVGWGGAPPPREKPPPPQKKSAVYKNSRGKGGPSPAP

SEQ ID NO: 77152 - DNA, 838 bp, Zea mays
  misc_feature: Ceres CLONE 1562030
  misc_feature: Encodes the peptide sequence at SEQ ID NO. 77153
  misc_feature (408)..(408): n is a, c, t, g, unknown, or other
  misc_feature (436)..(436): n is a, c, t, g, unknown, or other
  misc_feature (600)..(600): n is a, c, t, g, unknown, or other
ctccccgcggtggcggccgctctagaactagtggatcccccgggctgcaggaattcgtctcacccctagaaaaaggtcagcctcagccaccgaccgttgcaccagctcgcatggcgctccacgccgtctcccccgcggcggtctcctccccgctgcgcgccctctcgcgcagattcccccagcgctcaggctgtggttgtttaccaaagcagtccgtcacaatttgctcctctacgaactttgcaagaaaacttcaggatggaccagtggacttcgctgccaggcgactggttcttggacactcggacaagagagcagttttgacgcatgccactattgaagaaatcgaagcggagaaatccctcatcgaagaaccagctaaagaaaagatggaggaagcgatcgaancagtccaaactaacttcaacactgtganggacagggcgtgcaagccccggcatgctttgaccggatccgaggtcgagtactacgggaacttcagtggactttgaagagcattgcacagattagcactcccagatgcaactttctcttcttattcaacccatatgataaagtcaggccttcagcttaatgagnaaaactatagtggcggcaaaaatcttggtggtgacccaagcattggaccgagaaaatgataaccagtgacctggtcccaccgctttacatctggatccccagaaggaattagccaaaaacggtggctaaatttgctaaaaaatggcaaggtttgctatagggaacttaaaaaagatggccatccaagcttccgtaaccttccgaagggaagaacctttctttaaaacaatgtgaaaaa

SEQ ID NO: 77153 - protein, 133 aa, Zea mays
  misc_feature: Ceres CLONE 1562030
  misc_feature (100)..(100): Xaa is any aa, unknown, or other
  misc_feature (109)..(109): Xaa is any aa, unknown, or other
MALHAVSPAAVSSPLRALSRRFPQRSGCGCLPKQSVTICSSTNFARKLQDGPVDFAARRLVLGHSDKRAVLTHATIEEIEAEKSLIEEPAKEKMEEAIEXVQTNFNTVXDRACKPRHALTGSEVEYYGNFSGL

SEQ ID NO: 77154 - DNA, 756 bp, Zea mays
  misc_feature: Ceres CLONE 1562037
  misc_feature: Encodes the peptide sequence at SEQ ID NO. 77155
  misc_feature (583)..(583): n is a, c, t, g, unknown, or other
ctccccgcggtggcggccgctctagaactagtggatcccccgggctgcaggaattcgtctcacccctagaaaaaagaccgcaccgcggccacagcctcgcgtcgtcgccccacagccacgcgagccttcgccgatccgcgagcgcagatcgccgaagccaggcggcggagagggagctcgaggcggcggaggaaggcgttcgccacagtcgctgatttccctggggaagagatggggctctcctttggtaagctgttcagccgcctcttcgccaagaaggagatgaggattctcatggtcgggctcgatgccgccggtaagaccaccatcctctacaagctcaagctcggcgagatcgtcaccaccatccccactatcggattcaatgttgaaactgttgagtataagaacattagcttcactgtttgggatgttggtggccaggacaagatcaggcccctgtggaggcactactttcagaacacacagggacttatttttgttgtagacagcaacgacagggaacgtgttgttgaggctagagatgagctccacaggatgctgaatgaggatgagctgcgtngacgctgtgctgcttgtatttgcaaacaaacaagatcttcccaatgctatgaatgctgctgaaattactgacaagcttggtctgcattccctgcgacagcggcactggtacatcccagagcacttgtgctacatctgggtgaaggggttgtatgaaggggcttgaactggctt

SEQ ID NO: 77155 - protein, 137 aa, Zea mays
  misc_feature: Ceres CLONE 1562037
  misc_feature (1)..(133): Pfam Name: Arf Pfam Description: ADP-ribosylation factor family
  misc_feature (118)..(118): Xaa is any aa, unknown, or other
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRXRCAACICKQTRSSQCYECC

SEQ ID NO: 77156 - DNA, 957 bp, Zea mays
  misc_feature: Ceres CLONE 1562038
  misc_feature: Encodes the peptide sequence at SEQ ID NO. 77157
ctggagctcaccgcggtggcggccgctctagaactagtggatcccccgggctgcaggaattcgtctcacccctagaaaaactcgcgttccatttgcttcggctcatctcagatcaagctagcgcacctgacacccaccacctccctcccagatccaccaccccagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgccccactccaacggcgacctccacgacgaccctttcgccgcacctgctgactccaacggtgggcccatccttccgccgcccacccagatgggccggcgaggaggggattcctgctcccgcgagtgggggcccgaaaaaatgctttttcacccttggaggaaaaaaggaaaagaagggagaaaggaagccttagggaacccacaatcaatccttttgaaggcctgaaagaaagtttaaaaaaaaaggcttttttggtttgaaaaaaaaaaaaaaagactttcaaatggccttagaaaaaacaaagccaaaggggggccacaaaaaaccccgtgggaacaagggggaaaaaaagcttttttttcctctaggccaaaaaccacggggaaaaaaaggtttccccttggccggggggggcacaaaaaaaaaccacaaacatggggaaaagggcggaaatattttgaaaactttatcccccacctaggaaatattgccccacacacatcccaaaaaaaaaagaggggccacgggaaaaacacaaggggaaataaaacccccggggaatccgggggggataccagggaaccacaaatcctgggggaaaccacaggaaacgtggctggaatgggggaaaataatggct

SEQ ID NO: 77157 - protein, 124 aa, Zea mays
  misc_feature: Ceres CLONE 1562038
MATAFDSPTSSPAAAPFHDDPFLHFDGSAPAAADGFPASPDAYAPSPFGMPHSNGDLHDDPFAAPADSNGGPILPPPTQMGRRGGDSCSREWGPEKMLFHPWRKKGKEGRKEALGNPQSILLKA

SEQ ID NO: 77158 - DNA, 585 bp, Zea mays
  misc_feature: Ceres CLONE 1562041
  misc_feature (156)..(156): n is a, c, t, g, unknown, or other
  misc_feature (174)..(174): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (539)..(539): n is a, c, t, g, unknown, or other
ggagctccccgcggtggcggccgctctagaactagtggatcccccgggctgcaggaattcgtctcacccctagaaaaagtttacgacaagaaccttgctgagttctgttggagtctctcaaagcaaggcaataccaggtgccattgctatcaactnggatcctcaaggatggtngctgggccgtgttggaaaaaaaatgcttttttttgcccctcaaagggaaaaaaaaaatttttgagnnnnaaaaatgacccaaaacaatgcggttttcaggatccctttgaaaaagggacgggaaaaaaaaaaacgcggatcccccctttttttccccaaggcggggggccaaattttaaaaaaaacccccggtttttaagaaaatttaaccccccctttttttttaggggcctctgtggggaaaaaaaatttttttttttttcctcttaaagaaaatttttggggaaaaaaaaaaaaaattggggggggggggggggggggtttttttcccaaaaaaaaaaaaaacccccccgtggggggggggncccccccccccccctcccagggggggggaccccccccccaaaaaat

SEQ ID NO: 77159 - DNA, 796 bp, Zea mays
  misc_feature: Ceres CLONE 1562042
  misc_feature: SWISSPROT Homolog: EC 2.5.1.6 Methionine adenosyltransferase
ctccccgcggtggcggccgctctagaactagtggatcccccgggctgcaggaattcgtctcacccctagaaaaagtgcgctgcggacgggtcggatctgagtacgagacgatccccccctcccatcatccggaaattgttttaccccatctcatcacactgactccacccacaccgcactcccgctgcctccggcagatctcctccgactccgatcatccccaccacgaacacaccgcgctctcccctcgcaagctgttcagactccactacatcgccagactataaacattcctcttctcctcctagtccccgaacgaaagaccccctgactatatctgctcaccactctctcaaatgctgttctcgaccctcgccttgctaatcaccgtgacaactggggagcttgcgaaacctgcacccacaccaacatgatgcaggggctctggagagatcaccgcccctgccgatgtcctccactacaaatcgcaagggatacatgccgcatcattactctcctgacgaacaacgtgctgctagactctgaccacatgctccgcgcttgctaaatgaggacgacctgcccctaacattgctcacggtgtgctcagacacttcacatactccccctgcgagataggcacctgagacactgacacatgtgtgctgatgccactgacgagacggctgaggtgatgcccatcacctgtgctcgctgcgagaatggtgctcgacgcgactagactggctatcatggacctcgccaccgagtcatgaaccatgtgcagacgatccta

SEQ ID NO: 77160 - DNA, 812 bp, Zea mays
  misc_feature: Ceres CLONE 1562044
  misc_feature: Encodes the peptide sequence at SEQ ID NO. 77161
  misc_feature (397)..(397): n is a, c, t, g, unknown, or other
tcccgcggtggcggccgctctagaactagtggatcccccgggctgcaggaattcgtctcacccctagaaaaaacatctcatcttcgtctgtgttcttgggcgtacgcggacacagccccgatccgaatcgtcctcctcgcgagcctcgtcgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggccgcacacttgctgactacaacatccagaaggagtcaacccttcatttggtgctgcccntaggggaggcatgcggatctttgtcaagaccttgactgggcagacaatcccccttgaggtggagtctttcagacacctttgataatgttcaggctaagaatccaggacagggaagggatcccctcctgaccaggagcggggtttattttcccgggcaagcaacttttaggacgggacccccccctgtcgtaactccaaactcccgaagggggcaaccccccccccttgggggcgggccccttagggggaggggtggcaaaattttttttaagaacctttatgggggaaagaaaaacccccctgtggagggggggcccccccaacacccctttttaaaatgttctggggcaaaaaattcccggaaagagggggggggtttccccctctgggaaagggaaaaggttttttttttttt

SEQ ID NO: 77161 - protein, 83 aa, Zea mays
  misc_feature: Ceres CLONE 1562044
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (73)..(73): Xaa is any aa, unknown, or other
MQIFVKTLTGKTITLEVESSDTIDNVKAKIQDKEGIPPDQQRLIFAGKQLEDGRTLADYNIQKESTLHLVLPXGEACGSLSRP

SEQ ID NO: 77162 - DNA, 833 bp, Zea mays
  misc_feature: Ceres CLONE 1562048
  misc_feature (224)..(224): n is a, c, t, g, unknown, or other
  misc_feature (232)..(232): n is a, c, t, g, unknown, or other
  misc_feature (422)..(422): n is a, c, t, g, unknown, or other
ctccccgcggtggcggccgctctagaactagtggatcccccgggctgcaggaattcgtctcacccctagaaaaagtacagaacacttcacttcctggcaaggctggaacacaaagaaccctaaacactagcaatggcgggcggcaaacctgctgtcgcgctcccttctccccaccataacatgtgaagttgagctatatgaattgctgctaatataaaactttngcacacanattggttcaaaagggtaaaggttaaaagtgccagtttttttaaattgaacccatgaatgactaaacctttgtccccacacaggggaatccttaaaaccacccttttttttcccccccgatagacttgggaaattttggtttttaaaaaaagtggtaaaaacacaccacccctttttagtgtttttttggncccccacaaaaaaaaaaaaaacgcgttctttaggagtgatatacaccaaatataagtaaatataaatttttgagagtttttttttttttttcccgcccaaaaaaaaaaaaagaaaaatgcagaatgtatttttttttggtaattctacatcacttcttattgtatattacggatcctctaataaatagtataattacttctgacgtagtatggtatgtttataacaattaatgtttgcggtctatcatataacaatgacattcactctcatttaagtcatggagggactgttgtcggtggttataataaaacattaaatctgtggcaccactgtctcatcactgatcagatcacgtgtcatattaaactgccttctttctctatattgtgatatctacgttatagagtaaa

SEQ ID NO: 77163 - DNA, 889 bp, Zea mays
  misc_feature: Ceres CLONE 1562049
  misc_feature: Encodes the peptide sequence at SEQ ID NO. 77164
ggagctccccgcggtggcggccgctctagaactagtggatcccccgggctgcaggaattcgtctcacccctagaaaaaaccccgaccgactgctccccctccccgcaccagcctcaagccctcaaggcatcgccggcgccgcaacttcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatgatccttgggccggcgcagtcgccctatgaaggtggagtttttaagcttgaactctttttacctgaggaatatccaatggctgccccaaaggttaggttcctgacaaagatttatcatcccaacatcgacaagcttggtaggatatgcctcgacattctcaaggacaaatggagcccagcacttcagattcgaacagttcttttgagtatacaggccctactgagtgcgccaaatccagatgaccctctttcggataacattgcaaagcactggaaagccaatgaggtagaagctgttgaaacagctaaggagtggactcgcctgtatgcgagcggtgcatgagaacgcagtgatgttcttgatgtaataacccatcatacttcagtcctcatctattgccatttgcttgataaaaaaaggctggagatatttgccctggaatgaagtctctacatgactatccactctgaatggtttgggttgtacacctgttggtcggttcccttttacttgggggaccctttgacaatcagtatgggagaacttgctgaaactggaataaattggttacctccaggaaaaaaaaaaa

SEQ ID NO: 77164 - protein, 153 aa, Zea mays; identical to SEQ ID NO: 73172
  misc_feature: Ceres CLONE 1562049
  misc_feature (9)..(146): Pfam Name: UQ_con Pfam Description: Ubiquitin-conjugating enzyme
  misc_feature: SWISSPROT Homolog: EC 6.3.2.19 Ubiquitin--protein ligase

SEQ ID NO: 77165 - DNA, 779 bp, Zea mays
  misc_feature: Ceres CLONE 1562054
  misc_feature: Encodes the peptide sequence at SEQ ID NO. 77166
ctcaccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacagctgggacaccgccgggctgtccgccgaccccgagaccttcgccaagaaccgcgagctggaggtgatccactcccgctgggccatgctcagcgcgctcggctgcgtcttccccgagctgctctcccgcaacggcgtcaagttcggcgaagccgtctggttcaagccggctcccagatcttcagcgagggcgggctggactacctcggccaacccagcctgatccacgcgcagagcatcctccgcatctgggcctgccaggtcgtgctcatggggtgccgtccagggctaccgcattggccgcgggccgcttccggaaagtcctcgaccccccggtaccctgggggggagctttcaacccctcgggctgggccaaatacccccaaagccctttcccgaaacccaaggggaaagaacctcaagaaccggccc

SEQ ID NO: 77166 - protein, 147 aa, Zea mays
  misc_feature: Ceres CLONE 1562054
  misc_feature (61)..(145): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYSWDTAGLSADPETFAKNRELEVIHSRWAMLSALGCVFPELLSRNGVKFGEAVWFKPAPRSSARAGWTTSANPA

SEQ ID NO: 77167 - DNA, 980 bp, Zea mays
  misc_feature: Ceres CLONE 1562060
  misc_feature: Translation starting site: 149
  misc_feature (980)..(980): n is a, c, t, g, unknown, or other
tggagctccccgcggtggcggccgctctagaactagtggatcccccgggctgcaggaattcgtctcacccctagaaaaactcccaatagccagaccaaaccctaagttcgccgcgctcagctccggtcagtaccctcccccttctaagatgccgaacctcgagtgccggatgtatgagctgcggttcccggacgtggatgccgcggtgatgatccacgtgaagcacatcggtgacgtgggcgcgtttgtctccctgctcgagtacatctacatcgagggcgtgatcctcttctccgagctctcccgacatcggatccgctccatctcctccctctcaaagttggtcgccaggagccagtcatcatgctccgtgtcgatcgcgacaacggctacatccacccttaaaagctcctcctgcccccaagaggaggactcacttggcgatgacacgtacgacgaggcacaggctcgtgcaccccgtcatggcacgccggctcgacaacgacccgaggggttatcttgaacccctatgaacggcggagtgggcgggccgctataccgaaagggaaggtcagccccttcttgggggtccaaatcggagcggaccagaatcccgaagtaaatgtcaaccacctacccctggaagggaaaacggggccggccctcaatgggccgggggggtgccccatggcggatgtggtggtggcccccccggagggtttgggttccctcggggggaaaaccttgggggagggggtttttccccgcgccaccccaaattcccgggccggttgttaaggttgaaaatggggccccacactggagggaagagggccgtgtccgggggagcggttttaacaaaatcgaaatccccggcgaatttttccgtgggaagggaaaataaacactgttgtggggcagccccctctttttgtgtgacacccaacccttcttaaagggctacggaggttttcgtcttn

SEQ ID NO: 77168 - DNA, 784 bp, Zea mays
  misc_feature: Ceres CLONE 1562065
  misc_feature: Encodes the peptide sequence at SEQ ID NO. 77169
ggagctccccgcggtggcggccgctctagaactagtggatcccccgggctgcaggaattcgtctcacccctagaaaaagtgctccgtgctcattcattccccatctcgtctcctcccaaaccagaagacaaaaccctagcctcctccgtgtgatgggatgccgtccaaaccctacccccactccctgacctcctcttcctcctccgccgtcgcccccgcgacctggatgtccgcatccgcatggacggtgcccgagtcctgatcgccgccggtgccaccgccgtctgctgcttcgtctgcgccttctgggtcttccgttcctcttcgtcctcctcccccgcatccccaaagaagcaccaatccccttccaccaactgctgtggctgcgcctcctgcggctgccgcgacgccaagcccgccaacggcgagatggccgtgggtggggagaacaagaagaaggcgccggagccggatccgccggaggcgccctccatgatggagcagctcgtgcccgagatcaccacccacgcgctcagctacctcgactacaccagcctctgccgtctctccatgaccaactccgccatgcgccgcgcagccaacgacgacggcgcctgggaagcactctaccacaaagattttacggtgggacaaggtactataaatcctcctaatggatggaaagcatactatgcagctacaaaagcatcattaatctttaacgcggaagtctacaatatcatccagggaaaggtccttgcccccaatgagtcgttttttgctt

SEQ ID NO: 77169 - protein, 181 aa, Zea mays
  misc_feature: Ceres CLONE 1562065
  misc_feature (84)..(131): Pfam Name: F-box Pfam Description: F-box domain
MDGARVLIAAGATAVCCFVCAFWVFRSSSSSSPASPKKHQSPSTNCCGCASCGCRDAKPANGEMAVGGENKKKAPEPDPPEAPSMMEQLVPEITTHALSYLDYTSLCRLSMTNSAMRRAANDDGAWEALYHKDFTVGQGTINPPNGWKAYYAATKASLIFNAEVYNIIQGKVLAPNESFFA

SEQ ID NO: 77170 - DNA, 801 bp, Zea mays
  misc_feature: Ceres CLONE 1562069
  misc_feature: Translation starting site: 127
  misc_feature: Pfam Name: NUP50 Pfam Description: NUP50 (Nucleoporin 50 kDa)
  misc_feature (581)..(581): n is a, c, t, g, unknown, or other
  misc_feature (780)..(780): n is a, c, t, g, unknown, or other
tggagctcaccgcggtggcggccgctctagaactagtggatcccccgggctgcaggaattcgtctcacccctagaaaaactagtggagacaaagtggtagttggagaacccaatgaaggcagttgcatgccatctgaagttgagggcaaaacaaaagagggagatgctgaagaaaaggaaaggacagatgaagctggaaatatcgataaaattagcaaggatgatactgggaagaaagatggagatgacactgagaagaaagatggaggtgatgatactggaggtgaatcagagcagaaagggcaaacaccatcagcaacaccccttttctcgtttaagaatctgtcaagtggtcaaaatgctttcacaggtctgaccggaactggattttcaagcacatcattctcgtttggctcagcctctaaagatggctcaagtgctggtcccctatttgggctgaaagctgatggttcttcgttcccttcttttaatcttggtgctgccaccaatgggggttctgccacagctcttgctacttcagcagaggcacccaagatgtttgctatgacagagggccctgntcgaaaccggtgaagaaaatgagaaggctgtattcagcgctgattctgctttgtacgaatactttagatgggggctggaaagaaagaggaaaggtggactggaagctgaaacgtccccgtatcctggccggcgagcgaagccccggctcgtcatgtagacataatgctactacccggcctggtccttgaatgcaagccntctacaacgacatggtcgctc

SEQ ID NO: 77171 - DNA, 867 bp, Zea mays
  misc_feature: Ceres CLONE 1562070
  misc_feature: Encodes the peptide sequence at SEQ ID NO. 77172
ccgcggtggcggccgctctagaactagtggatcccccgggctgcaggaattcgtctcacccctagaaaaaaccttacctcacactcctctccatcgattaatctcctcccccctcaacaaccgcgagatcttcagctaccgctctctccggtcgcgtttgcatccgcattcctcagatccagattcgagccccagccccgcttcgagatccagctagctctctatcaagcatccggcggagcgagcagcggggggctcggcgagagagaagatgaagcggaagacgcggaacaagatcatcgtatggacactggccctggctgcagtggcgattctggtgggcggcacgattgcgctggtgctcacggcggggacgtggaaggccaagataaagaagtcgcaggagaagatctgtaacaaggggtgggagtgctcggggagcaagtactgctgcaacgacaccatcaccgacttcttcaaggtgtaccagttcgagaacctcttcgccaagcgcaacacccccgtcgcgcacgccgtcgggttctgggactaccaggccttcatcaccgccgcggccctcttcgagccccaggggttctgcaccaccggcggcaagcagatgcagatgatggagctctgcgccttcctcgggcacgtcggcgcaaagacttcatgtgggtacggcgtggcgaccgggcggccgacggcatgggggctgtgctacaccacgagatgagccccggacagacctactgcgacagaactacacccagttaccctgcgtcgagggcgcgtgttctacgggcgaaggcgcgattcctgtctacgggaactacaactacgggggctgccggtggacggggatca

SEQ ID NO: 77172 - protein, 154 aa, Zea mays
  misc_feature: Ceres CLONE 1562070
  misc_feature: SWISSPROT Homolog: EC 3.2.1.14 Chitinase
MKRKTRNKIIVWTLALAAVAILVGGTIALVLTAGTWKAKIKKSQEKICNKGWECSGSKYCCNDTITDFFKVYQFENLFAKRNTPVAHAVGFWDYQAFITAAALFEPQGFCTTGGKQMQMMELCAFLGHVGAKTSCGYGVATGRPTAWGLCYTTR

SEQ ID NO: 77173 - DNA, 762 bp, Zea mays
  misc_feature: Ceres CLONE 1562072
  misc_feature: Encodes the peptide sequence at SEQ ID NO. 77174
ctcaccgcggtggcggccgctctagaactagtggatcccccgggctgcaggaattcgtctcacccctagaaaaaaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaggcgggttaccgacatatcgattgtgccagagtttacggcaacgaaaaggagattggtttggcgctgaagaagctatttgaagagggtgtagtgaagcgagaagatctgtttatcacctctaagctatggaatgatcatcatgctcctgaagatgtgcctgaggcactaaatgacagccctgatgatttgcagcttgagtacctggatctttatcttatccattggccatttagagtcaagaaggggaacaaattcccgcccctggaaattttgtttaacctggactttccctggtaattggggggggaaaggaaaaagttttatttaaaggctggggcaaacccccccccccttttgggggggagaataacacttccccccccaaaaaaaaaaatgggggggaaaattggccttgggccggaaaacctccccgggggaacccccccccacaaatgtgttttgtaaatattcaagaggggggggaaaataaagtccctccccc

SEQ ID NO: 77174 - protein, 135 aa, Zea mays
  misc_feature: Ceres CLONE 1562072
  misc_feature (7)..(133): Pfam Name: Aldo_ket_red Pfam Description: Aldo/keto reductase family
  misc_feature: SWISSPROT Homolog: EC 1.1.1.2 Alcohol dehydrogenase (NADP(+))
MARHFVLNTGAKIPSVGLGTWQSDPGVVGNAVYAAVKAGYRHIDCARVYGNEKEIGLALKKLFEEGVVKREDLFITSKLWNDHHAPEDVPEALNDSPDDLQLEYLDLYLIHWPFRVKKGNKFPPLEILFNLDFPW

SEQ ID NO: 77175 - DNA, 847 bp, Zea mays
  misc_feature: Ceres CLONE 1562074
  misc_feature: Encodes the peptide sequence at SEQ ID NO. 77176
ctccccgcggtggcggccgctctagaactagtggatcccccgggctgcaggaattcgtctcacccctagaaaaagtcctccgttctcctcttcctctctctctcttctctctctctctacggattgcctcacacgcatctcgcgtgcaattcaagcgaaactttctgaatatcaaagtggcatagagctccacttttatggccatccctatgaaggcctctccgggttcctgatatagatgtttccttgttctgaacatgaaaagttctcaggtactccgccgttgatgaactgcctccacacctgcggcgacaagaagacgctgaagaagtggtttttcatcgacaagacagtaggctaaatccagtcccagagaacaaattgaagcaccactccccaccgcacagcagcacagctcttctcttcaccgatcccgatggatatgggcagcggctcgtcacctgtcatcaccgatccgatatcgataagcccaccgctgctgggaaggctgacgtcgaacctgatgccgttctcgggcatgttcggaggctgctccttcagtcctagcatgagcgcagcagcaggcgtaaaatcaaggaaggtcttgtcaatggcctgctagacccgatgaaatcttcctcccctcccaagaagcaacaactccgctttgggaaagagaaattcgcccggacgaagaacctgcttaacctggcagggctgtcaaaaaggccctttggggcttgggctcctttaagccaaaaagaccccaccccacggggcagggggaaaccccgggttccttggaatataaaaggggcccctgttcccccaatttttgaaaaaaacc

SEQ ID NO: 77176 - protein, 61 aa, Zea mays
  misc_feature: Ceres CLONE 1562074
  misc_feature: The sequence is a functional homolog of SEQ ID NO 16 in US patent 7214858
MDMGSGSSPVITDPISISPPLLGRLTSNLMPFSGMFGGCSFSPSMSAAAGVKSRKVLSMAC

SEQ ID NO: 77177 - DNA, 789 bp, Zea mays
  misc_feature: Ceres CLONE 1562075
  misc_feature: Encodes the peptide sequence at SEQ ID NO. 77178
ctcaccgcggtggcggccgctctagactagtggatcccccgggctgcaggaattcgtctcacccctagaaaaaaaaccaccgacgcgtagcacagtccattattgccgtctcccttttgcgtgagcaaagaaagagagcgagaagagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggaaaagaaggacaagaaaaagaagaagcacggcgagggccacgaccacgacggcggccacagtagcagcagcagcgacagcgactgagatctggtgtcgcagcacaggtgcaacacatgtatgcttgctggatggaggattcataccagctgatgctgatgtagtgtttcactggtgtcatgcatgtatcgtgctattatatcaaaagaaaaaagaaatacagtcagggatgggtttgtttgccaaaaaaaaaaaaaaaaataccccagcatccggaggtccccgaacacaaccggttcctccgaacccagggagcaacccccccccccaggaagaaaatttggtcctttttaaccaaattgtccaaggggaggaaaaaacctccccctggggggggcgcgacccccaagaaattagg

SEQ ID NO: 77178 - protein, 100 aa, Zea mays
  misc_feature: Ceres CLONE 1562075
  misc_feature (2)..(100): Pfam Name: Dehydrin Pfam Description: Dehydrin
MSGIIHKIEEKLHMGGDHKNKEEEHHKKAEEHHKKEEGEHHKKDGGEHKEGIVEKIKDKITGEHGDKSGDHKEKKDKKKKKHGEGHDHDGGHSSSSSDSD

SEQ ID NO: 77179 - DNA, 845 bp, Zea mays
  misc_feature: Ceres CLONE 1562076
  misc_feature: Translation starting site: 210
  misc_feature (725)..(725): n is a, c, t, g, unknown, or other
  misc_feature (784)..(784): n is a, c, t, g, unknown, or other
ctggagctccccgcggtggcggccgctctagaactagtggatcccccgggctgcaggaattcgtctcacccctagaaaaagccgtccacaggcgccagttcgtctcccggataagacgataattcgagccgaaaaatatcaccacacagacacacaggtacgcaaggcacagcccaagaccaccgcaccgcacctgcacaccgccagggatggcggcaaccgcgcacctcaccggtgtcctcggcgtgtcgtcgccgcctctcgctccgtcccactgcagctgcagcggcgccaagaagcagagctgctctctgcgtcaggggcggcagcagaggaggcgcctccgcgtcgcccgcgccgtcgaggtggacgcgccttccgccggcgcaccggagccggaggaggcggaggagccgtccgtcgacttcgctttcgtcagcccgcggctgctgccggacgggacgccggacgtgcactaccggacggcgcgcggcgggcagaagctcagggacatcatgctcgacggctacatcgacctctacgggccctacgataaggttcttctcaactgctcaggggggcggcgtgtgcgggacctgcatcgtcgaaggtggttgaaggcaaggaaatgctgtccccgaaaaactgatgtgggaaaaggagttgctcaaaaggaaacccaaaacgtgggagattggcgtgcccaggcaacggtggggcaacgncagattcgactgggacagatgaatcattcaacaagttgcccggaagtgaaagatacacngagtgggaaccaagtagggggttactggccttactggggtcttgaaaaaagtgctcttcgt

SEQ ID NO: 77180 - DNA, 752 bp, Zea mays
  misc_feature: Ceres CLONE 1562079
  misc_feature: Encodes the peptide sequence at SEQ ID NO. 77181
  misc_feature (695)..(695): n is a, c, t, g, unknown, or other
  misc_feature (700)..(700): n is a, c, t, g, unknown, or other
agctcaccgcggtggcggccgctctagaactagtggatcccccgggctgcaggaattcgtctcacccctagaaaaaacgcctagcgccagtcaccaaccttccactccctccctccgtcgccatggcgcgcaagaagatccgggagtacgactccaagcgcctcctcagggagcacctcaagcgcctcgcgggcatcgacctcaccatcctctccgcccagatcacgcaatcaacggacttcgcagagcttgtgagccagcagccatggctgtcaaccatgaagctagtggtgaagcccgatatgctgttcgggaagcgtgggaagagcggcctcgtggctctcaacttggatttcgatcaagtcaaggagtttgtcaaggagcggctgggggttgaggttgagatgggtggctgcaaggctccaatcacgaccttcatcgtcgagccatttgtgccacatgatcaagagtactacctttcgattgtctcagagaggttgggcagcaccatcagcttctcagagtgtggaagggattgagatcgaggagaactgggacaaggttaagactattttccttcctactgagaagccaatgacgtctgattcatgtgctgcctgtgattgcaacccttgcattggaagcacgcgggaaaaattggtgacttcattaaaaggagtgtttgccgtcttccntagancttggattttctcatttccttgaagatgaatcccgttcaccatgggtcaatg

SEQ ID NO: 77181 - protein, 138 aa, Zea mays
  misc_feature: Ceres CLONE 1562079
  misc_feature: SWISSPROT Homolog: EC 2.3.3.8 ATP citrate synthase
MARKKIREYDSKRLLREHLKRLAGIDLTILSAQITQSTDFAELVSQQPWLSTMKLVVKPDMLFGKRGKSGLVALNLDFDQVKEFVKERLGVEVEMGGCKAPITTFIVEPFVPHDQEYYLSIVSERLGSTISFSECGRD

SEQ ID NO: 77182 - DNA, 786 bp, Zea mays
  misc_feature: Ceres CLONE 1562082
  misc_feature: Translation starting site: 182
  misc_feature (638)..(638): n is a, c, t, g, unknown, or other
ctcaccgcggtggcggccgctctagaatagtggatcccccgggctgcaggaattcgtctcacccctagaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggacccctccgtgagcgtcgccatcgtggagcagtccgtgtccccgggcggcggcgcgtggctgggcgggcagctgttctcggcccatggtggtgcgcaggccggcgcacctgtccctggacgagctgggcgtnggctacgacgaagccgaggactacgtgggtgtcaagcacgcggcgctgttcacgtccaccgtgatgaagcggctcctgccgcggcccaacgtgaagctgtttcaacgccggggcggtgggagggacctgatcgtgcgggcgggggccc

SEQ ID NO: 77183 - DNA, 963 bp, Zea mays
  misc_feature: Ceres CLONE 1562083
  misc_feature: Translation starting site: 212
cctcggtggcggccgctctagaactagtggatcccccgggctgcaggaattcgtctcacccctagaaaaaaggttgcggccgaaccagagccccgtcccaactccaccacctctcttctctacggcgcgagcaagggcggcgccggccgcggcgtctgcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgatggggtggagtttctgctgctgtctccaagacagctgcagctccgattgagcgtgtcaagcttttgattcagaaccaggatgaaatgctcaagactggcaggctttctgaaccgtacaagggtattgggggactgctttggccggacaatcagagatgagggttttgtctcactgtggagaagaaacacagctaatgtcatccgttactttcccacacaggcatggtacttttgcgtttcaagatcactccaagcgcatggtcaactttaagaaggaacaggatggggtactggaaagtggtttgccggaaattctgcttccggtgggagctgctggtgcctgcccccctattctttggccattccccggacaacccccgttacgcgtttgggccattgatgcaaagctgccaaaataaggtgggggaaagcaattcaatgggaccccttggatgtttacccaagaacctttgcattgattggtttcttgggcccc

SEQ ID NO: 77184 - DNA, 743 bp, Zea mays
  misc_feature: Ceres CLONE 1562086
  misc_feature (315)..(315): n is a, c, t, g, unknown, or other
  misc_feature (342)..(342): n is a, c, t, g, unknown, or other
  misc_feature (343)..(343): n is a, c, t, g, unknown, or other
  misc_feature (468)..(468): n is a, c, t, g, unknown, or other
ggagctcaccgcggtggcggccgctctagaactagtggatcccccgggctgcaggaattcgtctcacccctagaaaaaaccgagaggaggaagcctgcccactaccgcgtatctctctcctccctggctctcgtcccccccaccgagtcgtcgccccctcgctttcaccccacgcggaagcaagaattcgtcgtcaaattcccagcttgcgcgtgtttctgtggatttcttcccgcttccctgctcctgcctcctatgggcctttgatccgggcttcgtggatcttgggaagaggagagtgtggtgggcgcctcnggcggcgatctggcgggggaggatatnnggccagcgggaaagggagccgatcgaggtcaggtttcgtctcttcgacggcacggatatcgggcctacgaagtacgatcccctcaccacggtctcctcgctcaaagagttcatccctcgctcggntggccgcaagaataaggattagcctcccaaaaactgtttaaggaccttgaaaccttaatcaatggggggggaaagaaatatttgggaaaaaaaaacccgggaaaacctttggcaaaaaacccccccggggtgttcccccgtgggggggaaaaaattcccccccggggggggggggggaaattataccaaaaatggcgccttgtgggggggaaaaaaagggggagaaaaacccccccccccaaaaaagagggggtggtggaccaaaaaaaaaaaaa

SEQ ID NO: 77185 - DNA, 674 bp, Zea mays
  misc_feature: Ceres CLONE 1562088
  misc_feature: Encodes the peptide sequence at SEQ ID NO. 77186
  misc_feature (319)..(319): n is a, c, t, g, unknown, or other
  misc_feature (330)..(330): n is a, c, t, g, unknown, or other
  misc_feature (346)..(346): n is a, c, t, g, unknown, or other
  misc_feature (347)..(347): n is a, c, t, g, unknown, or other
  misc_feature (385)..(385): n is a, c, t, g, unknown, or other
  misc_feature (386)..(386): n is a, c, t, g, unknown, or other
  misc_feature (502)..(502): n is a, c, t, g, unknown, or other
ctccccgcggtggcggccgctctagaactagtggatcccccgggctgcaggaattcgtctcacccctagaaaaaatcgctactaccagacagagaggacaggggaggtcagagtcagagacgctcgctcacgacggcagcagccatggcagcaccgtgcggcggccgcgtggtggtcttcccgttcccgttccagggccacttcaacccggtgatgcgcctggcccgcgcgctgcacgcgcggggcgtcgggatcaccgtgttccacaccgccggcgcgcgggcgccggacccggccgactaccccgccgactaccgcnttcgtgcccgntgcccgtggaggtggnnccccggaagctgaaatggcggtccggaaggacaatcgnnccgcccattcggtcaacgggcggcttcaaacgccccgccctggccgagggccggccccttttccgggggaccccgcccttcttcggggcggcctggcttctttccggcccggcccnaaaacgggccaaaagccgggggggaaaaaaggcccggggggggggggccccccccggttcccccccttgtgggggtcccccttcaaacccgaaaaacctttcaaagcccttggggggaaaaacaccccccggtggggcctttttttctccgggggggggggggccccccccg

SEQ ID NO: 77186 - protein, 71 aa, Zea mays
  misc_feature: Ceres CLONE 1562088
  misc_feature: SWISSPROT Homolog: EC 2.4.1.195 N-hydroxythioamide S-beta-glucosyltransferase
  misc_feature (59)..(59): Xaa is any aa, unknown, or other
  misc_feature (68)..(68): Xaa is any aa, unknown, or other
MAAPCGGRVVVFPFPFQGHFNPVMRLARALHARGVGITVFHTAGARAPDPADYPADYRXRARCPWRWXPGS

SEQ ID NO: 77187 - DNA, 1030 bp, Zea mays
  misc_feature: Ceres CLONE 1562090
  misc_feature: Encodes the peptide sequence at SEQ ID NO. 77188
  misc_feature (538)..(538): n is a, c, t, g, unknown, or other
gcggtggcggccgctctagaactagtggatcccccgggctgcaggaattcgtctcacccctagaaaaaaataccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcggggcgcgtggtggcgcgcacgggatgcagctccgggcattccccggtgcgagaccgggagcgcagcgcccggcgaccgtgggtgcaagctggtggtgcacgccggagggggcagggacctgggcgtccgtacaacgtggagccctggtgggaccgggttcaaacgtgcccccgccgttggtttgagccccncaaggccggtggggccggccgggcaattgccccggccccctggggggttggggccggcggaaacctcaaacggcccgggttggcccgccccctccccaaacaccgtgctgggggcccaggggggggcccgcgcccttttttatattttccctttactaaaaggacccccaccccccggctgctcttcttagagaagaggggtgcgccccgcttaatttagttgttacacacccgcctgccacctctgttaagctctctatgcccccaattgaatgatttttgattccccgtggcaactaaaagttggtttctctctttcgagttccctcccttgggaaataaacccgtccagcctcgctaaatagaaagtatgctcgataccctaaagtgtgataaaaaaagtacttatttctttatatacgtttgtgcgtactctccggcggtgggttggcttatttaaggaatacaaagtgcgcttctccccttcggttg

SEQ ID NO: 77188 - protein, 214 aa, Zea mays
  misc_feature: Ceres CLONE 1562090
  misc_feature (142)..(142): Xaa is any aa, unknown, or other
MAGTAKTPVLGFLLALALVATSTPAAATTLTLHNLCPYPVWPLVSPNTGFPAISENTGRLDGGGRGLVSFRFPDSFWAGRVVARTGCSSGHSPVRDRERSARRPWVQAGGARRRGQGPGRPYNVEPWWDRVQTCPRRWFEPXKAGGAGRAIAPAPWGVGAGGNLKRPGLARPLPKHRAGGPGGGPRPFLYFPFTKRTPTPRLLFLEKRGAPRLI

SEQ ID NO: 77189 - DNA, 1030 bp, Zea mays
  misc_feature: Ceres CLONE 1562095
  misc_feature: Encodes the peptide sequence at SEQ ID NO. 77190
  misc_feature (406)..(406): n is a, c, t, g, unknown, or other
  misc_feature (524)..(524): n is a, c, t, g, unknown, or other
ctccccgcggtggcggccgctctagaactagtggatcccccgggctgcaggaattcgtctcacccctagaaaaatgggtcaaaccaacttcagagttcagagaccggcggctggttctccaccaaaccaaccaaccatgcgtccgtcgtcgcgttacccgccgcaacccgcgctactcgctctcgctctcgccctcgccctcgcggcggcggccccggagctgagacccctcgccgccgccgtcgccgtcaccgtcacgccgccgtcggagcggacggacgaggaggtgcggcggctgtacgaggagtggagatcggagaacgacgcgggggccgaggcgtggcgccaccggcggcagcctcggcctgggcgacgccgacgccggcgaggacgacaacgcgcggcnggctgggaggtgttccgcgacaacctccgctacatcgaccgcacaaccgcgggagggcggacgccggggctcccacggcttccgccctccggcctcaccccgctttcgccgacctcancggctgggaggaagtaccgcggcccggcctccctccctggggtccccgcggccgcaacggcacccgcgggtggggcgggttccttccgggagaccgccccgcttaccggcccccttaggccgggggaagcaagcttcccccgaacgccccgtgggtaactgggcgcccaagccgccggcccccccttctcccctagggccaaaggaaccaggggccaaattgccggttgggggtggctggggcgtttcttccgcggttggcaaacccggggggaaagggaattcaaaaagaaattgggacaagggcaggcccccttttcgccgttcgggaaacaggaacttattccaccgggggatagattcccaggacccgggggtgtcaaaggggcgcgtttatggaaaaagggtttcccggttccagaatcaaaaaacggggggggctaaacccggggcggataccccttctctgggcccacagaggaggtggaatccaatggaaaaaaacag

SEQ ID NO: 77190 - protein, 181 aa, Zea mays
  misc_feature: Ceres CLONE 1562095
  misc_feature (130)..(130): Xaa is any aa, unknown, or other
MRPSSRYPPQPALLALALALALAAAAPELRPLAAAVAVTVTPPSERTDEEVRRLYEEWRSENDAGAEAWRHRRQPRPGRRRRRRGRQRAAGWEVFRDNLRYIDRTTAGGRTPGLPRLPPSGLTPLSPTSXAGRKYRGPASLPGVPAAATAPAGGAGSFRETAPLTGPLRPGEASFPRTPRG

SEQ ID NO: 77191 - DNA, 916 bp, Zea mays
  misc_feature: Ceres CLONE 1562098
  misc_feature: Encodes the peptide sequence at SEQ ID NO. 77192
  misc_feature (769)..(769): n is a, c, t, g, unknown, or other
  misc_feature (892)..(892): n is a, c, t, g, unknown, or other
ctggagctccccgcggtggcggccgctctagaactagtggatcccccgggctgcaggaattcgtctcacccctagaaaaactttcctagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccatccaggtcgtcgtcgacgcgatcatcaacagtggaccccgtgaggatgccacccgtattggttccgctggtgttgtgaggaggcaggccgtggatatctcacccctgaggagggtgaaccaggccatctacctcctcaccactggtgccagggagagtgctttccggaacatcaaaaccattgccgagtgccttgcagatgagctgatcaacgctgccaagggctcatccaacagttacgccatcaagaagaaggacgagattgagcgtgtttgccaaggcaaccgntgaactgagcttgtatcctggtgcactctgcgctgggaacttttatgtcgctggcagtcgtatcggttcctggtttacaattgttagagttttttgagactaaatggcggtttggtgtttcantgcacattaaaatactggggtaag

SEQ ID NO: 77192 - protein, 199 aa, Zea mays
  misc_feature: Ceres CLONE 1562098
  misc_feature (44)..(199): Pfam Name: Ribosomal_S7 Pfam Description: Ribosomal protein S7p/S5e
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGVVRRQAVDISPLRRVNQAIYLLTTGARESAFRNIKTIAECLADELINAAKGSSNSYAIKKKDEIERVCQGNR

SEQ ID NO: 77193 - DNA, 908 bp, Zea mays
  misc_feature: Ceres CLONE 1562099
  misc_feature: Encodes the peptide sequence at SEQ ID NO. 77194
gagctccccgcggtggcggccgctctagaactagtggatcccccgggctgcaggaattcgtctcacccctagaaaaaagctggaggtctcgctgttcccttcacgatacgcccccccaaagcggatcaaaccctagatctcgtcttgtcgccccgttcctccgatcccatcctatccgatcctcatggattcctcctcgtccagcctcagccagcagcccgagttcgactacctcttcaagctactccttatcggcgactccggcgtcggcaagagcagcctcctcctccgcttcaccgccgactccttcgatgacctctcccctaccataggtgttgacttcaaggtgaagatggttagcattggtggccaaaaactcaagcttgccatctgggacacagctggacaagagagggttaggaccttgaccagctcttactacagaggggcacaaggggatcattatgggtgtatgatgtcagtcgaccaagagacgttcaccaaatctttttggatatattgggcccaggaaaattgccctgtatttcacccaaaccggaactgtggtaaagttgcttgtttggaaataaaagttaccaagggaaaagtgggaggggcttgtccccaaaaaagggggggaaattgaattttccccggggaaaaccgggtggtttggttttcttaaaagggggggggggaaaaacaaaatgtaaacctttaaaaaagtggtttttttggggaaaatggggttcttaaaagattttttaaacacccccccaagccccccttggggggggaagtgtttttctcccccagggggggtgcccccccaaaaaaaaaaactttctctccacccgagaggggttcctcaaaaaatttggagcgccccccccacgggggaggttttg

SEQ ID NO: 77194 - protein, 153 aa, Zea mays
  misc_feature: Ceres CLONE 1562099
  misc_feature (19)..(133): Pfam Name: Ras Pfam Description: Ras family
MDSSSSSLSQQPEFDYLFKLLLIGDSGVGKSSLLLRFTADSFDDLSPTIGVDFKVKMVSIGGQKLKLAIWDTAGQERVRTLTSSYYRGAQGDHYGCMMSVDQETFTKSFWIYWAQENCPVFHPNRNCGKVACLEIKVTKGKVGGACPQKRGGN

SEQ ID NO: 77195 - DNA, 911 bp, Zea mays
  misc_feature: Ceres CLONE 1562100
  misc_feature: Encodes the peptide sequence at SEQ ID NO. 77196
  misc_feature (371)..(371): n is a, c, t, g, unknown, or other
  misc_feature (426)..(426): n is a, c, t, g, unknown, or other
ctggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacngctgggacacccgcgggctgtcggcggacccgggagacgtcgccaagaacggggnagctggagtcaatccactcccgctgggccatgcttggccccttggggctgccttgtccccgggagctggctcccccgcaaagggggtcaaattcggccaaggcccttgtgggtcaaaggccggggcccaaaactttcaaccaaggggggggggggaataccctgggaaaccccgaagcctgtttccccccgccaaaaaatcccccccccccccggggcccccccaaggtcgtgccccttgggcgccccctccggaggggtaacccggtttcccccgggggcccccccccaaaaaaaggttttaaaaaccccttttttacccccggggggggatttttttaaaaccggtggggccccccccaaaaaaacacctagaggcccctccgggggggtctttgggggggggagagtcctcaaaaaggggccccccccccccactgtttccatgaggggggggggggtctccacaaaaaaaaaattaaaacc

SEQ ID NO: 77196 - protein, 182 aa, Zea mays
  misc_feature: Ceres CLONE 1562100
  misc_feature (78)..(78): Xaa is any aa, unknown, or other
  misc_feature (96)..(96): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYXWDTRGLSADPGDVAKNGXAGVNPLPLGHAWPLGAALSPGAGSPAKGVKFGQGPCGSKAGAQNFQPRGGGEYPGKPRSLFPPAKKSPPPPGPPQGRAPWAPPPEG

SEQ ID NO: 77197 - DNA, 1015 bp, Zea mays
  misc_feature: Ceres CLONE 1562102
  misc_feature (1015)..(1015): n is a, c, t, g, unknown, or other
ctggagctccccgcggtggcggccgctctagaactagtggatcccccgggctgcaggaattcgtctcacccctagaaaaaatgcgacgattagcgttcgaaaagccatcggcctcacgtacgatacacgagacgcggcaagccttggagcggttacatttttctctgaaggcaacctcttcctcggcgcagcccacgtcacccgccgcggctgtcagggatgcgggcttggatgtggtctagtgacacaccttcctctgagccctcccctgggcgggaagcgtatacgtggacagccatctcctcgtagatgttcactcttaagtgctgcaagatcttttgctggaacgcgtaatgtgtcatgtccgagcaccgatgaagcatggtgagcgtacgcgcgcatccatgcttgtgatctgtgatcggggtaccccatgctgaacgatggaagagggtacatgccaccgttatcacatacacctgtcctgtacattctgggaggggtgaataattgtaaggaaaggaatcccaggcttttttcccgggcatttgggtaagccctccccgtttttatgattggaaaaacttgggaacaatttcccccttctttggaggccccttcccgtgccctggactgggaaccaaacgggggaaatttttcctgagactttttggcgaaaaccccctgaaaacctttccggaaatggcaaagaaaaatatattttgacaaaactttggcaaaggaatgggcgcttttacccccccggggggtaaaaaaaggggtgaactttttccgtggttgggaggccccccttgggtggttttttttttttttccaaataggccccggggcccaaaaactcttttattaagtggcccttaaaatttattttgttcccctttttttcggtgttgaccccacaaaccgggtttttgtctttaaccactttttttttccccaaagtggtgggggggaaaaaacaaaaaggggggttaaaaaaaattggtgctttttn

SEQ ID NO: 77198 - DNA, 854 bp, Zea mays
  misc_feature: Ceres CLONE 1562104
  misc_feature: Encodes the peptide sequence at SEQ ID NO. 77199
atagctggagctccccgcggtggcggccgcgtcgaactagtggatcccccgggctgctcgcttcgtctcacccctagaaaaagtgaaccacgggtgttgttcacatttggtaccagagccaatactggatcctccacacgggtactggacgagatcgcaatcgaagttgggcggcatggcgccagcgaagacggacgatcctttgtcccagcttctggcgaagatcgaggagggaaacaaggagactcaccgacgcatggaggcgattcagggggcggtgggaaatatggaggcggcggtcaaggtggtgatgacggagcagggagatcttcagaagtggaaaccggaggtggaagcgaaagtgacggagatttctgatgctctaaaggcgatccagatccagatgggaaagatggagaagaagccgctcggtttcgggtcgagacaggaagaagaaggagaagacggatttctgaagccgccaccatctgattcttcgaatttggagtttcgtcgtgaagaagggcggacccaattctcgcatggagtattgggcatgaactggatccagcaatacagtccgatgaaagtggattggggcgaacaagtgggcagtcatttcatattatggatccccaggcttacttgcaagggggggaggggaatttcccggcggggctggtcaccgaaatttttgttcttgtcggtgggaaccacggggtacacccccggggacaatcgggggggtccaaaaggcaaacaaattccgggattatttcggggaagggtttttgagaaacccattgggttttacccccagagagaaagttgggacaccccttccccttgtggta

SEQ ID NO: 77199 - protein, 226 aa, Zea mays
  misc_feature: Ceres CLONE 1562104
MAPAKTDDPLSQLLAKIEEGNKETHRRMEAIQGAVGNMEAAVKVVMTEQGDLQKWKPEVEAKVTEISDALKAIQIQMGKMEKKPLGFGSRQEEEGEDGFLKPPPSDSSNLEFRREEGRTQFSHGVLGMNWIQQYSPMKVDWGEQVGSHFILWIPRLTCKGGRGISRRGWSPKFLFLSVGTTGYTPGDNRGGPKGKQIPGLFRGRVFEKPIGFYPQRESWDTPSPCG

SEQ ID NO: 77200 - DNA, 1287 bp, Zea mays
  misc_feature: Ceres CLONE 1562107
  misc_feature: Encodes the peptide sequence at SEQ ID NO. 77201
  misc_feature (1160)..(1160): n is a, c, t, g, unknown, or other
  misc_feature (1216)..(1216): n is a, c, t, g, unknown, or other
cctttgagccgttgttgcggtcccttgtaaatgtttaaacatattatactattttctccttctctatacttggactccccgcggtggcggccgctctagaatagtggatcccccgggctgcaggaattcgtctcacccctagaaaaaaaatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgcccttcagagcgaggatgtcgagctcgtcgccgtcaacgaccccttcatcaccacggactacatgacctacatgttcaagtacgacaccgtccacggccactggaagcacagcgacatcacactcaaggacttcaagacccttctcttcggtgacaagccggtcaccgtctttggcatcacgaaccctgaggaaatcccgtggggtgaggctggcgctgagtatgtcgtggagtccacccggccgctttcactgacaaggacaaagcttgccggcccatcctcaagggtggtgcccagaaaggttggttttcctcggccccctggcaaaagtggccccccattgttttgtttttggggtggccattggagggaacaagtgcccccccccccgaatggtgtaaaacttttgctccccaaattggctaggccgtgcgaccctataaaaatgtgcctcttggcgccaccccccgtggcaaaagggggtcattgtctaagaggaacaacacttctcgtggacggatatggcgcgtcaagagggcgtctcttcaatgagcgaacaatccctggtatctctgattggcggcaaattgacaatggggcccgcctccctcaaaaaatattcactttgttgctacacatgcggcatcccccctcaggctattaaatgaattcctcgtaacaatgcgatggttgtgactagtcgatttttcccctcaccattttttaatacaagtacggctccgaaacaagtcaagacacccgcgggggattcaatccaaaagtgctatatcgttagtaaaacaatccttctctcctatacaactgcaatctgccgcactacccacgacatcggttgtgcccctcacctganctgtgcgtttacttgcggtggtatgctgcttcgtttgctaggaccctccccccccncgcgctttatccttagtgaaagggggtgcttctcgctcattgctatccgcacaaagctattatggcgtcgg

SEQ ID NO: 77201 - protein, 242 aa, Zea mays
  misc_feature: Ceres CLONE 1562107
  misc_feature (4)..(122): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDFKTLLFGDKPVTVFGITNPEEIPWGEAGAEYVVESTRPLSLTRTKLAGPSSRVVPRKVGFPRPPGKSGPPLFCFWGGHWREQVPPPPNGVKLLLPKLARPCDPIKMCLLAPPPVAKGGHCLRGTTLLVDGYGASRGRLFNERTIPGISDWRQIDNGARLPQKIFTLLLHMRHPPSGY

SEQ ID NO: 77202 - DNA, 930 bp, Zea mays
  misc_feature: Ceres CLONE 1562108
  misc_feature: Encodes the peptide sequence at SEQ ID NO. 77203
  misc_feature (363)..(363): n is a, c, t, g, unknown, or other
  misc_feature (365)..(365): n is a, c, t, g, unknown, or other
acccgcggtggcggccgctctagaactagtggatcccccgggctgcaggaattcgtctcacccctagaaaaaacactcgcttgagcatatagtgtgctcttctcttcctcttccagttggtattctttatctgaaacatagtacagaggaggagaggagaacgagagctaagaagatgaccggcaaggttctccttgtggccgtccttatcttggtgggcgtggcctctcgatgctcgggcagtaggggcctgcagggcgatcacgttgctgaacagaagttcggtggcggtggctatggaggtggcggtgggtacggaggctacggcggcggtggaggaggaggtggtggtgggtatacaangnttacacacagggcactgtgccttctgtggaccacaacaacgaggtcacggcgcgagagcttggaccctgatcaggtacatcgacaagctactttgatcggccccgcgtctgctcccagatggatgctgcaaaagaagccggtttggctgacgaactggttcggcgtctggccaacgcgtttctccaaaagaccctcctactttgcccgttgcctggccccaccgcgggccgtggttcataaccgaaaattggttgcccagcctcttggaataaaaaccccgaagtctggaaccctatcccagagtttccgaacgaaacgggactccctttccttcccttagggccaaagttcccatctttggtgcgggaaatgttagccgtaaacgtttaaccgatattctggggaaagagggtttccaaaagtgtagctattttgccacaatccttataggaaactataccgaggtgtccccccaatgggtgatgggcccttggcccctctcagggaaatattcatgcccgccgtagaatgaaaccattgtatccgtatagccgatattgcctc

SEQ ID NO: 77203 - protein, 176 aa, Zea mays
  misc_feature: Ceres CLONE 1562108
  misc_feature (1)..(65): Pfam Name: GRP Pfam Description: Glycine rich protein family
  misc_feature (63)..(63): Xaa is any aa, unknown, or other
  misc_feature (64)..(64): Xaa is any aa, unknown, or other
MTGKVLLVAVLILVGVASRCSGSRGLQGDHVAEQKFGGGGYGGGGGYGGYGGGGGGGGGGYTXXTHRALCLLWTTTTRSRRESLDPDQVHRQATLIGPASAPRWMLQKKPVWLTNWFGVWPTRFSKRPSYFARCLAPPRAVVHNRKLVAQPLGIKTPKSGTLSQSFRTKRDSLSFP

SEQ ID NO: 77204 - DNA, 807 bp, Zea mays
  misc_feature: Ceres CLONE 1562109
  misc_feature: Translation starting site: 252
catagctggagctccccgcggtggcggccgctctagaactagtggatcccccgggctgctggaattcgtctcacccctagaaaaagcagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaaggggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtgggggaaagctgctggcgacaggtggtaatccctgagcgagtcggacaaggctccctatgtagccaagggctaacagctcaagctcgagtacaacaaaggccatcggctggcctaaaaaaaggggcgagaggcacggcaagctaaaaaaggctcccctgcccagggggggaaaaaaggggggaaagaattaaaaaagggagatctgaacaaagtcccccaagtggggaagggcccattgcccccagggattatataaaaaggggggtttgggggggggggggattaaaaaaatttttgtcccccgggtgggtgggggggcccccccccagggagaaaaaa

SEQ ID NO: 77205 - DNA, 912 bp, Zea mays
  misc_feature: Ceres CLONE 1562110
  misc_feature (14)..(14): n is a, c, t, g, unknown, or other
  misc_feature (18)..(18): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (644)..(644): n is a, c, t, g, unknown, or other
  misc_feature (651)..(651): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (745)..(745): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (839)..(839): n is a, c, t, g, unknown, or other
  misc_feature (894)..(894): n is a, c, t, g, unknown, or other
tggagctccaccgncggntggggcggctcgctctagaactagtggatcccccgggctgcaggaattcgtctcacccctagaaaaaacctcccaactccagaagtcctccctagacgccgccagccgcgcgcacacccaccgagagctcctcgggctttctttctccgttcctccctcgcgcgctcagggtttcacgatggaggccgaggcggcggccaaaagggcgcgggagggcggggaagacgccaccgcgcctgtggcgggggcctgagcggtggtctgcggtgctggcgagcaggcgggaatctccgccgtcatcccaggatggttctccgagatccagccccatgtggcccgggtgaggcgccttccctgaaggggggagaagggtcttgttcccgggcaagtccaactacccaaaagggggagggttttttcagccctcccaccaacggggaaggggctttgtccttccccgggattttttctgggggaacaaaaaggggtagaaattcccccttcccaaaaaagagaatttctctccccggccccccttttgtccccctcaaaaaaccccccaaaaagggtgttggtttttgaaggggggggggaaataattttttttttttttttnnnnnnaaaanttttttnannnatttttttttttgtgggggaaaaaattttgatgaatttttgataaaaaataaaataaagaggggggggggggattttttcttttaaaaanaaattttttttgtcttannnaaagtgggggggggaaaggagaaagaaacgccttttttgttttgtatataaaagggggagggagggggggtgtntttttttttgtaaaaaaaaagaggttttttcccccccccctgcccccaaaaaaantagtgtggtgggtggggg

SEQ ID NO: 77206 - DNA, 861 bp, Zea mays
  misc_feature: Ceres CLONE 1562111
  misc_feature: Translation starting site: 146
  misc_feature (818)..(818): n is a, c, t, g, unknown, or other
  misc_feature (854)..(854): n is a, c, t, g, unknown, or other
gagctccccgcggtggcggccgctctagaactagtggatcccccgggctgcaggaattcgtctcacccctagaaaaaatccgaaagcccaagacactgagctggtctgtttagttggaaagccatctgtacgtttttcgccgatcatggaggatgagaggaacacccagcagcaccagggcggtgagcaggcccaggaccaggagaacgaggtgaaggacaggggactcctggacagcctactcggcaggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccagctccagttccagctcgtcgagcgacgacgaggaagaggaggtgatcgatgagaacggcgagattgtcaagaggaagaagaagaagggccttaaggagaaggtcaaggagaagctggcggcccacaaggcccacgatgagggcgaccaccaccagactgcccgcgccgcccgtggtggtggacacgcatgctcaccaccaggagggagagcacttcccggcgccggcgcctcccccgcacgtggagacgcacccaccccgtcgtcgtccacaagatcgaggacgacgacacgaagattcagaccccaccaccaggcaccgggaggaagagaaagaaagcctgctggacaagatcaaggagaaagcttcccggtggccacaagaagccggaagacgctgctgccgcccgcgnccgcggccgggccgtcaacgcgcccacggcgggggnccgaagg

SEQ ID NO: 77207 - DNA, 965 bp, Zea mays
  misc_feature: Ceres CLONE 1562112
  misc_feature: Translation starting site: 481
  misc_feature (950)..(950): n is a, c, t, g, unknown, or other
  misc_feature (965)..(965): n is a, c, t, g, unknown, or other
ctccccgcggtggcggccgctctagaactagtggatcccccgggctgcaggaattcgtctcacccctagaaaaatttattgaggaacagagctggttttccaaaagaaaaaattctgctttgattttccataaagaaaacctctcagcctctttcgtctagctccatcatagctgtagtcctaatggccgcgaccatcgagatgtacaagtacgacaataccagcgaacaaggaatccactcctcatccccctcggatcaggagctcgcgaaagcactcgagccttttataacgagtgcttactcctcttcatcctcctccccctaccatggctactcgtcctctacatccatgtcccaagattcttacatgcctacaccctcttacaccagctacgcgacctcggatcttcccactcccgccgacgcctcctcctagcagcttccgccactctactgatcgccttatgcggagccgtggatggccggcctgatggggctgaaccagatcaggccggcccagatccagcagatccagagccagttcatgttgcagcagcagcagcagaagacgaggggcctgcacacggcgttccggggcccgcgggcgcagccgatgaagcagtcatggtcgccttggccaggcgcctcgtctaaagccggcgcattctaaactgtaccacgacgtgcggcagcgccactggggccagtgggttggcggatatccggctctcaaacaacgacacgcggatgtgggctgggcaccttctacaccgtggaagaacgggggcctcggctactacaaggggggcttccagactccggggggatacggagaggctaaatttcccgggccttccggcgcggtggcaacaaccttgccgggcctttgtagaccttcctggaaagcacaaatgaacggcctctggcagtgcccgttccgaatgcaantacaagaagcgtgcn

SEQ ID NO: 77208 - DNA, 845 bp, Zea mays
  misc_feature: Ceres CLONE 1562114
  misc_feature: Encodes the peptide sequence at SEQ ID NO. 77209
  misc_feature (1)..(1): n is a, c, t, g, unknown, or other
  misc_feature (2)..(2): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (30)..(30): n is a, c, t, g, unknown, or other
  misc_feature (37)..(37): n is a, c, t, g, unknown, or other
  misc_feature (44)..(44): n is a, c, t, g, unknown, or other
  misc_feature (54)..(54): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
nngggaattggggtnnannnnnngatgganaggggcnaacaacnaacagagagnacnnnnncnnnnnnncccaannnnnaaagctggagctcccccggtggcggccgctctagaactagtggatcccccgggctgcaggattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagcccggcggccgagcttcccggcagccccccgtgggtaacgggccccccaaacccgcctgggcttcctaccctgggggccccccccctttttcccggggggggggcccccccccgaaaagccttacccctggaaaacggggggccaaaaaaatttttccccccccggggggggggaaaaatttaacccgggggttttttggggggaaaaaaaaaccccccctccggggggggggggccttttttttttttttggggggcccccaaaaaacacccccccccggaaaaaaaaaaaaaccctttttttttcccccccccaaaaaaaaaaaaacaccccccggggggaaaaaaaccttgtttggaaaaaaaaaannnntaaaaaattttcccccaattttttccccccccccccttttgtggggggggcgcccccccaaaaagggtcctggggggggggggcccccccccccccttttttttgttggggggggccttttttttcaccaga

SEQ ID NO: 77209 - protein, 208 aa, Zea mays
  misc_feature: Ceres CLONE 1562114
  misc_feature (164)..(164): Xaa is any aa, unknown, or other
  misc_feature (165)..(165): Xaa is any aa, unknown, or other
MASSTMALSSTAFAGKAVNVPSSLFGEARVTMRKTAAKAKPGGRASRQPPVGNGPPKPAWASYPGGPPPFSRGGGPPPKSLTPGKRGAKKIFPPPGGGKNLTRGFFGGKKKPPLRGGGAFFFFLGGPQKTPPPGKKKKPFFFPPPKKKKTPPGGKKTLFGKKKXXKNFPPIFSPPPLLWGGRPPKKGPGGGGPPPPLFFVGGGLFFHQ

SEQ ID NO: 77210 - DNA, 828 bp, Zea mays
  misc_feature: Ceres CLONE 1562116
  misc_feature: Encodes the peptide sequence at SEQ ID NO. 77211
  misc_feature (36)..(36): n is a, c, t, g, unknown, or other
  misc_feature (60)..(60): n is a, c, t, g, unknown, or other
ctcaccgcggtggcggccgctctagactagtggatnccctgggctgcaggaactcgtctncaccctagtttatttcgtcgaggagcttccggggggcagagcagggcaggggagggggaggggagagaagaaggctcctgcttgcgtaagcgaccaagtcgttcttccaaggaaacgaaggggaagggaagggcagggagggcgacagaggctgatcggagctcatcatcgttcgatggcggtgaccgcgacgacggtcgcggcggcgaccacgatgctggcggccgtggcggcggtcttcctgaccctggtgctctgcttctacgtcttcctctgcgccaagcggtaccgcggcaaggcgccgccgcacgcggtggccgcctgcggcggcggcggcgtcagggccgtgtctgcacatcatgtttcgggttctgggggagcgccaggcgcgcacgttcgggctgcggcacagaatggtgcccacgaacggccggcttcgtcgaaaaatcgaatggggaaatctgcccccgggggggaaggttgcgcctgggccgaactaagccggacggaactgcgcccatggggctctaccgaagactggcgcccggggggaaaaccgccccaccatgcctgccctggggggggggaaacacccttcaaagatgaactggcctataaaatatgggatccccggcttccaattgcaatcagtgcaccacctaaaaactggtgcccccccctcttgaaataaacgcctctgttgtccgggcctggcttggtccaccacccccgggagaaacaatcccggggaatccgccacaaactttg

SEQ ID NO: 77211 - protein, 171 aa, Zea mays
  misc_feature: Ceres CLONE 1562116
MAVTATTVAAATTMLAAVAAVFLTLVLCFYVFLCAKRYRGKAPPHAVAACGGGGVRAVSAHHVSGSGGAPGAHVRAAAQNGAHERPASSKNRMGKSAPGGEGCAWAELSRTELRPWGSTEDWRPGGKPPHHACPGGGETPFKDELAYKIWDPRLPIAISAPPKNWCPPLLK

SEQ ID NO: 77212 - DNA, 1226 bp, Zea mays
  misc_feature: Ceres CLONE 1562117
  misc_feature: Encodes the peptide sequence at SEQ ID NO. 77213
  misc_feature (872)..(872): n is a, c, t, g, unknown, or other
tccttctctttttttttcgggcgtacttattctttcacccctgcattattgtgtacacctctcaatactggagctcccgcggtggcggccgctctagactagtggatcccccgggctgcaggaattcgtctcacccctagaaaaatgctgcggcagacgctctactccaccacgcggatggggctgtacgacatcctcaagaccaggtgggcccgggagaacggcggcgtcctcccgctgcaccgcaagatcttggccggcctcgtcgccggcggcgtcggcgccgccgtgggcaacccggccgacgtggccatggtgcggatgcaggcggacgggcgcctgcccctcgcggagcgccggaactaccgcggcgtcggcgacgccatcggccggatggcgcgcgacgagggcgtgcgcagcctctggtgcgggtcctcgctcaccgtcaaccgcgccatgatccccaccccgtcgcagctggccacgtacgaccaggccaaggaggccatcctggcgcgccgcggcccgggcgccgacggcctcgccacgcacgtggccgccagcttcaccgccggcatcgtcgcccgccgccgcgtcccaaccccgatcgacgtcttccaagaccaaggatgcatgaacatgaaaggtgggcgccccggcgacgcccccccacccttacgtccgggcgacccgtcgtaactggcgccccctcaaagaaccgttcccagggtcccggtagggcgaaccctattgggcccgcctgttaaccaaatagtgcggtgttcaattctcacccaccccccgttgagatatggccgccactatgggggggcccccctctctccaaccacgggtggggtggcgcttctctntcccgttcccccgccctccccaaactccagtgatgtgcccccattagggttccttcccaaagggggccgcctctttaagttctccgcaagcaatcccggtcccccacttaatgtaatcgagttgtgaatggatccacattatcctataccgtcctggcttctcgaccatatatttcggtatcacggcgctgtctcgagctgctccaagggaatattattcaaccccgtctggccatcccttataagggcgcggtctacatttctatattgaccctcctcattggcttggctatgtgcgcccccgcgcgctagtaactgtggcgatcctagctccctcacactagaatccgatgg

SEQ ID NO: 77213 - protein, 184 aa, Zea mays
  misc_feature: Ceres CLONE 1562117
  misc_feature (31)..(126): Pfam Name: Mito_carr Pfam Description: Mitochondrial carrier protein
MLRQTLYSTTRMGLYDILKTRWARENGGVLPLHRKILAGLVAGGVGAAVGNPADVAMVRMQADGRLPLAERRNYRGVGDAIGRMARDEGVRSLWCGSSLTVNRAMIPTPSQLATYDQAKEAILARRGPGADGLATHVAASFTAGIVARRRVPTPIDVFQDQGCMNMKGGRPGDAPPPLRPGDPS

SEQ ID NO: 77214 - DNA, 842 bp, Zea mays
  misc_feature: Ceres CLONE 1562118
  misc_feature: SWISSPROT Homolog: EC 4.1.2.13 Fructose-bisphosphate aldolase
ggagctccccgcggtggcggccgctctagaactagtggatcccccgggctgcaggaattcgtctcacccctagaaaaacagactgtaacgcttcttcccagcaccaacatgtcctgcgatcttcttagccaccgcggcgtcgagtatccatgatgtcggcctatctgcgttagagtaataggatgagctcattgcgaatgctgcctaccttggaacttctggggagggtattcttgctgctgatgagtccattggcacgcttggacagcgcctttccagcatcgaggctgagaagcttgaacagaacggccgtgccctccgtgagctcctattctgatgcgatgatgctctggactacatcaccggtgtgatcgtcggcgaggacacccagttgccgagaaccaagatggaacgtcttctgctgatgtctcccggatggaggcctactagctggacatcaagttcgacgcgctaccggtgatgtagaaggcactgaaagcgagaacaccactggatgccaggacgacctagtatagcgctgctgcaatgactgataggcaagtgcccactctctcaaatggcacgctgggctacagattggccataacgaccagcgctgcttgacatcagcttgatgcacaaggtgctgctcgctacggagtctctgtcacgatgatggactcgtacaattaatcaacctgagatctaagagacggcttccctgcgtagatcgctagactacatcctgtaacgctcttgcggtctgccacgagcgatgaatagcacgtgatcctcttgcatgtaccctactgaaggcgattagcgactccagactctaaatc

SEQ ID NO: 77215 - DNA, 948 bp, Zea mays
  misc_feature: Ceres CLONE 1562121
  misc_feature: Encodes the peptide sequence at SEQ ID NO. 77216
  misc_feature (805)..(805): n is a, c, t, g, unknown, or other
  misc_feature (806)..(806): n is a, c, t, g, unknown, or other
  misc_feature (847)..(847): n is a, c, t, g, unknown, or other
  misc_feature (848)..(848): n is a, c, t, g, unknown, or other
  misc_feature (879)..(879): n is a, c, t, g, unknown, or other
  misc_feature (886)..(886): n is a, c, t, g, unknown, or other
  misc_feature (887)..(887): n is a, c, t, g, unknown, or other
acccgcggtggcggccgctctagaactagtggatcccccgggctgcaggaattcgtctcacccctagaaaaggagaagctaagctgtcttctaactctctctcgagttcatagtttttgctcttcctctctcatggtcacaatgcttgcagctagttctctagtgaacagcaacctcgcttgctcatcaaggatatcatcctgttcagacttcacatatagccactcctggcgtcccatacatgctatgaaactccatcagatgcgtgctgtgagctcaatacgtataagttgtgctgccactaaacctgcaaagactcctgccgaagaagaatggaaagttaagcggcaactgctatcagaaaagcgggtacgaagtgtcgatgtgaaggaagcactgcgccttcaaaaggaaaacaactttgtcattcttgatgtcaggccagaagcagagtttaaagaggctcatccacctggcgccatcaatgtacaaatatacagattaatcaaggaatggacagcgtgggatattgcgaggcgtgcagcgtttgcgttcttcggcatatttgctggaacagaagagaatcctgagttcatacagagtgttgatacgaaggttgggaaagatgcgaagataattgtggcatgctctacaggagggacactgaagccaacgcaaaatttccctgatgggaagcaatctcggtccctgatagctgcgtacctgttggtcctgaatggctacagcaacgtgtaccatctggaaggaggactttacacatggttcaaagaaggactaccagctnngtgcagagaagagtaagagagacattacgacatagtgttcnncatgctgaaagagtggagaagtgaaaactanagttgcnnagaaactgtagtgatgtgcttgctcacagtcaccaggttgttcgattgttgtgttacggat

SEQ ID NO: 77216 - protein, 229 aa, Zea mays
  misc_feature: Ceres CLONE 1562121
  misc_feature (85)..(220): Pfam Name: Rhodanese Pfam Description: Rhodanese-like domain
  misc_feature: SWISSPROT Homolog: EC 2.8.1.1 Thiosulfate sulfurtransferase
  misc_feature (225)..(225): Xaa is any aa, unknown, or other
MVTMLAASSLVNSNLACSSRISSCSDFTYSHSWRPIHAMKLHQMRAVSSIRISCAATKPAKTPAEEEWKVKRQLLSEKRVRSVDVKEALRLQKENNFVILDVRPEAEFKEAHPPGAINVQIYRLIKEWTAWDIARRAAFAFFGIFAGTEENPEFIQSVDTKVGKDAKIIVACSTGGTLKPTQNFPDGKQSRSLIAAYLLVLNGYSNVYHLEGGLYTWFKEGLPAXCREE

SEQ ID NO: 77217 - DNA, 1333 bp, Zea mays
  misc_feature: Ceres CLONE 1562123
tggaagagaggaaaaggcccttcactggtgggattgacacgggcgttgcctggggggggcggggttgggaaactgggactccccgcggtggcggccgctctagaactagtggatcccccgggctgcaggaattcgtctcacccctagaaaaaacgcgagtctccccatcttcttttcctcgcttgccctaattccgcatccccggctgaggcagcagcggcggcgccggcagcggcaccggctcgccagcgattccagcaagaatggggatgtacagtcccgcgtactacccccccaggagaggatatgtgtagccggggaatgaacccacctcctaggagaagatttggcgctggccttggtggaccaaggactctgtgcaggttcccggatcgctaatattacattgatactctggtctagaagaacgtatattttccctttccaaccataaaaccctgtgctagcatgctcttgcttggtgagcgaatgatcccacctgtgcaacgcccattagtatttgggtatcggtgggagagccttagaacgttgatagaagtcgttcaggacgcagtttcttcctgtgtgaaattcggaagatggctctttctctgcccgtgtatgtgcactacctcgttccctccttgtttggggatttgcactgtcctaaaagaggtgatcacttgactttctctggcctatccattagcctacgggcgcgtgcaagggggtcatggtgctcccgcctcatcgcatatggatgtacattggtgtagagcatatgagaccgatggataccgagtccttgctaacccgccgaagctttaattacacgcagctcatgaattctctagggctcggcgtcgttctctccctggatagagtcacgcacgccgtatagcgattcaccctggtacagtgtaccgtagaagagtcgcgctgagttagtatcagcacgttctttcggtatcgaagtgctactccatcctccatgcgcgcgccttgagttactcctgcaccgccatccgtgtcctcctcgctgatgccgcgtgcgatagttaggattcattttgacaagaatctatatccgcggagatgtgtctgatcgaggcatgcgatacgatcacgtcgatctatcaccaatatgttcaacccctcaagctagtgattcctcgtttgcctgtatatctgaactcgtcatggagccgattcctagatagtactcaacccatgctggcacttttatcctatcctgcgttgaaacaatggatatctcttacggaatgtgctagcaccaccgtataatcacgtctccagagtgttgtctcctacc

SEQ ID NO: 77218 - DNA, 842 bp, Zea mays
  misc_feature: Ceres CLONE 1562127
  misc_feature: Translation starting site: 137
  misc_feature (463)..(463): n is a, c, t, g, unknown, or other
  misc_feature (842)..(842): n is a, c, t, g, unknown, or other
ctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcngttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggccttgcaggtcgtgctcatgggcgccatcgaggggtaccgcgtcgccggcgcccgctcggagaggtcgtcgacccgctctacccggcggcagcttcgacccgctcggcctcgccgacgaccctgagcctcgcggagctcaggtgaaggagctcagacgggcgcctcgcatgtcttcatgttcggggtcttcgtccgccatcgtcacggcagggccgctcan

SEQ ID NO: 77219 - DNA, 819 bp, Zea mays
  misc_feature: Ceres CLONE 1562128
  misc_feature: Encodes the peptide sequence at SEQ ID NO. 77220
  misc_feature (518)..(518): n is a, c, t, g, unknown, or other
  misc_feature (552)..(552): n is a, c, t, g, unknown, or other
ccccgcggtggcggccgctctagaactagtggatcccccgggctgcaggaattcgtctcacccctagaaaaagcgggtgagccggggaccctcctacgtctcgccaccctgctggtatagcccgccggtcgtccacgccatggccacccaatatgcgcggctctccctgccatgccgcctgccctcgccgctccctccgccggtgccgacgacgacccgccggctgccgcgcgccgcggcggcggcggcgtccacctccccgcggtgcccacgcgtcgggggcgcggcggccacgcgcgcccgcggcccgtgccggcctcgcgcctccgagggcgaagtgcagcagcaggaggcggaagcggaccaggtggtggacagcaacatgctgccctactgcagcatcaaccgcaaggagaagaagagcatcggggagatggagcaggagttcctccaggcgatgcaggccttctactacgaaggcaaggcgatcatgtcgaacgaagagttcgacaacctcnaggaggagctcatgtggggaagggagcagcgtcntgatgctaagcccagatgagcaaaagcttttgggaaagcccccatggcgtatgtcttcggcaacccccctcatgaccggatgatgaatttcgatcaactaaagcctgaaacttaagaaaaaaggaaagcgaccttgttaccggaaagggccccaaaatccacccctacggaaatcaaaaagggcctcaagggaactttgaccgggttgaacaccttggaaaaaagtgtcgcccccaaaaagttcccccccccccgtttttaaacccc

SEQ ID NO: 77220 - protein, 143 aa, Zea mays
  misc_feature: Ceres CLONE 1562128
  misc_feature (127)..(127): Xaa is any aa, unknown, or other
  misc_feature (138)..(138): Xaa is any aa, unknown, or other
MATQYARLSLPCRLPSPLPPPVPTTTRRLPRAAAAAASTSPRCPRVGGAAATRARGPCRPRASEGEVQQQEAEADQVVDSNMLPYCSINRKEKKSIGEMEQEFLQAMQAFYYEGKAIMSNEEFDNLXEELMWGREQRXDAKPR

SEQ ID NO: 77221 - DNA, 838 bp, Zea mays
  misc_feature: Ceres CLONE 1562129
  misc_feature: Encodes the peptide sequence at SEQ ID NO. 77222
  misc_feature (666)..(666): n is a, c, t, g, unknown, or other
ctccccgcggtggcggccgctctagaactagtggatcccccgggctgcaggaattcgtctcacccctagaaaaaattccggtccgagagccgaaaactccactgctttcatcaactccggcgacttggagaagacgaagttccagaatccgatcggaagtttggtgctcgcgccttgacggattgatttcggtgcgccgatggggcaggcgttccgcaagctgttcgattccttcttcggcaccagcgagatgagggttgtgatgcttggtctggatgctgccggttaaaccaccatattgtacaagctgcatatcggggaggttttgtcgactgttcccacgattggtttcaacgtccagaaaggtcaatacaagaatgtgatgtttactgtgtgggatgttggtggccaagaaaagttgaggcccttgtggaggcactacttccaccatactgatggcttgatctacgtagttgattccttggatcgggagagaattggaaaagccaaagctgaatttcaggcaataatcaaagatcctttgatgcttaacagtgtagtactggtacttgccaataagcgagatatgagaggggcaatgacaccaatggaagtgtgatgagggtcttggcctctacgatttgaagaacggattctggcacatcngagggtcttgtgcgcttcaatgtgatgtgctgtatgagggcttggactggctggcaagacactggaggaatgcaagcctcagggtctctgcatctggaggggacatcgtgttcttagtagaagcctggctgtagattcttcggctggtacaatgatatgggttctagtcgtt

SEQ ID NO: 77222 - protein, 78 aa, Zea mays
  misc_feature: Ceres CLONE 1562129
  misc_feature (2)..(79): Pfam Name: Arf Pfam Description: ADP-ribosylation factor family
MFTVWDVGGQEKLRPLWRHYFHHTDGLIYVVDSLDRERIGKAKAEFQAIIKDPLMLNSVVLVLANKRDMRGAMTPMEV

SEQ ID NO: 77223 - DNA, 903 bp, Zea mays
  misc_feature: Ceres CLONE 1562132
  misc_feature: Translation starting site: 149
  misc_feature: SWISSPROT Homolog: EC 1.11.1.7 Peroxidase
  misc_feature (398)..(398): n is a, c, t, g, unknown, or other
ctggagctccccgcggtggcggccgctctagaactagtggatcccccgggctgcaggaattcgtctcacccctagaaaaaacgcctctcttgctcaccattctcttctaaccggccaagccaaggcgcatctagcgagctgagcagcaatggtggctgctacttcttctaggcgccctgcaggtgctctgctggtcctggcagcagccgacgtggccctggcggcccagggggccaggtacccgccgctggcgccgggcctgtccttcgacttctacaagaagagctgacccaaggcggagtccatcgtgcgggagttcctggcgtccgcggtccagcagaacgtgaggctcgccgcggcgctgatcctgctccacttccacgactgcttcaaacacncctacgacgcctccatcctgctggacgccacgacccacccagcccagcgaggcagcagtcgccgcccaagctcacactccgacccgccgcgttaaaggtcgtcaacgatatccgcgcccggctcgaccaggcctgcggccgcgtcgtctcctgggccgacattggcgcgctcgccgcacttgaatccgtagccctgggtggcgggcccggcgtacaagatgccaaagggtaggcggcaacgggctggcgcccggaatctaaacgccaccgtccctagcgggggcttcccaccgccgaaaatccaagggggcccacgctttcctggtccttcctggggaaagatacaaccctgaacttggacggaaccttggtggggcctgacctgggggggcaacacgggggggggcaatctggggaacttgtaaggttccctttctagaaaaaccgggtggtttcccggaccccagggaacccgggaaccctttaaaaaaaattgtctttccgg

SEQ ID NO: 77224 - DNA, 899 bp, Zea mays
  misc_feature: Ceres CLONE 1562133
  misc_feature: Encodes the peptide sequence at SEQ ID NO. 77225
  misc_feature (143)..(143): n is a, c, t, g, unknown, or other
  misc_feature (144)..(144): n is a, c, t, g, unknown, or other
  misc_feature (380)..(380): n is a, c, t, g, unknown, or other
tggagctccccgcggtggcggccgctctagaactagtggatcccccgggctgcaggaattcgtctcacccctagaaaaaccgcctctactgtagccacggcccttggttcccctccattattcgacctcaccttgccaccagnnccatggctgccgtgaccgccgcggccatctctctgtcctcctcctccacctcctcccctgcggctgctgccaaggccaaggcggcgtccccgtcgtcgtcgccatgcaggcacctccagttcctgtcggcggcgagcccgcggcggcggtggcgggccggcgcccgcgcggtgcgggcgcaggtgtccaccaccgagaccgcggcggcggggccggcgaagacgtccaagaagcangacgaggggctggtcaccaacaagtacaagcccaaagagccgtacgtccggaaggtccctgttcaaacaccaggatcaccggcgaacaacccgcccgggggaaaactggccccatggcccttcaacaaccaaaggcgaaaatccccctataaaaaagaggggaaagccaatcggggattattcctcgaatgggggaaaaaaaaaaaaacgggaaacccccccaaaacctccggggtttaaactcccctgccccaagaaggcccccccccgagaaatttcggggaaaaccccaaaaaaggggggcccctttttgggtgaaaaaagggttttttcccccccaaaaataaaagggggggaaatattgccaaaaaagaaagcctccccaaaaattcccccgggggggataatataaaaaaaacagcccgcccctgttgttaaaaataccccccccccaactggggaaaaaaaaaaaaaatttttctcccccaaaaaaaaccccctgtgtagatattttttttt

SEQ ID NO: 77225 - protein, 157 aa, Zea mays
  misc_feature: Ceres CLONE 1562133
  misc_feature: SWISSPROT Homolog: EC 1.18.1.2 Ferredoxin--NADP(+) reductase
  misc_feature (78)..(78): Xaa is any aa, unknown, or other
MAAVTAAAISLSSSSTSSPAAAAKAKAASPSSSPCRHLQFLSAASPRRRWRAGARAVRAQVSTTETAAAGPAKTSKKXDEGLVTNKYKPKEPYVRKVPVQTPGSPANNPPGGKLAPWPFNNQRRKSPYKKEGKANRGLFLEWGKKKKTGNPPKTSGV

SEQ ID NO: 77226 - DNA, 790 bp, Zea mays
  misc_feature: Ceres CLONE 1562135
  misc_feature: Encodes the peptide sequence at SEQ ID NO. 77227
acccgcggtggcggccgctctagaactagtggatcccccgggctgcaggaattcgtctcacccctagaaaaagttcccaaatcccggtgcccctccacccgcactccattggcgccgctcccctcccctcgccgccgccggagatctgatccgatccgatccgatccgtttgtgcttgtgctgcagcaggagtgagaagtaaaaaaatatggctgccctgccactggccaccgccgaagtatgcgacgctaaccctcacctgatcatgaacggcgagctccgcgcgctccagccaatcttccagatctacggacggcgccaggtcttcgccggccccatcgtcacgctcaaagtctacgaggacaacgtcctgggtccgcgagttccctcgagggagaaaggccacggtaggggtccctcgtggtcgacgggcggccggcagcatggcgctggcgccatcccttggcggcaaacccccgtccaggcagggcggcagaaacaaacggggtggggctggggtatcccggggtcaaacggggctgcattcaggggaacctggggattaaaaattcaacgggggtgggaaaaatttcgggggggcccggggggttcttaagggttcgggccccccctttggaaaagggcccaaccaaaaaaaagggggaattggggccgaaaaaaaacaaaaatttcccccccggttaaaaaaaattggggtgggggaaaacccggaaaatttttccccaaacccggccaaaaggggggtttcttctccccccccaaaaatccc

SEQ ID NO: 77227 - protein, 135 aa, Zea mays
  misc_feature: Ceres CLONE 1562135
MAALPLATAEVCDANPHLIMNGELRALQPIFQIYGRRQVFAGPIVTLKVYEDNVLGPRVPSREKGHGRGPSWSTGGRQHGAGAIPWRQTPVQAGRQKQTGWGWGIPGSNGAAFRGTWGLKIQRGWEKFRGGPGGS

SEQ ID NO: 77228 - DNA, 760 bp, Zea mays
  misc_feature: Ceres CLONE 1562136
  misc_feature: Encodes the peptide sequence at SEQ ID NO. 77229
  misc_feature (462)..(462): n is a, c, t, g, unknown, or other
  misc_feature (532)..(532): n is a, c, t, g, unknown, or other
  misc_feature (533)..(533): n is a, c, t, g, unknown, or other
ctccaccgcggtggcggccgctctagaactagtggatcccccgggctgcaggaattcgtctcacccctagaaaaaatctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacatccntgacccttatgtgatcaatcgagtcctgaacagaagtatggatgtatgttcccttacttctgatgactcnnttcatcccctgatgacccccgaagatcggtgggaagtattcaactcccacattgaaattcttacttcaatccaaggccggatccctcgccttgttacccgagggaatttttttggccttttccaagcaaggggaaaatttgggggaaggggggggctggggtttcctcccagggccccgggggggaagggtgttctcccccccctttttaaaaaaaaacaggggggg

SEQ ID NO: 77229 - protein, 118 aa, Zea mays
  misc_feature: Ceres CLONE 1562136
  misc_feature: SWISSPROT Homolog: EC 2.7.7.9 UTP--glucose-1-phosphate uridylyltransferase
  misc_feature (115)..(115): Xaa is any aa, unknown, or other
MAATAVSVDEKLDKLRAEVAKLSQISENEKAGFISLVSRYLSGEAEQIEWSKIQTPTDEVVVPYDTLTSPPEDLEETKKLLDKLVVLKLNGGLGTTMGCTGPKSVIEVRNGFTSXTLM

SEQ ID NO: 77230 - DNA, 776 bp, Zea mays
  misc_feature: Ceres CLONE 1562140
  misc_feature: Encodes the peptide sequence at SEQ ID NO. 77231
  misc_feature (763)..(763): n is a, c, t, g, unknown, or other
tggagctcaccgcggtggcggccgctctagaactagtggatcccccgggctgcaggaattcgtctcacccctagaaaaattttctccactccgctctctcaaactccccggctccccgctctcccccgcccgtccagctcgtgctccgcctccgctgctctgccctcttcctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtaccgcggctccccgnccggccgcgttcg

SEQ ID NO: 77231 - protein, 179 aa, Zea mays
  misc_feature: Ceres CLONE 1562140
  misc_feature (24)..(89): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature (176)..(176): Xaa is any aa, unknown, or other
MPDSDNESGGPSNAEFSSPREQDRFLPIANVSRIMKKALPANAKISKDAKETVQECVSEFISFITGEASDKCQREKRKTINGDDLLWAMTTLGFEDYVEPLKLYLHKFRELEGEKAATTSASSGPQPPLHRETTPSSSTHNGAGGPVGGYGMYGGAGGGSGMIMMMGQPMYRGSPXGRV

SEQ ID NO: 77232 - DNA, 1035 bp, Zea mays
  misc_feature: Ceres CLONE 1562141
  misc_feature (420)..(420): n is a, c, t, g, unknown, or other
tcaccgcggtggcggccgctctagaatagtggatcccccgggctgcaggaattcgtctcacccctagaaaaatccctacccctacgagtatccaagtccaaccagcaagaggggaggcgctgcacgcaggtcacgcggcgatggacatatgcgatgtttgagcaggcggtggcagatttctgctggcatgccaaggaaagagtggcctcaggggatggggctcttgggttggcccttggggccacctgggccgttcgggtttgggttccgcgtcccccgcccaaggaggtaccccccggggcgtcaacccaaaaaaatatcctggccttctttcctgggacctaccaatggccttgggtgtccccccccccccccaaattttaaaccttggggggggggcccccccccaccccaaacaanttttggaaaacctggaaaagaggggcccccccactttaaagggggaagcccccccccaaaaaaaggggtcccccaaaaccccccaggggggaaccctcttttttgggaaaaagggtgccccctgggaggggggtttttggatcttttccggtcggggagagattttttgccaggggggggctgcctcaaagttttttttcccacacacaaaatatatttgggaaaaccctcccccctttaaaaaaaaaaattatgtgggggggtatatttgggggggtgtggtgcccttcttttcacaaaatgttttttctcgtgggaggggggaaaattttgtgaattcttcaactttctctccacgacaacaaaaaaaataggtgggcggccgctatctttttttgttattataaaaaaaaactcccccctctttgccacaagaaaaaaagaagaaaatggatcttttttctccaaaaacacacaaaatttgtttgtcgtggcgggagggtgagactttatacctgatgttttttttgttcccgccccgccttttaaaacaaaaaggtggggggggggagcacttgttgtggggggtcctaccccctgtactacacataaggg

SEQ ID NO: 77233 - DNA, 826 bp, Zea mays
  misc_feature: Ceres CLONE 1562144
  misc_feature: Encodes the peptide sequence at SEQ ID NO. 77234
ctccccgcggtggcggccgctctagaactagtggatcccccgggctgcaggaattcgtctcacccctagaaaaaaccagctcaaagctgaacgcggcatccttcctttcctcccctcttctgcccccatttcgttcctttcacaccggggaccggcgagcagagccgcgcacagcagaacgcggaagcaagaggaggcgatcgactactcgaccagccctctccgtgtctccgatggcggctcgcgtcctcgcggccctcgcccttgccctcgccctcgccctcgtcgccgtacccgctcccacgcgggcgtccaacgacgagggggacgcgctctacgcgctgcggcagcggctgtcggacccccaacgcgtgctgcagagctgggatcccacgctcgtcaccccctggacctggtttcacatctcctgcgaacaggtcggccgcgtcgtccgcctggactggggcactccaacgtcttcggctccatcgggcctgaggtcgggcggcttgtccacctccaagagctgtacaggaacaacctttgacggggagatcccccaaggattggggcaccctcaagaactgatccagcttggggtctgtatgcccacaagctcaccgggaggaatccccaagtcacttttcccaggtcgactccctccgaaatcatgcgccttgacaacaacaggctttcaggatcaatttcccagggaggtttgccaggctttccaacctgaaaggtaatccatttgtgctaacaatgtgttctgggggaaaaatcccccggttgatggggccttttttcaacttttccccttccgaag

SEQ ID NO: 77234 - protein, 170 aa, Zea mays
  misc_feature: Ceres CLONE 1562144
  misc_feature (27)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MAARVLAALALALALALVAVPAPTRASNDEGDALYALRQRLSDPQRVLQSWDPTLVTPWTWFHISCEQVGRVVRLDWGTPTSSAPSGLRSGGLSTSKSCTGTTFDGEIPQGLGHPQELIQLGVCMPTSSPGGIPKSLFPGRLPPKSCALTTTGFQDQFPREVCQAFQPER

SEQ ID NO: 77235 - DNA, 830 bp, Zea mays
  misc_feature: Ceres CLONE 1562145
  misc_feature: Translation starting site: 247
  misc_feature: SWISSPROT Homolog: EC 2.7.11.1 Non-specific serine/threonine protein kinase
  misc_feature (652)..(652): n is a, c, t, g, unknown, or other
  misc_feature (716)..(716): n is a, c, t, g, unknown, or other
ggagctccccgcggtggcggccgctctagaactagtggatcccccgggctgcaggaattcgtctcacccctagaaaaaagaggaggcacaagagcgccatacatacacaaacagcgtacaagactcaaccactccctccttgtttgtttatataccttggcaccaccaaggcagcaccctgtaaactaaccaccaaagccgaagaaggcggcttgccctgcccgccgccttggtgccgcgcgcgccatggccaagagcaagtcgtccgccaaggccggccccccgctcctcggcaagtacgagctcggccacctcctcggccggggcaacttcgccaaggtataccacgcgcgctgcctcggcggaggcgaccccgtggccgtgaaggtgctggacaaggccgggctggccgccacgggcatggcgtcgcggctcctgcgcgaggtgtccgccatgcgccgcctgagccaccccaacgtgctccgcctccacgaggtgctggcgacgcgctccaaggtgtacctcgtgatggagctggccccgggcggggacctcctgtcccggctggcgtcgctgccgtcccgcatgctccccgagcacgcgtcgcggcgcgtgttcctccagctggcgtcggcgctcatctacagccacngcgcgcggggtgttccaccgcgacgtgaagccgcagaacgtgctgctggacgccgaggcaaccntcaaggtgtccgacttcggcctcgcggcgctcccggactcggtccgcgacgacggggcgcttgcacacggtgtgcggcaccccggcgttcgcgggcgccccgaggtgctccggg

SEQ ID NO: 77236 - DNA, 857 bp, Zea mays
  misc_feature: Ceres CLONE 1562148
  misc_feature: Encodes the peptide sequence at SEQ ID NO. 77237
tacccgcggtggcggccgctctagaactagtggatcccccgggctgcaggaattcgtctcacccctagaaaaatcccctcccctccccatctcgctcttgcggagatcgaagagaagctgaggcctagcgccgcacccgccgccgcatcagccatcagccatgacgctggccgctcgcctcgtctcgcgctcccgtcagctacattcggttcaagctgcttttgcgaatggaggtgccactcaagttcgctcctttgccaaggatgcagctccagctgaccgccctcctgttagtggggatgatctcctgaagggcatattctttgaggtaaagaagaagtttgagacagctcttggcgtccttaaaagggaaaagattactattgatccagatgacccagcggcagtttctcaatatgctcaagtcatgaagactgtaagggaaaaggcggatcttctttctggttctcaaaggattaaatataccattgagaccttcaccaagggcatccctgatgcacggacttacttgaatactcttcaacagctcagaataaagagtggtcttatagatcatattggaatcgaacctttgatgatggaagctcttgagaagattgagaaggatattaagaaaccacttttaaggagtgacaagaagaacatggccaccctttatgggagagtttgacaagattaacgcaaaagcttggcatttggaaaaggaggatcttccccaaaaacgaaaaaagaacttggatttgggaaattgcccaaaagtgggagctgactggaacttaaaagaagaaaggtgtttgaaaccataggggaaaacccaactttagagaggggagggg

SEQ ID NO: 77237 - protein, 176 aa, Zea mays
  misc_feature: Ceres CLONE 1562148
MTLAARLVSRSRQLHSVQAAFANGGATQVRSFAKDAAPADRPPVSGDDLLKGIFFEVKKKFETALGVLKREKITIDPDDPAAVSQYAQVMKTVREKADLLSGSQRIKYTIETFTKGIPDARTYLNTLQQLRIKSGLIDHIGIEPLMMEALEKIEKDIKKPLLRSDKKNMATLYGRV

SEQ ID NO: 77238 - DNA, 833 bp, Zea mays
  misc_feature: Ceres CLONE 1562152
  misc_feature: Encodes the peptide sequence at SEQ ID NO. 77239
  misc_feature (573)..(573): n is a, c, t, g, unknown, or other
  misc_feature (662)..(662): n is a, c, t, g, unknown, or other
ggagctccccgcggtggcggccgctctagaactagtggatcccccgggctgcaggaattcgtctcacccctagaaaaaagaccgcaccgcggccacagcctcgcgtcgtcgccccacagccacgcgagccttcgccgatccgcgagcgcagatcgccgaagccaggcggcggagagggagctcgaggcggcggaggaaggcgttcgccacagtcgctgatttccctggggaagagatggggctctcctttggtaagctgttcagccgcctcttcgccaagaaggagatgaggattctcatggtcgggctcgatgccgccggtaagaccaccatcctctacaagctcaagctcggcgagatcgtcaccaccatccccactatcggattcaatgttgaaactgttgagtataagaacattagcttcactgtttgggatgttggtggccaggacaagatcaggcccctgtggaggcactactttcagaacacacagggacttattttgttgtagacagcaacgacagggaacgtgttgttgaggctagagatgagctccacaggatgctgaatgangatgagctgcgtgacgctgtgctgcttgtatttgcaaacaaacagatcttccaatgctatgaatgctgctgaaatactgacaagctggntctgcattccctgcgacagcggcactggtacatccagagcacttgtgctcctcctgtgaaggggtgtatgaggggcttgactggctttcagcaaatcttcagcaagtctgaagctttcggcaggctcctacccgaaagatgccgacaactaagggcgcttttttttaaaat

SEQ ID NO: 77239 - protein, 91 aa, Zea mays
  misc_feature: Ceres CLONE 1562152
  misc_feature (1)..(91): Pfam Name: Arf Pfam Description: ADP-ribosylation factor family
MGLSFGKLFSRLFAKKEMRILMVGLDAAGKTTILYKLKLGEIVTTIPTIGFNVETVEYKNISFTVWDVGGQDKIRPLWRHYFQNTQGLILL

SEQ ID NO: 77240 - DNA, 765 bp, Zea mays
  misc_feature: Ceres CLONE 1562153
  misc_feature: Translation starting site: 500
  misc_feature (391)..(391): n is a, c, t, g, unknown, or other
ctccccgcggtggcggccgctctagaactagtggatcccccgggctgcaggaattcgtctcacccctagaaaaaagttctccgcacccacccacccacccactcctttccccaacccatggccgccgccgccgccggcacccgggaggagatggtctacatggccaagctagcggagcaggcggagcggtacgaggagatggtggagttcatgaggaaggtcgcggccgccgccgagctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtaccgcgcgncgcgtggaggccgagctctccgggatctgcgcggggatcctgcgcctcctcgacgagcgcctcgtgccggcggcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcaggctcggcctcgcccctcacttctccgtcttctactacgagatcctcagctcgccggacccggcctgctcgctggccaagcaggccttccacgaagctttttcagacctgggtagtccttgggggaa

SEQ ID NO: 77241 - DNA, 799 bp, Zea mays
  misc_feature: Ceres CLONE 1562157
  misc_feature: Encodes the peptide sequence at SEQ ID NO. 77242
ctggagctccccgcggtggcggccgctctagaactagtggatcccccgggctgcaggaattcgtctcacccctagaaaaatggttggcgcccactacgacttcgtcaaagggcagttcgtcacatgggagcctccccaggacgccatcgagcgcttgacgagcgggttccagcagttcaaggtcaatgtctatgacaagaagccggagcttttcgggcctctcaagtccggccaggcccccaagtacatggtgttcgcttgctccgactcccgtgtgtgcccatcggtgaccctgggcctgcagcccggcgaggccttcaccgttcgcaacatagccgccatggtcccaggctacgacaagaccaagtacaccggcatcgggtccgccatcgagtacgctgtgtgcgctctcaaggtggaggtcctcgtggtcattggccatagctgctgcggtggcatcagggcgctcctctcccctcaggacggcgcacctgacaccttccacttcgtcgaggactgggttaagatcggccttcatgccaagatgaaggtaaagaaagacacgcctcggtggccgttcgatgaccaattgctcattctcgagaaagaggccgtggaacgtgtcccctggagaacctcaagacctacccccttcgtcaagggaagggcttgccaatggggaccttcaagctgattcggcgcccactaacgactttgttccaaggaaaagtccctcccatgggaaaaaagtgaaaaaactggggcttcggggaattctttccgggcccccccaaattcc

SEQ ID NO: 77242 - protein, 204 aa, Zea mays
  misc_feature: Ceres CLONE 1562157
  misc_feature (49)..(201): Pfam Name: Pro_CA Pfam Description: Carbonic anhydrase
  misc_feature: SWISSPROT Homolog: EC 4.2.1.1 Carbonate dehydratase
MVGAHYDFVKGQFVTWEPPQDAIERLTSGFQQFKVNVYDKKPELFGPLKSGQAPKYMVFACSDSRVCPSVTLGLQPGEAFTVRNIAAMVPGYDKTKYTGIGSAIEYAVCALKVEVLVVIGHSCCGGIRALLSPQDGAPDTFHFVEDWVKIGLHAKMKVKKDTPRWPFDDQLLILEKEAVERVPWRTSRPTPFVKGRACQWGPSS

SEQ ID NO: 77243 - DNA, 1003 bp, Zea mays
  misc_feature: Ceres CLONE 1562158
  misc_feature (1003)..(1003): n is a, c, t, g, unknown, or other
tctccgcggtggcggccgctctagaactagtggatcccccgggctgcaggaattcgtctcacccctagaaaaatagaaaaagtcttccaatgcaagtgactgcccgacccatcatgcgccaggcgaatcaaaccactacctgatttgtttaccccccgaaaatttgccgtctcctcgtctcgctcctctccctgcgcagcccccagatccggcaccgcccgctcctcgatccccgcaccccacgcccgcaggccgggacccggggggtcgcgcgccgggtaggaggaggagaaaaggaaggggcggatggcggcgcctcctgggaagggccagggccgactacgactaccttaatcagctgtctcttcatttggagaaagttggggtggggccaccaaattggcctccctggttgggggttctctttaaggggtccctttcccttacaaacttttatttaccccccaatgggggattttgcttttttaaaattcccaacccgataaaaatttgggatgggcaaagccgcgcttaaagggtttcctaatttttgggggatatagggggggggcacaaagaaaagctttttccggggacaatattttttagccccccgcgggtaaatttatcccgagagagaaacctattgtgggccctcctctttgagcggggggtttattaagactagtctccccccccaggagaaaaatcctttctttttttgacaaaccaccacctcccaacaatgcgttgtaattttgggaacattctttgagaaagaccaccccccctctgtgcgaaaagggggctaccacaagaatttattgggtgtgggggccacaaaggggccgcattagttggtctaaaaaaacctgaagagggcggttctcccctcgtggggaaaagagggcacaacacccctcttctttgtggagacccgcggaaaaaaaatttttttaaaaaacaaaagggcacaaagaacactcctttgtgggtggggagn

SEQ ID NO: 77244 - DNA, 851 bp, Zea mays
  misc_feature: Ceres CLONE 1562159
  misc_feature: Encodes the peptide sequence at SEQ ID NO. 77245
  misc_feature (769)..(769): n is a, c, t, g, unknown, or other
ggagctccccgcggtggcggccgctctagaactagtggatcccccgggctgcaggaattcgtctcacccctagaaaaagctcccgccgacaccgacgccgccactgccaccgccggcatggcgaccccgctccgcgccaccgcggtcctcgcgtggggttccggggaggacgggcagctgggcatgggcgggaacgaggagaaggactggccccacttcgttgaggcgctggggccctacgccgtcgccgccgtcgtagccggcagccgcaactccctcgccatctgcgacgacggccgcctcttcacatggggatggaaccagcgcggcacgctcgggcacccaccggagaccaagacggagagctcccctggccccgtcgacgctctcgcgggtttcaagatcgtccaggcggcgattggcgggtggcattgcctcgcagttgacgacaaggggcgcgcctacgcctggggtggaaacgagtacgggcagtgtggtgaggagcctgagaggaaggaggacgggacgagggcgctcaggagggacatcccgatcccgcagcggtgcgcgctcaagctcaaagtccggcaagtagccgctggagggacacattcagtagttttgactcaagaaagtcacgtctggacatggggacagccatggcctccgggtgatatcaagcaaatatctacacctgtacgtgtgcaagggccttgagaaagtgagggtcatttgctgtaggtgcattccataatttggcactaacggnaggatggtatttttgtgggcatgggggtaatatatgagttatgggtcagctgggggactgggagataccccaaccaagatcc

SEQ ID NO: 77245 - protein, 199 aa, Zea mays
  misc_feature: Ceres CLONE 1562159
  misc_feature (112)..(169): Pfam Name: RCC1 Pfam Description: Regulator of chromosome condensation (RCC1)
  misc_feature (59)..(109): Pfam Name: RCC1 Pfam Description: Regulator of chromosome condensation (RCC1)
  misc_feature: SWISSPROT Homolog: EC 2.7.11.1 Non-specific serine/threonine protein kinase
MATPLRATAVLAWGSGEDGQLGMGGNEEKDWPHFVEALGPYAVAAVVAGSRNSLAICDDGRLFTWGWNQRGTLGHPPETKTESSPGPVDALAGFKIVQAAIGGWHCLAVDDKGRAYAWGGNEYGQCGEEPERKEDGTRALRRDIPIPQRCALKLKVRQVAAGGTHSVVLTQESHVWTWGQPWPPGDIKQISTPVRVQGP

SEQ ID NO: 77246 - DNA, 1061 bp, Zea mays
  misc_feature: Ceres CLONE 1562162
  misc_feature: Encodes the peptide sequence at SEQ ID NO. 77247
  misc_feature (950)..(950): n is a, c, t, g, unknown, or other
ctggagctccccgcggtggcggccgctctagaactagtggatcccccgggctgcaggaattcgtctcacccctagaaaaggagaagctaagctgtcttctaactctctctcgagttcatagtttttgctcttcctctctcatggtcacaatgcttgcagctagttctctagtgaacagcaacctcgcttgctcatcaaggatatcatcctgttcagacttcacatatagccactcctggcgtcccatacatgctatgaaactccatcagatgcgtgctgtgagctcaatacgtataagttgtgctgccactaaacctgcaaagactcctgccgaagatgaatggaaagttaagcggcaactgctatcagaaaagcgggtacgaagtgtcgatgtgaaagaagcactgcgccttcaaaaggaaaacaacttttgtcatttcctgatgtcagccaagaagcagaatttaaaagaggctcatccaccctggcggccttcaatgttcaaattataccgatttaatccagggaatggaacagccgtgggattattgccgaggccgtgcaagccgttttgccgttctttcgggcataatttgcctggaaacagaaaaaaaaaacccggaagttcaattacagaaaggtttgaataacaaaagggttggggaaaaaaaaacccaaaagaaaaattttggggggccaggcccccttacggggagggggaaacccttgaagccccaacccccaaaaattttccccctgaagtggaaaaaaaaatctccggggcccccctaataaacccggcgctcaccctgttgggggccctaaattgggatcaacaacacaacggggaaccacctctggaaggaaggatactttcacccggggtttaaaaaaaaagaacaccactcctttttcgggaaaaaaaaaaataaaacactttctccaaaatngtgttccccccccgtgaaaaagggggaaggggagaaacaattttcggaagaatcttttggtgggtctttctcccaaacacaaggttttcaataattttaacaaaaataaaa

SEQ ID NO: 77247 - protein, 169 aa, Zea mays
  misc_feature: Ceres CLONE 1562162
MVTMLAASSLVNSNLACSSRISSCSDFTYSHSWRPIHAMKLHQMRAVSSIRISCAATKPAKTPAEDEWKVKRQLLSEKRVRSVDVKEALRLQKENNFCHFLMSAKKQNLKEAHPPWRPSMFKLYRFNPGNGTAVGLLPRPCKPFCRSFGHNLPGNRKKKPGSSITERFE

SEQ ID NO: 77248 - DNA, 905 bp, Zea mays
  misc_feature: Ceres CLONE 1562168
  misc_feature: Encodes the peptide sequence at SEQ ID NO. 77249
tccccgcggtggcggccgctctagaactagtggatcccccgggctgcaggaattcgtctcacccctagaaaaagtgctgacggagatgggtggcgccgccgccgccgttcttgccgtcgcagccgcacgccggaaatctggtcccttcgtatccttgttctccagggcggcgcgcaggctccacgatgctgtagagactgcagcggcggaggaggacacggcggggacgcggagtccgcggcggcggcggcggagcagcagcagcctccttcttggaccggaattccccgacacctgggacccttcatcgcgtgacacgacgccgcagtctcctccgcggtgtgcccaagctgattatgatcgcactgcatccattattgatggcaagtccaccccaaaggacatgaggttacatattgctgaagaggtctgtcaaatgaaatgttcagttggacacgtgcctggtctagctgttgttttggttggtgatagaagagattctgaatcatatgtgcgatacaaaacaaaaggctgtgaggaagttggtattaaatctttgttggcgaagttgcctggaaactgttcagaagatgaagtgatggattcagtgtccagatttaatgaggattcatctgttcatggcatcctagtgcagttgcctctaccagaagttatggatgaggaaaagattctgaacatcatcagtctgaaataagatgttggagggttccatcccttaaaaggttggaaatcttgcacttaagaaggcggaaatccctttgtttgtgcccctggggctgcaaagggcttgcatttgaattatttgcttccaatctggggaattgaacctgatggggcaagccttgtatatttggtcatttgggaagaaaacaaaatttgttgtg

SEQ ID NO: 77249 - protein, 209 aa, Zea mays
  misc_feature: Ceres CLONE 1562168
  misc_feature (96)..(209): Pfam Name: THF_DHG_CYH Pfam Description: Tetrahydrofolate dehydrogenase/cyclohydrolase, catalytic domain
MGGAAAAVLAVAAARRKSGPFVSLFSRAARRLHDAVETAAAEEDTAGTRSPRRRRRSSSSLLLGPEFPDTWDPSSRDTTPQSPPRCAQADYDRTASIIDGKSTPKDMRLHIAEEVCQMKCSVGHVPGLAVVLVGDRRDSESYVRYKTKGCEEVGIKSLLAKLPGNCSEDEVMDSVSRFNEDSSVHGILVQLPLPEVMDEEKILNIISLK

SEQ ID NO: 77250 - DNA, 1023 bp, Zea mays
  misc_feature: Ceres CLONE 1562170
  misc_feature: Encodes the peptide sequence at SEQ ID NO. 77251
ctccccgcggtggcggccgctctagaactagtggatcccccgggctgcaggaattcgtctcacccctagaaaaagccgagggaatcgcacgcacccagcgatcagcgcagattccttccacgctccccctcctttccaggtcccctcgcccgcgctctcagatctcgcgcgcctcccacaagggaaaccttgagccatgggcacagttgtggatgccgctccagcagttgtggctgaggtcactgagaacatgttgggtggcaagaaagttacagttgtatttgttctaggtggtcctggaagtggaaaaggcacacagtgtgccaacatcgtggagcactttggattcacccatcttagtgctggagatcctctgcgtgcagagaataaacccggctctgagaacgggaaccctgattgagaacatgataaaggagggaaaagattgttccctcgggaagtgactataaaagcttttgcaggaaggcattgataaaaaagtgaaaattgacaaattctctggatcgaagggattttcccagggaatgagggagaaatccctgccagcccttttgagaaatggttacccaaaaattttctcccccgcattttggggccatattcctttggaccgggtccttgaaaaaaaaaattgggaggaaaacccaacctccctggggggcgcacattccaggggaagggggtttgaaataaataaacccttggaaaccttttccaaaaaaagaggttccaaaaccctttggtttgaatctcaaccttctgcctggttcttttgagacttttacacaccccaaagggaaagggggttaaaaaaattggtgccggcaaaaacaaaaccccgcaagtggtttggaaaaaccctcaaacccttgtttgcccccatattctccacagggggaatagaagcacctctaggggacttgaataagggggtaactggggggtctaggcccccctaatacatatctggtggattaaaggagccctttaattaaaaaaaag

SEQ ID NO: 77251 - protein, 74 aa, Zea mays
  misc_feature: Ceres CLONE 1562170
  misc_feature: SWISSPROT Homolog: EC 2.7.4.14 Cytidylate kinase
MGTVVDAAPAVVAEVTENMLGGKKVTVVFVLGGPGSGKGTQCANIVEHFGFTHLSAGDPLRAENKPGSENGNPD

SEQ ID NO: 77252 - DNA, 1030 bp, Zea mays
  misc_feature: Ceres CLONE 1562173
  misc_feature: Encodes the peptide sequence at SEQ ID NO. 77253
ccccgcggtggcggccgctctagaactagtggatcccccgggctgcaggaattcgtctcacccctagaaaaaaaacccaccccctctcgctcgcctccccgccactcccctcccgtccctatggcggccgttaccacagccactgccgccgcgtcctcctcctccttcctccaccgccgaagccccgcctgcctgcgcgccacgctccgcgccgcgccgcggcactgccgcaactccagctccaggctcgcctgccgcgccgccgaggtgtccggggccgagtcgtcctcggccgcggcggatggcgcgggaggaggcgggggcgcgtcgtgggtgcccgtggtgccgctcgccgcgctgccgcggggagagcgccgcgtgatcgtgcaccaccttctttacatcctgctgctctggtacaagaaccaggtcttcgccaatcgagaaccggtcgccaggcggaggggcgcctacaccggaggggcctccctcaacgccaaggctcactgcaaggacgggttggcacttgttttgttctattcaaccagatcagcgcaatttggaccctttccccccccggggggagaataaaaaagaaatgggtatattcccaaaaaaacccgcttgtttcctaaccgggccttctcttacccccccagtccctttgggaggggaaaacctagtgtccaccctctacccgggcggttgtgaaaaacccgcgacctaaaaaaaaaaacaataattaccattccgaggccttttcatctcggggggccaccaaatgggtgtgccgggtgttcacgacgcgagaaaattattattttcacgcgcgggaaaaagctctcaactcctggggcaatgaaatgggcattcgggaatgttcaaatgggttcaaaaaagggaggagagaatgtgctccttcataacaagagatatgttgagagagggttccggcctttctcccaagtgggaacaaccaaaccttaattaaacgggagaaaaaccgcgccataaattagggcattcctcc

SEQ ID NO: 77253 - protein, 156 aa, Zea mays
  misc_feature: Ceres CLONE 1562173
MAAVTTATAAASSSSFLHRRSPACLRATLRAAPRHCRNSSSRLACRAAEVSGAESSSAAADGAGGGGGASWVPVVPLAALPRGERRVIVHHLLYILLLWYKNQVFANREPVARRRGAYTGGASLNAKAHCKDGLALVLFYSTRSAQFGPFPPPGGE

SEQ ID NO: 77254 - DNA, 714 bp, Zea mays
  misc_feature: Ceres CLONE 1562175
  misc_feature (226)..(226): n is a, c, t, g, unknown, or other
  misc_feature (243)..(243): n is a, c, t, g, unknown, or other
  misc_feature (255)..(255): n is a, c, t, g, unknown, or other
ctccccgcggtggcggccgctctagaactagtggatcccccgggctgcaggaattcgtctcacccctagaaaaagcctcgcatctcctcctccgccccacgcagctgaggcgttgatcctcaccggcgtcgccatcgtaatcgccttggacagcggcaccagaacctctgcctccgcagggtgcttgctggtatcattacaatctggtagttttagtggttgggcnttgacttcctactattncagaaaacacangtaccccgagaagtcttttaagtgggggtccaaagaatgggggtcccccctgaaaaattttgccaaaaaaagccccttttggcccccagaaggctaacccctcaaaaagtgtggggggaaaaaaaaacaaaaaaggggggggggggtttttttaaccccccccaaaaaaaaaaaaaattttgttgggggaaaaaaaacctcccccccggggggggggaaaaaaaaacccccccccccccccccaaaaaaaaaaatttatccccccccaaaaaaaataaattttgtgttttttttaaaaaaaaaaggaaaaggggggggggggtttttgttttttttttccccccgcccccccaaaaaaaaaaaaaaacccccccccccccccccacaaaaaaaaaaaaaaaaaaaaaaccccccccccccccccccccccccttataaaaaaaaaaaaaccaccccccc

SEQ ID NO: 77255 - DNA, 775 bp, Zea mays
  misc_feature: Ceres CLONE 1562176
  misc_feature: Encodes the peptide sequence at SEQ ID NO. 77256
ctacccgcggtggcggccgctctagaactagtggatcccccgggctgcaggaattcgtctcacccctagaaaaagaattgaggactatctatggtcagctatgtcaggatgacatgcctatggtcagaagagcagcagcatcaaatcttggaaagtttgcagctacagttgaacagaatcatttgaagacagaaataatgtcaatatttgatgatttaacccaagatgatcaagattcagtgcgtctgttggctgttgaaggctgtgctgcccttggtaaattgttggaaccacaagattgcgtagcacacattcttccagtcattgtcaatttctcccaggataaatcatggcgtgttcgttatatggtcgccaatcaattatatgagctctgtgaggctgttggccctgagcctacaagagctgatttggtgcctgcctatgttcgcctccttcgtgataatgaggctgaagtgcggatagcagctgctggaaaagtaactaagttttgccgcatattaaatcctcagctctcagtccaacatattcttccatgcgttaaggaattgtcatcagattcatcccagcatgttcgttcagctttagcctcagtgattatggggaagggctcctgtactgggaaaaggatgctaccaatgaaacagcttggtccaatttttcctctctttgttggaaggacaaatttcctggatgttccgacttaacattaatcagcaaaacttgatccagttaaatcaggggtattgggaattgg

SEQ ID NO: 77256 - protein, 240 aa, Zea mays
  misc_feature: Ceres CLONE 1562176
  misc_feature (98)..(134): Pfam Name: HEAT Pfam Description: HEAT repeat
  misc_feature (137)..(173): Pfam Name: HEAT Pfam Description: HEAT repeat
  misc_feature (20)..(56): Pfam Name: HEAT Pfam Description: HEAT repeat
TRGGGRSRTSGSPGLQEFVSPLEKELRTIYGQLCQDDMPMVRRAAASNLGKFAATVEQNHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILNPQLSVQHILPCVKELSSDSSQHVRSALASVIMGKGSCTGKRMLPMKQLGPIFPLFVGRTNFLDVPT

SEQ ID NO: 77257 - DNA, 903 bp, Zea mays
  misc_feature: Ceres CLONE 1562179
  misc_feature: Encodes the peptide sequence at SEQ ID NO. 77258
  misc_feature (269)..(269): n is a, c, t, g, unknown, or other
  misc_feature (285)..(285): n is a, c, t, g, unknown, or other
  misc_feature (312)..(312): n is a, c, t, g, unknown, or other
  misc_feature (338)..(338): n is a, c, t, g, unknown, or other
  misc_feature (362)..(362): n is a, c, t, g, unknown, or other
  misc_feature (373)..(373): n is a, c, t, g, unknown, or other
  misc_feature (374)..(374): n is a, c, t, g, unknown, or other
  misc_feature (400)..(400): n is a, c, t, g, unknown, or other
  misc_feature (406)..(406): n is a, c, t, g, unknown, or other
  misc_feature (458)..(458): n is a, c, t, g, unknown, or other
  misc_feature (466)..(466): n is a, c, t, g, unknown, or other
  misc_feature (467)..(467): n is a, c, t, g, unknown, or other
  misc_feature (522)..(522): n is a, c, t, g, unknown, or other
  misc_feature (529)..(529): n is a, c, t, g, unknown, or other
  misc_feature (564)..(564): n is a, c, t, g, unknown, or other
  misc_feature (574)..(574): n is a, c, t, g, unknown, or other
  misc_feature (583)..(583): n is a, c, t, g, unknown, or other
  misc_feature (584)..(584): n is a, c, t, g, unknown, or other
  misc_feature (776)..(776): n is a, c, t, g, unknown, or other
ctggagctccccgcggtggcggccgctctagaactagtggatcccccgggctgcaggaattcgtctcacccctagaaaaaagagcaagagcatcgctctctaagcaaaacgcgcagcacgccggccggccacttcgcacgtacgtaggacgcgcacgcaccggtgcatatatggggctcctggaccagctgtgggacgacacggtggccgggccgcgcccggactccggcctcggcaagctccgcaagtacgcctcccttctccccttncgtcgtcggcgggcgnccgggctccgcgccgcctccccggcgnccgttgggacgcatagcgtcaaccantgctgcccccgcccccggcggagnactgtgttttnncctactacgtccccgcacagcagctnccgcgncccgtcttccgctcgccgcagcggcgctccgattcgcccttcgccagtgcgncgacgacnncccccaggggagaaggggctggagaagctgcgcggaaagccccagaaatggggcnggccggnccgcgggccaacgccccccggcacgccgaagaagnccccaccggntacccaacnngggggggggggggggaattcagttccgcctgggaacctccttgaagcccccaagggccaacttggcccgccccaaggccaaagaccaagaacctgcccccaaggaaaaccccccccaccacccaacaccggcttgggcaaactgaaaaggaaggaaaaaggggccaaagggggcccctggggcccatggggnccctggtaatgtggacgaacccatccccttttaaaagccctcccggggggaccttgttccagtttaccatattaactaacataccttaaaacggggggaaccgggggggcgcccgggttgaaaatgt

SEQ ID NO: 77258 - protein, 204 aa, Zea mays
  misc_feature: Ceres CLONE 1562179
  misc_feature (7)..(114): Pfam Name: Auxin_repressed Pfam Description: Dormancy/auxin associated protein
  misc_feature (33)..(33): Xaa is any aa, unknown, or other
  misc_feature (39)..(39): Xaa is any aa, unknown, or other
  misc_feature (48)..(48): Xaa is any aa, unknown, or other
  misc_feature (56)..(56): Xaa is any aa, unknown, or other
  misc_feature (64)..(64): Xaa is any aa, unknown, or other
  misc_feature (68)..(68): Xaa is any aa, unknown, or other
  misc_feature (77)..(77): Xaa is any aa, unknown, or other
  misc_feature (79)..(79): Xaa is any aa, unknown, or other
  misc_feature (99)..(99): Xaa is any aa, unknown, or other
  misc_feature (118)..(118): Xaa is any aa, unknown, or other
  misc_feature (120)..(120): Xaa is any aa, unknown, or other
  misc_feature (132)..(132): Xaa is any aa, unknown, or other
  misc_feature (135)..(135): Xaa is any aa, unknown, or other
  misc_feature (138)..(138): Xaa is any aa, unknown, or other
MGLLDQLWDDTVAGPRPDSGLGKLRKYASLLPXRRRRAXGLRAASPAXVGTHSVNXCCPRPRRXTVFXPTTSPHSSXRXPSSARRSGAPIRPSPVRRRXPPGEKGLEKLRGKPQKWGXPXRGPTPPGTPKKXPPXTQXGGGGGNSVPPGNLLEAPKGQLGPPQGQRPRTCPQGKPPPPPNTGLGKLKRKEKGAKGGPWGPWGPW

SEQ ID NO: 77259 - DNA, 797 bp, Zea mays
  misc_feature: Ceres CLONE 1562180
  misc_feature: Encodes the peptide sequence at SEQ ID NO. 77260
  misc_feature (405)..(405): n is a, c, t, g, unknown, or other
ctggagctccccgcggtggcggccgctctagaactagtggatcccccgggctgcaggaattcgtctcacccctagaaaaacccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaacanggacatttgagatagaattggcgatgttgtcaagtgctcaccatgtgggagatgaccccccgtgatgctggctttcaggacaagtatgtttgttcaggaggtcatcaaagagatggcgaagaacagggccattgatggcaaaggcaagagagcatttaagggccttgtggttaaatgaagtccacaagctctcccgaggaagcccagcatttccctccgcaggacttttggaaaagtttgcctcatcctggaaaacggatcccttggctgtaaacagccccctccaaaagggaccaaaacctggtaaaaatccccgttggccttaaatggggccacaattaaatgcccccccaggcaaaaaatccaaatttgtcccaaaatttctaaaagtt

SEQ ID NO: 77260 - protein, 100 aa, Zea mays
  misc_feature: Ceres CLONE 1562180
  misc_feature (80)..(80): Xaa is any aa, unknown, or other
MLWVDKYRPKTLDKVTVHDQVAQNLRKFVSEQDCPHLLFYGPSGSGKKTLILALIKQMFGAGAEKVKLENKTWKIDTGTXTFEIELAMLSSAHHVGDDPP

SEQ ID NO: 77261 - DNA, 868 bp, Zea mays
  misc_feature: Ceres CLONE 1562183
  misc_feature: Translation starting site: 374
  misc_feature (577)..(577): n is a, c, t, g, unknown, or other
ctggagctccccgcggtggcggccgctctagaactagtggatcccccgggctgcaggaattcgtctcacccctagaaaaactcgctttcctttcgtccgtacgccgccggctcgcaccgccgacagtcctcagtccagaactccagatcgaacctccctcttcccagatcgggtcctaggctacagcagccgccgcatccgtcaccttcacaccgcgtgcgtgctctctcttccccccttcccctgtccttgcgacgactgggtgggctaccgccgccttacgcaaggtgccgagagcttcgccgatatctgcgccggagaagagcgcccaccagatcaggcgctgataaggcgcgctggccggtggatgacgatggcgggtggcgggggactgaaccggtcttcatcgagggggcagctgccgccgcaagagctgcttgacgatctctgcagccggttccttctgaatgtgccaaggaggagctggagtcgttcgagcggatccctgtcctgctggagcaggcgcactgggtctatgaggacaactccgttgagcacaccccaacctcaagtcccntctcctcaaggacttcacttccctcatgttcaagagctgcactgctcctccggccctacatcgcggacctggatgatttctaccaggacttcaacaactttaaagtccccggtgccctggtgtcggggcccatcatcctaaaaaaaactttattaaaggggccttggcttggtaaaaggaaggaaagggtgggggcccccttggagcttttccctccggggaaagggaaataaaattggggggagaccccccctgtggccgtttaaagaaagttcaaaaagaaaactgggg

SEQ ID NO: 77262 - DNA, 797 bp, Zea mays
  misc_feature: Ceres CLONE 1562184
  misc_feature: Encodes the peptide sequence at SEQ ID NO. 77263
  misc_feature (538)..(538): n is a, c, t, g, unknown, or other
  misc_feature (600)..(600): n is a, c, t, g, unknown, or other
  misc_feature (679)..(679): n is a, c, t, g, unknown, or other
  misc_feature (772)..(772): n is a, c, t, g, unknown, or other
  misc_feature (779)..(779): n is a, c, t, g, unknown, or other
  misc_feature (780)..(780): n is a, c, t, g, unknown, or other
ctggagctccccgcggtggcggccgctctagaactagtggatcccccgggctgcaggaattcgtctcacccctagaaaaattcctgagtagtggggagtcaaaatggctccgccagactggccttgtcgtttgccttcctcatggatatgatggtcaggggcctgaacattctagtgcaagattggaacgctttcttcagatgagtgatgacaacccttatgttatacccgagatggatccaacactgcggaagcaaatccagcagtgcaattggcaggtcgttaatgtaacaactcctgcaaattatttccatgttctgcgtcgccagatacaccgggacttcaggaagcctttgattgtgatgtccccaaagaacctccttcgccacaaggactgcaagtcgaacctatctgaatttgatgatcttgcgggccaccctggattcgacaaacaggggacacgcttcaagcgtctcattaaggaccagaataatcacaaggacctcgaggagggaatcaaccgcctagttctttgctnctggaaaggtgtactatgaactggatgaagaaagaaggaagtcggagcgcactgatgttgcntatatgtagagttgagcagctctgcccgttcccctatgacctcatcccagcgcgagttgaagaatatcaaattgccaanatcgtgtggtgcccagtagagccgatgaacatgggagcatacagctacatcaacccgcggttgctgacggcgatgaaaggtctggggccgggntggctcnnaggacaatcagtacgcc

SEQ ID NO: 77263 - protein, 184 aa, Zea mays
  misc_feature: Ceres CLONE 1562184
  misc_feature (1)..(130): Pfam Name: Transket_pyr Pfam Description: Transketolase, pyrimidine binding domain
  misc_feature: SWISSPROT Homolog: EC 1.2.4.2 Oxoglutarate dehydrogenase (succinyl-transferring)
  misc_feature (179)..(179): Xaa is any aa, unknown, or other
GAPRGGGRSRTSGSPGLQEFVSPLEKFLSSGESKWLRQTGLVVCLPHGYDGQGPEHSSARLERFLQMSDDNPYVIPEMDPTLRKQIQQCNWQVVNVTTPANYFHVLRRQIHRDFRKPLIVMSPKNLLRHKDCKSNLSEFDDLAGHPGFDKQGTRFKRLIKDQNNHKDLEEGINRLVLCXWKGVL

SEQ ID NO: 77264 - DNA, 1045 bp, Zea mays
  misc_feature: Ceres CLONE 1562186
  misc_feature: Encodes the peptide sequence at SEQ ID NO. 77265
tctgtggcggccgctctagaactagtggatcccccgggctgcaggaattcgtctcacccctagaaaaagtcagggcctctcgatcgctcatcagtcgccagaggagttgttgatcgaggcgagtgaggttgaaaagaaggcggcgaacaaaggcaccatcgtcatggacggcggatactacggcggcgggtactacggcggcggtggcgccatcgcgacgccggggtacgctccggcggtcccgtacgggatgtcgcaggtgaacatcgagggcaacgggtgcgggcgggcgctgccgccgcagccgaccgtggaaggtgtattgcccgccaaccccaactacgccatgagcgtccgcgacgggaaagtggtgcttggcgccggccaacccccagggacaattccccgcccctggatccagggaatgccggggggaccccaaccctccagggacctaggaaagggtttccccgggctttcccccctgggttaaaaaaggcggacccgggggagaggccattcaaaagcacctccccttggggggaattccccccccccgggtgggcccccttgggggtcccctttaaaacccccggggaaaatttttgtgggacaaaaaatcacccggcccttttgtggatcccaaaaaaaacccccccccaacattctttggtgaaaaacgtgttttctcccgctcccccgctctcccccattggtgggttgaaaaaaaaactttctctctctccgctaatttgtggaacccccccccccccccgctgggaataatatggttggcggcggggggtgggctccccctttatgaaaaacacccaaaaaacctttgttgttctctataaaattgggtggggggagcggggaacaacccccccccgcgcgggtgaaatataacccccccctccttcggttgaaaaccgggggtgagttttttccctcctccgcgccccctttgttggtgaccgcactctgcgctgttatttcttctataaaaataaaaaggcgggtggtttctctcctccccgctcgt

SEQ ID NO: 77265 - protein, 109 aa, Zea mays
  misc_feature: Ceres CLONE 1562186
MDGGYYGGGYYGGGGAIATPGYAPAVPYGMSQVNIEGNGCGRALPPQPTVEGVLPANPNYAMSVRDGKVVLGAGQPPGTIPRPWIQGMPGGPQPSRDLGKGFPGLSPLG

SEQ ID NO: 77266 - DNA, 638 bp, Zea mays
  misc_feature: Ceres CLONE 1562187
  misc_feature: Encodes the peptide sequence at SEQ ID NO. 77267
  misc_feature (227)..(227): n is a, c, t, g, unknown, or other
  misc_feature (233)..(233): n is a, c, t, g, unknown, or other
  misc_feature (268)..(268): n is a, c, t, g, unknown, or other
  misc_feature (315)..(315): n is a, c, t, g, unknown, or other
  misc_feature (316)..(316): n is a, c, t, g, unknown, or other
  misc_feature (324)..(324): n is a, c, t, g, unknown, or other
  misc_feature (327)..(327): n is a, c, t, g, unknown, or other
  misc_feature (330)..(330): n is a, c, t, g, unknown, or other
  misc_feature (340)..(340): n is a, c, t, g, unknown, or other
  misc_feature (341)..(341): n is a, c, t, g, unknown, or other
  misc_feature (344)..(344): n is a, c, t, g, unknown, or other
  misc_feature (354)..(354): n is a, c, t, g, unknown, or other
  misc_feature (358)..(358): n is a, c, t, g, unknown, or other
  misc_feature (362)..(362): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (599)..(599): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (609)..(609): n is a, c, t, g, unknown, or other
caaagctggagctccccgcggtggcggccgctctagaactagtggatcccccgggctgcaggaattcgtctcacccctagaaaaatccggttgcatggcatgcaggaggagatggtggagccggcggtgcgggggacgcggtacgtcatcgacgcggcggccgaggccggcacggtccgccgcgtcgtcctgacgtcgtcgatcggcgcggtggccatggacccccngccggncgaagcccggacgccgtcgtcgacgagtcgtgctnggagcgacctcgacttctgcaagaagacaagaactggtactgctacnngcaaggcngcngcngaacgggccnngcntggggaggcnggcngccngccccccggggtggacctgggtgggtgggtgggtgccccggtgcctgggtgcaggggccccggccccttcaacccgttcggtggaaaagccaagcccctgaatggccagggggccccaaagaaaccctgaaaaagggggtcccccccccaaaaaaagtttttgcgcccccaacccccgggggggtgcaaaagggggggtttttttattttttnnnttaacaaaaacacacatacgtnttnnnnnttnaaaaaaaaaaaaccccccccccccccccc

SEQ ID NO: 77267 - protein, 126 aa, Zea mays
  misc_feature: Ceres CLONE 1562187
  misc_feature: SWISSPROT Homolog: EC 1.1.1.219 Dihydrokaempferol 4-reductase
  misc_feature (39)..(39): Xaa is any aa, unknown, or other
  misc_feature (41)..(41): Xaa is any aa, unknown, or other
  misc_feature (53)..(53): Xaa is any aa, unknown, or other
  misc_feature (69)..(69): Xaa is any aa, unknown, or other
  misc_feature (77)..(77): Xaa is any aa, unknown, or other
  misc_feature (78)..(78): Xaa is any aa, unknown, or other
  misc_feature (83)..(83): Xaa is any aa, unknown, or other
  misc_feature (84)..(84): Xaa is any aa, unknown, or other
MVEPAVRGTRYVIDAAAEAGTVRRVVLTSSIGAVAMDPXPXEARTPSSTSRAXSDLDFCKKTRTGTATXKAAAERAXXGEAGXXPPGVDLGGWVGAPVPGCRGPGPFNPFGGKAKPLNGQGAPKKP

SEQ ID NO: 77268 - DNA, 769 bp, Zea mays
  misc_feature: Ceres CLONE 1562188
  misc_feature: Encodes the peptide sequence at SEQ ID NO. 77269
ctccccgcggtggcggccgctctagaactagtggatcccccgggctgcaggaattcgtctcacccctagaaaaaacctccacagctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagtaggacctggggaaaaagagcgagctgctcctccgcgccaacccggtgcacaagaagatccccgtgctgctgcacgacggccgccccgtctgcgagtccctcgtcatcgtgcagtacctcgacgaggcgttcccggcggcggcgccggcgctgctccccgccgacccctacgcgcgcgcgcaggcccgcttctgggcggactacgtcgacaagaagctgtacgactgcggcacccggctgtggaagctcaagggggacggccaggcgcaggcgcgcgccgagatggtcgagatcctccgcacgctggagggcgcgctcggcgacaggcccttctttcgcggcgacgcccctcgccttcgtcgacgtcgcgctcgtgccctttacagtcgtgggtcctcgcctacgaccgctttcggcggcgtcaacgttgggaaaaaagaagtgccccgaaggctgggcgccctgggccaa

SEQ ID NO: 77269 - protein, 38 aa, Zea mays
  misc_feature: Ceres CLONE 1562188
  misc_feature (11)..(38): SWISSPROT Homolog: EC 4.4.1.5 Lactoylglutathione lyase
  misc_feature (1)..(38): SWISSPROT Homolog: EC 2.5.1.18 Glutathione transferase
MAEEKKQGLQLLDFWVSPFGQRCRIALDEKGLAYEYLE

SEQ ID NO: 77270 - DNA, 974 bp, Zea mays
  misc_feature: Ceres CLONE 1562190
  misc_feature: Encodes the peptide sequence at SEQ ID NO. 77271
tccccgcggtggcggccgctctagaactagtggatcccccgggctgcaggaattcgtctcacccctagaaaaaatcccccacactcaccctccgcaccggatcccgtcatcacctccgagcggcgcgccgggccggcatccaactcgccgccgacgcgccgcgccccagaacgagccgccggaacgatctccctaacccccgatgcgccgtcctattgcccgcggcgagcccaaggtacaaaccctagctctagctcctccctccgcagccgccccaaccaagatgggcgcccataggcgacaacccagctcccaccgccgcgttgccggcgccctcacgctcctcgccgcgtccgcgctcgcgcttcttctcctagcatcccgccgggctcccccgacctacggcgtcatcatcgacgccggcagcacggggagccccgtccacgatctcgcctaccgctcccaggggggactccccgcagctgggactgggggcccgcatgggcctccatgaagggctacccccagggggtatcggtcctttcgcgggggggaaccccgccggcggcgggggctggtcctctgggggcccgcctattttgggagtttgcgccaggcccccccttgtggcccccccgggaaaaaacttcgtggggggaaaaacccgaaggtgggggggctcattgggcccacctgtccgggggggtgcgggctgggctccaaatttcggcgggggggcgaagaatcccttcccccggcaaaccttgggcaggggaaaatgtccttcctggggtgtgcgggggtgttccacttatctgggggaggaaagtggggcccacccgcgggtgctcccggggggggtgtaaacaaacagagaaaacggggggggacaccttttttctccccttttgagaggaaaccaccttttgtaaaaatgggggggagaactgggaggcccctgcagcacttttaag

SEQ ID NO: 77271 - protein, 103 aa, Zea mays
  misc_feature: Ceres CLONE 1562190
MRRPIARGEPKVQTLALAPPSAAAPTKMGAHRRQPSSHRRVAGALTLLAASALALLLLASRRAPPTYGVIIDAGSTGSPVHDLAYRSQGGLPAAGTGGPHGPP

SEQ ID NO: 77272 - DNA, 662 bp, Zea mays
  misc_feature: Ceres CLONE 1562192
  misc_feature: Encodes the peptide sequence at SEQ ID NO. 77273
  misc_feature (497)..(497): n is a, c, t, g, unknown, or other
  misc_feature (578)..(578): n is a, c, t, g, unknown, or other
ctggagctcaccgcggtggcggccgctctagaactagtggatcccccgggctgcaggaattcgtctcacccctagaaaaatcgctcgtcgctcccaagtcccaccaagctgtcccccgaccactccgccgcccgctccaatggcggcgccggccagctcctcatgcttccacccacgcgcgaccgccagcccgccgtcttctctcagcgtcggcaccaaggtcttcgtcgggctcagggcgcagaccaagctcggttcgtcggagtcgtcatgcccgaatgtcagcgctgggttccacactgcggtcaaccggagaatctctctcaggttgtccaaaaagaaggcgaccagagcccgcatctcgatgatgcctattggtactccacgtgtgccttaccgaacacctggtgaaggaacctggcaatggcttgacatatggaacgctctgtaccgtgagcggattatcttcattggggacaatatagatgaagaattcnagcaaccaagtggttgggcaagcatggctctatgcttggacagcatttgataaatgtcccaaaaaaagaataattgcttantaccattgtaaatgggaaccccaaggggaagggaaggatcctttttaaccttcccccgttggtttattgggggccaaaccttat

SEQ ID NO: 77273 - protein, 135 aa, Zea mays
  misc_feature: Ceres CLONE 1562192
  misc_feature: SWISSPROT Homolog: EC 3.4.21.92 Endopeptidase Clp
  misc_feature (120)..(120): Xaa is any aa, unknown, or other
MAAPASSSCFHPRATASPPSSLSVGTKVFVGLRAQTKLGSSESSCPNVSAGFHTAVNRRISLRLSKKKATRARISMMPIGTPRVPYRTPGEGTWQWLDIWNALYRERIIFIGDNIDEEFXQPSGWASMALCLDSI

SEQ ID NO: 77274 - DNA, 961 bp, Zea mays
  misc_feature: Ceres CLONE 1562194
  misc_feature: Translation starting site: 122
  misc_feature: SWISSPROT Homolog: EC 2.5.1.18 Glutathione transferase
  misc_feature (943)..(943): n is a, c, t, g, unknown, or other
ctccccgcggtggcggccgctctagaactagtggatcccccgggctgcaggaattcgtctcacccctagaaaaaagggagcagaagccaaccggctcgtccgcccgttgcctgtcgtcgctatggccgccgtggaggtgtgcgtgaaggccgccgcggggaaccccgacacgctcggcgattgcccgttctcgcagagggtgctgctcacgctggaggagaagaaggtcccgtacgaggtgaagctcgtcgacctcggcaacaagcccgaatggtttctgaacatcagcccagagggtaaggtgcctgtgttcaacggtggagatggcaaatgcattgctgattctgatgtaatcacccaagtcattgaggagaagttcccgactccttctctgggcacccctccggaatatgcatcagtgggatcaaagatttttcccagcctttgtcaagttcttgaaaagcaaggatgctagtgatggggcagagaaggcgcttctggatgagcctgcaagcactggatgatcatctcaaagctcatggcccctacataaatgggggaaaacgtgtcagcgactgatcttagcctggggggcaaagctttttccccccttcagatcgcactggaggcttttccaaggcgtggaaagatcccagggaaaccttacccattgtccggggcctacaccaaggggctttttcaggccgggaaatctttgtgcaaaataagccatcccaaggacccgtgtattgcgggatggggcgccccagggggaatgcctaaaaaccctgggccctttgggggctcccggggggcacccgccctttttctttttattctttttcaccggggggggaaaggggccaagcctggtaccctaagagcggattcacctggaatttttcgggggcgtggtctcgagtacccagttcgggcggtgcgnggggggatctaccccctg

SEQ ID NO: 77275 - DNA, 777 bp, Zea mays
  misc_feature: Ceres CLONE 1562200
tggagctccccgcggtggcggccgctctagaatagtggatcccccgggctgcaggaattcgtctcacccctagaaaaaacaaccctcctcctccttgcctaggtactcgcagcagcgtcggcaagcaaggttctcttctcgcgccgcccagatctgagcgctcccatggccatgccgtcctcccgctccccggcgccgccgccaacggcctcctcctcctactggtgctacatgtgcgaccgcttcgttcgcgccgccgcttcctcctcctcctcacccacttcgccgtcctcctcctcccccgcctgcccgtcctgcggcgggggcttcctcgaggagatgggcgcgccgccgccccgcgcccgccggccccgccgcgccgcccgccgcggcgccgactcccgcgcctcgcccttcaaccccgtcatcgttctccgccgctccccgcccgccgacgccgacaccgatggctcctcctctcccgccgccgccaccggcagcagcttcgagctgttctacgacgacagggcggggtcgggcctccgcccgctcccggagagcatgtcggacttcctcatgggctccagcttcgagcggctgctggagcagctggcccagatggaggcctgcagcccgtctagcggcgcgcgcacgcgacgcaccgccggcttctcaagccgccgtggactccatgcccagcgctcgcgtcggcgacccccacatcgcagacgacgcgcactgcaccgtctgcaaggacgccttctagctgcgctcgga

SEQ ID NO: 77276 - DNA, 834 bp, Zea mays
  misc_feature: Ceres CLONE 1562204
  misc_feature: Encodes the peptide sequence at SEQ ID NO. 77277
ggagctccccgcggtggcggccgctctagaactagtggatcccccgggctgcaggaattcgtctcacccctagaaaaaacccccctcgcctcgccctcgccgcctcctctcccgttcccccaccaaccgcagcagcgagagcgagactgagaatggccgcggcgccgtcgtccctcgtgtcctcccatctctctcgcctcgccgacctccgccgcgcggcggcgccggccactcccaccgtcccacagcagcttcgcgtcggctgctcgcgccgccgcgcccagcgcgtcgtcgccatggctggatccggcaagttcttcgtcggaggcaactggaagtgcaacggaacaaaggactccgttagcaagcttgtctctgaactgaatgctgctaccctcgaaactgatgtagatgttgtggtggctcctccattcatctatatcgatcaggtcaagaattcactaacgggtcgcattgaggtttctgctcaaaatgtgtggattggaaaaggaggagcctacaccggagagatcagtgcagaacaactggtggacatcggttgtcaatgggttatgcttggacactcagagcgtagacatattgttggtgacaatgacgagtttattgagaagagagctgcatatgcattgagccaaaatgtcaaggttattgcgctgctatgagagcttctggaagagagggaagccgcaaaactttctgaacatgtatggagcagatgatgcttttgcagatagtattccaactgggccgatcgtgtgattgcatgagagcatgcttgggctatggcacccggagagtgctactcctggcagt

SEQ ID NO: 77277 - protein, 128 aa, Zea mays
  misc_feature: Ceres CLONE 1562204
  misc_feature (7)..(128): Pfam Name: TIM Pfam Description: Triosephosphate isomerase
  misc_feature: SWISSPROT Homolog: EC 5.3.1.1 Triose-phosphate isomerase
MAGSGKFFVGGNWKCNGTKDSVSKLVSELNAATLETDVDVVVAPPFIYIDQVKNSLTGRIEVSAQNVWIGKGGAYTGEISAEQLVDIGCQWVMLGHSERRHIVGDNDEFIEKRAAYALSQNVKVIALL

SEQ ID NO: 77278 - DNA, 838 bp, Zea mays
  misc_feature: Ceres CLONE 1562205
  misc_feature: Encodes the peptide sequence at SEQ ID NO. 77279
gcggtggcggccgctctagaactagtggatcccccgggctgcaggaattcgtctcacccctagaaaaagttgttgctgctgctaggtgctagctcccgagtcacggccgccttccactcccacagaattcagctagctttcttactcccgccgtcgcccccgatccgagagcgagcatggcgcactctctcgccgcttccttctcgccagccgccgcccggcgccaggtcacaaatgtgattccaagctggacctcggtttccttccagagccacaggatgacttctgtatccatccgctcaagacaaaggtctcttgggtttaagatttgctgttcggctaagaaagagacagtggacaaggtttgcagtatagtgaaggagcagctggctcttcccgatgggaccgccatcactgccgaatcaaaattcgctgaacttggcgctgattcgctggatacggtcgagattgtgatgggcctcgaggaggcgttcaacataacagtcgacgaaacaagcgcacaggacatcgcaacagtgcaggacgctgcggaccttatcgagaagctcatgctggaggcacctccaaaggtcgtctagatccaacaaccttgcgatcgacgaccttgtgtttgatctatgttgtgtgttattttgttcgtgttgccccatttgttctttcttgatgatcaagatgaggttttgtattggtggtgctgaggtgaatagatagccccaaaggcacatgaagcagatgaggacagttcattccactttgaaattgaatgttggtacttgtagtgctgctatagagaaaccatggaactgtttggagagtt

SEQ ID NO: 77279 - protein, 140 aa, Zea mays
  misc_feature: Ceres CLONE 1562205
  misc_feature (61)..(128): Pfam Name: PP-binding Pfam Description: Phosphopantetheine attachment site
MAHSLAASFSPAAARRQVTNVIPSWTSVSFQSHRMTSVSIRSRQRSLGFKICCSAKKETVDKVCSIVKEQLALPDGTAITAESKFAELGADSLDTVEIVMGLEEAFNITVDETSAQDIATVQDAADLIEKLMLEAPPKVV

SEQ ID NO: 77280 - DNA, 1005 bp, Zea mays
  misc_feature: Ceres CLONE 1562206
  misc_feature: Encodes the peptide sequence at SEQ ID NO. 77281
  misc_feature (457)..(457): n is a, c, t, g, unknown, or other
  misc_feature (463)..(463): n is a, c, t, g, unknown, or other
tggagctccccgcggtggcggccgctctagaactagtggatcccccgggctgcaggaattcgtctcacccctagaaaaaattggagtccgcatcgctcgctagtcacctaccgcaccgccaccgccaccgccgccgccgccagcgcgcccgtctcgcacgcgcagcacaggacgcgcgcgatcccctcgcgtccggatcgccatggcctccacggcgttcgccgccgccaagtacttccccgcgcacctcgactcctccccgcgcatcgcgccccgccgcgccgcgcccaccgcgagcctctccttctccccgctctccgccagcccgtcgtccctgctccgcctccggtccccctgcccgtccggcccggggggcaggctgcccccgcccccgccgccgcgatcgtacggcggcggcggcggatctggtggcgacgcccgggactccggcggttgnctcctnggtttggggcatcctcgtgcccttcactcggcgggtgggcctccaggtttctcgcggtaacccacctttccatttcaaggtgccctcttgataagcccctggggggtcggcttgttggtgtagggtgcagacgtgtctcatgtgtatcctcagttcttcctccaaccaaaacttggagctaggattcaccagacccaatgacctagttgtcctccccggtagtctcccccgctgatgttgttcccgccgcagaaagagggggcataatgctggaccaacgtggtctcgttaggtttatcaggcgacctcgcgttgtatctaattatcacctggcatatctccgtttgactcactcgaaagtacgctttttcggaggtactctcgccattagtcgctgttctgcttcattgatacgtgggcgtaactccactcgctagcagttacccaccgtgcacgggaagacgacttccgcgatttcgcgaactcaggaggaccatcggcgcttgcgagttaggctattgctttgcctagcgctaacactc

SEQ ID NO: 77281 - protein, 106 aa, Zea mays
  misc_feature: Ceres CLONE 1562206
  misc_feature (85)..(85): Xaa is any aa, unknown, or other
MASTAFAAAKYFPAHLDSSPRIAPRRAAPTASLSFSPLSASPSSLLRLRSPCPSGPGGRLPPPPPPRSYGGGGGSGGDARDSGGXLLGLGHPRALHSAGGPPGFSR

SEQ ID NO: 77282 - DNA, 847 bp, Zea mays
  misc_feature: Ceres CLONE 1562207
  misc_feature: Encodes the peptide sequence at SEQ ID NO. 77283
  misc_feature (518)..(518): n is a, c, t, g, unknown, or other
  misc_feature (747)..(747): n is a, c, t, g, unknown, or other
  misc_feature (783)..(783): n is a, c, t, g, unknown, or other
ctggagctccccgcggtggcggccgctctagaactagtggatcccccgggctgcaggaattcgtctcacccctagaaaaaaagaacgacagctgcgaggacgtcgacgcagcggggcggtaccggtgcctggagccggaccacccgtgcgaggcaccgtggtgcgacgggccgctcggcgcgctggagagcaacgggtgggtgtactcagcgcactgctccttcaagctctttacggccgatgcgtcgtggcggtgccttgacgggaagtggctcttcttctggggcgactctaaccacgtcgacaccatccggaacctcctcaccttcgtcctcggcatcacggacacgtctgctgtgacgcgccggtttgatgcagtgttcaccaatcccagtggtggggcagggactctgaggatcacaagcatcttcaacggccactggaacatgagcatgaactatctcggcttgcattccctccggaacagaggtttccggcagctcatccggtcctacttncatgtccggtgatcgtgttccggacgtcgtggtcctgaactctggcctgcacgatggctgctactggaccagcgtccgcatctacgcgcaggctgcggatttcgcagcacagttctgggtccggagtcatggacaaagtccggggctcgtgggcgtgcagtgccccagggtgttctaccggacgacgattgccactgggggctacgctagggacctggcattcaatccnacaagatggagcggttcaatgggtgtgcttgttgangagatgaggcggcacggggtgcttaactgggtgggagtgattgaacattttgacatgacattcc

SEQ ID NO: 77283 - protein, 175 aa, Zea mays
  misc_feature: Ceres CLONE 1562207
  misc_feature (172)..(172): Xaa is any aa, unknown, or other
GAPRGGGRSRTSGSPGLQEFVSPLEKKNDSCEDVDAAGRYRCLEPDHPCEAPWCDGPLGALESNGWVYSAHCSFKLFTADASWRCLDGKWLFFWGDSNHVDTIRNLLTFVLGITDTSAVTRRFDAVFTNPSGGAGTLRITSIFNGHWNMSMNYLGLHSLRNRGFRQLIRSYXHVR

SEQ ID NO: 77284 - DNA, 824 bp, Zea mays
  misc_feature: Ceres CLONE 1562208
  misc_feature: Encodes the peptide sequence at SEQ ID NO. 77285
ggagctccccgcggtggcggccgctctagaactagtggatcccccgggctgcaggaattcgtctcacccctagaaaaaaacgcaccccttcctcgtttcgccgcctccgccgacaccgactgcctacctcagctgccgtcaccatgggcagaaagcctgctagatgctatcgccagatcaagaacaagccataccctaagtccaagtactgccggggtgtccctgaccccaacatcaggatctacgatgtcggcatgaagaggaacggtgttgatgagttcccctattgtgtgcaccttgtctcttgggagaaggagaatgtctccagtgaggcgcttgacgctgcccgcattgcctgcaacaagtacatgaccaagtctgcagaaaaggatgctttccaccttagggtccgggttcacccgttccatgtcctccgtatcaacaagatgctctcgtgtgctggggctgataggctccagactggaatgaggggtgcctttggcaagcctcacggcacctgtgctagggtggacattggtcaagtcctcctttccgtgcgatgcgaggacaacaatgctgcccatgccagcgaagctctgcgtcgcgctaagttcaagttccctggccgccaaaagatcattgagagcagaaagtggagcttcaccaagttcagccgcgctgactacctgaagtacaagagcgagggcagaattgtccctgatggtgtcaacgcaaagctgctcggcaaccacggcagaacttgaagagcgtgctcctgggaaggcgtttcctcgatgcccgttgcttaaatgcagatgcctaac

SEQ ID NO: 77285 - protein, 206 aa, Zea mays
  misc_feature: Ceres CLONE 1562208
  misc_feature (5)..(167): Pfam Name: Ribosomal_L16 Pfam Description: Ribosomal protein L16
MGRKPARCYRQIKNKPYPKSKYCRGVPDPNIRIYDVGMKRNGVDEFPYCVHLVSWEKENVSSEALDAARIACNKYMTKSAEKDAFHLRVRVHPFHVLRINKMLSCAGADRLQTGMRGAFGKPHGTCARVDIGQVLLSVRCEDNNAAHASEALRRAKFKFPGRQKIIESRKWSFTKFSRADYLKYKSEGRIVPDGVNAKLLGNHGRT

SEQ ID NO: 77286 - DNA, 738 bp, Zea mays
  misc_feature: Ceres CLONE 1562209
  misc_feature: Encodes the peptide sequence at SEQ ID NO. 77287
gagctccccgcggtggcggccgctctagaactagtggatcccccgggctgcaggaattcgtctcacccctagaaaaaattcctacctgttgccacatctagtggttcggcctttccatctgccgttcgcccagcgtgttctccctctagtgcggcaactgggcgaccgccgccgccgctctactccaggtgcccaggcgttcgtccgtaccttctcaggccttcatcgcgtccttcgccggcgacgatcaccgacaaggatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaaatgtgatgcatcacaggttttcagctatctatccccagaagtctgtaccaaagtatatcagtgaattggactggaatgggaagttctgctggtggaaatcatggatgggaaataatcaaacccttgaaaaattcttaaaaagaaagcctttgaagaaaaagcgtgggggctgggttctttcatttctaaacgggaaaaacggccccccgaacccttttgttggaaaagagcaatttcctctttgggtaaaaaaaggaaaaaattttttggaaa

SEQ ID NO: 77287 - protein, 89 aa, Zea mays
  misc_feature: Ceres CLONE 1562209
MERTINSLMYKGSIPDAINQSRREKKLFVVYISGEDEASSSLEQSSLIDENVVEVIGRCCILLHLKQGKCDASQVFSYLSPEVCTKVYQ

SEQ ID NO: 77288 - DNA, 734 bp, Zea mays
  misc_feature: Ceres CLONE 1562211
  misc_feature: Encodes the peptide sequence at SEQ ID NO. 77289
  misc_feature (445)..(445): n is a, c, t, g, unknown, or other
  misc_feature (471)..(471): n is a, c, t, g, unknown, or other
  misc_feature (486)..(486): n is a, c, t, g, unknown, or other
  misc_feature (489)..(489): n is a, c, t, g, unknown, or other
ggagctccccgcggtggcggccgctctagaactagtggatcccccgggctgcaggaattcgtctcacccctagaaaaaaccaatccccgattccttacacgctaagccacgcaacgcaacgcaactagccatgacgatgaagtccagcagcggcggcggccatgtcatcggggtcccggtcacctccaaggcgcacgggatagaggaggtgtccagggatccgtccttcggcaagggcgccggcgatcacctcgccgtctcgttgacgcaccccagcccttacgcgtctttcggctacaagcacacaggcagcaaaggccaggtgacccactgggtgagcaagctgagcagaagggcgcagggcttcagagagcatgtgaccttggggccgaagctgtcggagacggtgaaggggaagctgagcctgggcgcgcggatcctgcangccggcggggtggagcgcgtgttccngcaggccttctccgnccngcgacagggcgagcggctgctcaaggcgctgcagtgctacatctacaccacggggcgggccccatcgcggcatgctcttcgtctccaccaggaaagtcggctttcggcagcgaacgccccatcaacgttaccctccccgggcggcggccggcaaaccgggcccggggtcacctccaaggggggccctccccgctggcgaggaatccgccagggggcggcccagccaagaaacgttccccgggccc

SEQ ID NO: 77289 - protein, 201 aa, Zea mays
  misc_feature: Ceres CLONE 1562211
  misc_feature (105)..(105): Xaa is any aa, unknown, or other
  misc_feature (114)..(114): Xaa is any aa, unknown, or other
  misc_feature (119)..(119): Xaa is any aa, unknown, or other
  misc_feature (120)..(120): Xaa is any aa, unknown, or other
MTMKSSSGGGHVIGVPVTSKAHGIEEVSRDPSFGKGAGDHLAVSLTHPSPYASFGYKHTGSKGQVTHWVSKLSRRAQGFREHVTLGPKLSETVKGKLSLGARILXAGGVERVFXQAFSXXRQGERLLKALQCYIYTTGRAPSRHALRLHQESRLSAANAPSTLPSPGGGRQTGPGVTSKGGPPRWRGIRQGAAQPRNVPRA

SEQ ID NO: 77290 - DNA, 807 bp, Zea mays
  misc_feature: Ceres CLONE 1562216
  misc_feature: Translation starting site: 208
  misc_feature (631)..(631): n is a, c, t, g, unknown, or other
  misc_feature (758)..(758): n is a, c, t, g, unknown, or other
tggagctcaccgcggtggcggccgctctagaactagtggatcccccgggctgcaggaattcgtctcacccctagaaaaaagcagcataacaagaagacacaccaaaacctagctagcttgccgcacctgcttggggctgccaagtaaaagtagtaagctagagaagcaaagcaaagctccgatccaatccaatccaccgcgaggattatgtctctggtaaggctcctggacacgctggccctggactcgtgggtgcggaacccgttcaccatcttcggcacggcggtggccgccgacgcgtggctggccagcgacacgtcggcgttcgccaacacgcacatcgagagccgggacacggcggccgcctacgtgttcagcgccgcgctcccgccgggcgtcaagaaggaggaggtgacggtggagctggacgagggcaacgtgctggtcatcgccggcgagcgcagcgtgtgccgccaggagcgcagcgacgggtgccaccacatcgagcgcagccgcgccaccttcctcgccaggttcacctgcccgaagacgccgccgtcgacagcgtcagggccgccttggacgccggcaggctcaccgtcaccgtgccccaagtctgggccgccgccgnccgccatcgtgcccgtagagcccgccgccgacgcgcctgcgcctggcgcccgttgcccgtcgaagcccggccccctgctgagcttctgacgatgcccgacgccaacgcccgaccgaagacgcccggnccggctccttggttccttccacgtacacgccccccccgccagttgaccg

SEQ ID NO: 77291 - DNA, 952 bp, Zea mays
  misc_feature: Ceres CLONE 1562217
  misc_feature: Translation starting site: 165
ctccccgcggtggcggccgctctagaactagtggatcccccgggctgcaggaattcgtctcacccctagaaaaaactcatccattccatcatcccctttgcaagtatagtctctctgctaagcgaagcgaagcttcaagctagtctcggcggctctagaatacgatgggcaaggacgacctgatcgacagcggcgctggcggcggcgagttctctgccaaagactacacggaccctcccccggcgccgctgatcgacgcagcggagctggggtcctggtcgctgtaccgcggcctgatcgacgagctcatcgccaccctgctgttactgctcctcatcggcggcccacctgatcgggttcaagcaccagacggacgcgtcggcgtctggcgccaacacaacgtgctggcggcgtgggcgtgctgggcatcggccgggccttacgcggaatgatcttcctcctcgtctactgcaccggcggcctctctgggggccagattaaccccgccgtcggctttggcctattactggtgcgcaaagtctccctggtgcgcgcgcagcctctagatcgtggcacaattgtgtcggccccatctgcggcgacggccgcctccaaggcgttacctaacgacttctctggacaggggacggggggaggtcccaactcactcgccttcgggctatacccgcggagccggactcggcgcacgatagtcaattgggaccctatctgccccattcttagcagtctttccgctcttgccgaccccaaagcgccaagccccccggagttccaagttcccgtgttgtgggctccgccttcccccatccggctttgggcggggtttctaagggtgactcctagggccatctattccccgtgtcacgcggccccggggactttaaccccgggtccaaggaattcctgtgagcagccgcccctacatctaaag

SEQ ID NO: 77292 - DNA, 885 bp, Zea mays
  misc_feature: Ceres CLONE 1562218
  misc_feature: Translation starting site: 163
ctccccgcggtggcggccgctctagaactagtggatcccccgggctgcaggaattcgtctcacccctagaaaaaaccaaccctcctcctccttgcctaggtactcgcagcagcgtcggcaagcaaggttctcttctcgcgccgcccagatctgagcgctcccatggccatgccgtcctcccgctccccggcgccgccgccaacggcctcctcctcctactggtgctacatgtgcgaccgcttcgttcgcgccgccgcttcctcctcctcctcacccacttcgccgtcctcctcctcccccgcctgcccgtcctgcggcgggggcttcctcgaggagatgggcgcgccgccgccccgcgcccgccggccccgccgcgccgcccgccgcggcgccgactcccgcgcctcgcccttcaaccccgtcatcgttctccgccgctccccgcccgccgacgccgacgccgatggctcctcctctcccgccgccgccaccggcagcagcttcgagctgttctacgacgacgggggcggggtcgggcctccgcccgctcccggagagcatgtcggacttcctcatgggctccggcttctagcggctgctggagcagctggcccagatggaggccggctgggggtctggcggctccctccccctaaggcccgccagagtccagggcccccaatgaattccattggcgcacgcccccgatgacggggccgccaacgttagaggccgaagggaaactgcgcccgtctgaaaagggaaggccttcttaacttgggccgcctaaagaccacggggaaaatatccttggagcccagacattcttccatttcccaaatatggctttcctggtccctgggtgtggcgagtcttagtgctgga

SEQ ID NO: 77293 - DNA, 1005 bp, Zea mays
  misc_feature: Ceres CLONE 1562219
  misc_feature: Encodes the peptide sequence at SEQ ID NO. 77294
  misc_feature (352)..(352): n is a, c, t, g, unknown, or other
acccgcggtggcggccgctctagaactagtggatcccccgggctgcaggaattcgtctcacccctagaaaaagacactcgcgcacttcagcactcagccactcagcacagccactgacccgtcgcctccccggctcgcgaccgcatctctctcgccccttccaagttcctaatcgccaccgctgtccccaaccagcaaaccctagccctcatcgccggcggccatggccgagaccgtcgacgacaagatcagttacttccaggctgtcaccggcatctccgacacggacctctgcacggaaatcctcgccgcgcacaactgggacctgcagctcgcggtgtcctccatcacngcaaacccgtccttgcccttcggcccgggttccacctccccccggggggggggtgggggtggggtggccccccccaatggggaagttcgcccccccacccccccccaaatacccccccccccttaagaagggggccgggggaacccccgggaaaacgggggaacccccccccttttaaggggggtcatcggggggggggccaggcctcctacccccggggttctttttccccctttggggcctccgggggcctccccggggggggcggggggttatccccgaggtcccctttttccccaccgagaagggccctcttctgggggagaaagggccggcgaaacacgggacaaacgcccctgtggaagaagaggtggccccgccctccaatttttccggaggagggggtgtaatattttcttcccccaaatatacaaacacacggaagttcgggctgtgtgtccccacgccccccccatttttttagggaaaaagggtctcctttaaaaagagcttgcggaggatatggaggggggggaaataagagggtccctggatagtgtaagaacacaccccccccctgacacgcagatagtgactcctgtgtttgtgggggggggcccggttgttatataacaacatccacgctctatatg

SEQ ID NO: 77294 - protein, 84 aa, Zea mays
  misc_feature: Ceres CLONE 1562219
MAETVDDKISYFQAVTGISDTDLCTEILAAHNWDLQLAVSSITANPSLPFGPGSTSPRGGGGGGVAPPNGEVRPPTPPQIPPPP

SEQ ID NO: 77295 - DNA, 953 bp, Zea mays
  misc_feature: Ceres CLONE 1562220
  misc_feature: Translation starting site: 140
gcggtggcggccgctctagaactagtggatcccccgggctgcaggaattcgtctcacccctagaaaaagcgctagcgcgagtggtggcacccacgcatactcttctcccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagtttccccgggcaggtgctccgctacgaagacaacttcgacgccaacagcaacgtgtccgtcatcatccagcccacgtccaagaaaaccatcgccgactacggctctcccgagggagttcctctcccaggtcgactaccggctcggcaaggcggggctaccggcggcgaagaccaactccgcagggccgggttccataaccgggcgccgtgggccaccggccaaacgtcctggaaaagctccccccccgtgtttcgacgggcaagcagttactaccccctggggccgtgctccccctgtaacggcggaacggcgaccaagggcggggaagaaccaggttctttgcgggccacccgctccaaagggaaagctcttaatctcgaaggggcaaggccggcgaaaaaaagggggtcaagggcgcccggtaagggatccaaaaaggccccccccccttcagggggccaaggtgag

SEQ ID NO: 77296 - DNA, 791 bp, Zea mays
  misc_feature: Ceres CLONE 1562221
  misc_feature: Translation starting site: 138
  misc_feature (532)..(532): n is a, c, t, g, unknown, or other
  misc_feature (552)..(552): n is a, c, t, g, unknown, or other
  misc_feature (564)..(564): n is a, c, t, g, unknown, or other
  misc_feature (567)..(567): n is a, c, t, g, unknown, or other
ctccccgcggtggcggccgctctagaactagtggatcccccgggctgcaggaattcgtctcacccctagaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggaccccggagacgttcgccaagaaccgggagctggaggtgatccactcccgctgggccatgctgggcgcgctcggctgcgtcttccccgagctgctcgcccgcaacggcgtcaagttcggcgaggccgtgtggntcaaggccggctcccagatnctcagcgaggcnggnctggactacctcgggaaaccgagcctcatccacgcgcagagcatccttgctatctgggcctgccaggtcgtgctcatgggcgccgtcgagggcttaccgcatcgccgggcgcccgcttggggcgagggtcgtcgacccgctctaccccggggggaagcttcgaaccggttgggctttgcccaagaacccccaaaggccttcgccgaaggctcaagggtcaagga

SEQ ID NO: 77297 - DNA, 769 bp, Zea mays
  misc_feature: Ceres CLONE 1562225
  misc_feature: Encodes the peptide sequence at SEQ ID NO. 77298
  misc_feature (706)..(706): n is a, c, t, g, unknown, or other
  misc_feature (745)..(745): n is a, c, t, g, unknown, or other
ggagctcaccgcggtggcggccgctctagaactagtggatcccccgggctgcaggaattcgtctcacccctagaaaaaacccatcagccatccccttttgctgcaaatctttccctgaattgtgggtctccgacaatggcggcgctcgctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgctggaccgatcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctgggtggtggccgtgatcgcggaaggtcatcctcgtcgggcggcgccgagntactaccggatcaccaacgggaactggaccttgaggacnaagctgcacccccgggtgggcccc

SEQ ID NO: 77298 - protein, 211 aa, Zea mays
  misc_feature: Ceres CLONE 1562225
  misc_feature (83)..(206): Pfam Name: Chloroa_b-bind Pfam Description: Chlorophyll A-B binding protein
  misc_feature (191)..(191): Xaa is any aa, unknown, or other
  misc_feature (204)..(204): Xaa is any aa, unknown, or other
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLNYFGNSIPINLGGGRDRGRSSSSGGAEXLPDHQRELDLEDXAAPPGGP

SEQ ID NO: 77299 - DNA, 807 bp, Zea mays
  misc_feature: Ceres CLONE 1562226
  misc_feature: Encodes the peptide sequence at SEQ ID NO. 77300
  misc_feature (386)..(386): n is a, c, t, g, unknown, or other
ctccccgcggtggcggccgctctagaactagtggatcccccgggctgcaggaattcgtctcacccctagaaaaaagacgcaccccttcctcgtttcggcgcctccgccgacaccgactgcctacctcagctgccgtcaccatgggcagaaggcctgctagatgctatcgccagatcaagaacaagccataccctaagtccaggtactgccgtggtgtccctgaccccaagatcaggatctacgatgttgggatgaagaggaacggtgttgatgagttcccctattgtgtgcaccttgtctcttgggagaaggagaatgtctccagtgaggcgcttgaggctgcccgcattgcctgcaacaagtacatgaccaagtctgcaggaaangatgctttccaccttatggtccgggttcacccgttccatgtcctccgtatcaacaagatgctctcgtgtgctggggctgataggctccagactgcaatgaggggtgccctttggaagcctcaaggcacctgtgctagggtggacattggtcaggtcctccttatcgtgcgatgcaggacaacaatgctgcccatgacaacgaaagctctgcgtccggcctaagtccaagttccctgggcggccaaataatcattgtgaaacaaaaaaggggggcttccccaagttcaaacggggctgaccaccctgaaatactaaaaggaaagcgaaaaattgtccccaaaagggtggtaaaggaaaaagggggggggggcaacccggggagaactttaaaaacccggtgtccccggggaagggcttttcc

SEQ ID NO: 77300 - protein, 155 aa, Zea mays
  misc_feature: Ceres CLONE 1562226
  misc_feature (5)..(153): Pfam Name: Ribosomal_L16 Pfam Description: Ribosomal protein L16
  misc_feature (82)..(82): Xaa is any aa, unknown, or other
MGRRPARCYRQIKNKPYPKSRYCRGVPDPKIRIYDVGMKRNGVDEFPYCVHLVSWEKENVSSEALEAARIACNKYMTKSAGXDAFHLMVRVHPFHVLRINKMLSCAGADRLQTAMRGALWKPQGTCARVDIGQVLLIVRCRTTMLPMTTKALRPA

SEQ ID NO: 77301 - DNA, 858 bp, Zea mays
  misc_feature: Ceres CLONE 1562227
  misc_feature: Encodes the peptide sequence at SEQ ID NO. 77302
  misc_feature (801)..(801): n is a, c, t, g, unknown, or other
ctccccgcggtggcggccgctctagaactagtggatcccccgggctgcaggaattcgtctcacccctagaaaaagtaccagaacaccaaaagccatctgatctccactcctgcgaagagatctagcacatcgccacatccacacacacttccagctcctccaaatatttcgcgccacttgcgggctctgacggtttagctccactccagccatgagctcccgaatggccggagcagcgctcctgcgccacctaggcccccgcctcttcgcggccgagccggtgaccgggctcgcggcgaggggcgtcatgcccgcggccgcgaggattctccccgcacggatgtccagcacggccgcggaggccgccaaagaagctgccgcgccacaacagcgccaaaagcccgaggccgcggccgcggcgccggaggggcaggacaagaaggccgtcgtcagctactggggcatcgagccgcgaaagctcgtgaaggaggacggcacggaagtggaggtggttctgcttcaggccatgggacacgtacagagcggacacgtcgatcgacatgaagaagcaccacgagccgaaggcgctgccggacaagctggcctactggctggtcaagtcgctggtcgtgcccaagcagctcttcttccagcgccggcacgccagccacgcgctgctgctggagacggtggcggccgtgccgggcatggtgggcggcatgctgctccacctgcgctcgctgcgccgcttcgagcaagcgggcggctggatccgcgcgctgctggaagaaggcgagaacnacggatgcacctcatgacgttcctggaggtgcgcagcccagtggtgggagcgcgcgc

SEQ ID NO: 77302 - protein, 85 aa, Zea mays
  misc_feature: Ceres CLONE 1562227
  misc_feature (81)..(81): Xaa is any aa, unknown, or other
MKKHHEPKALPDKLAYWLVKSLVVPKQLFFQRRHASHALLLETVAAVPGMVGGMLLHLRSLRRFEQAGGWIRALLEEGENXGCTS

SEQ ID NO: 77303 - DNA, 804 bp, Zea mays
  misc_feature: Ceres CLONE 1562233
  misc_feature: SWISSPROT Homolog: EC 3.2.1.21 Beta-glucosidase
  misc_feature (66)..(66): n is a, c, t, g, unknown, or other
cccgcggtggcggccgctctagaactagtggatcccccgggctgcaggaattcgtctcacccctangaaaaaatctctacgacaaaagcaaagcaaagcagctcaaaaaagtttagccagctagcaagacatggctccacttgttgctgctgccacgaatcacactgcccatagaagccacatatagtaggacccaacaatgagaattttccaaggcaccaaccttgttcatcacaaaacagaaacaaaagactcaggcttaggtcacgagcactaaggataagcagtcagctgcttgcaagccaaaagctgatgccatggcaaaatcctaaaagggactggtttcctcctagctttcatcttggtgccgccaccgcagcatacaaaattgaggcgccttggatgaagatgggaagggggccaagcaatggggatcccttctgccccatttatcggaattggaacctggacggaaaccatggggaacctggaaccaaattctattaaattttcccccgcggatgtccaaattctaaaggaaaaagggctgggcccctaccaattttcccttccttgggcccaaaaattgcccaaaggaaccccttcaaagggggttttaatcgggggcgggccccgttttttaaaaaaagcccttccccttttttttgaaagaaaaaaccaaaaaagccccctttttaaaaattttttttttgggggggggcccccctccaccaccgggaaaaaaaaaaaaggggggggggtttttttggggcccccgcaggttttaaaaaaaaaaaacaacaa

SEQ ID NO: 77304 - DNA, 720 bp, Zea mays
  misc_feature: Ceres CLONE 1562234
  misc_feature: Translation starting site: 162
  misc_feature: SWISSPROT Homolog: EC 2.5.1.6 Methionine adenosyltransferase
ctccccgcggtggcggccgctctagaactagtggatcccccgggctgcaggaattcgtctcacccctagaaaaagccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagtgccacatgttcggggtacgccaccgacgagacccccgagctgatgccgctcagccacgtgctggccaacaagctgggcgcgcgccctcaccgagtgcgcaaggacggcacctgcgcctggctgatgccccgacgctagacccaggtgacggtggaatacgtgaacgagggcggccgcatgttg

SEQ ID NO: 77305 - DNA, 721 bp, Zea mays
  misc_feature: Ceres CLONE 1562241
  misc_feature (424)..(424): n is a, c, t, g, unknown, or other
tccccgcggtggcggccgctctagaatagtggatcccccgggctgcaggaattcgtctcacccctagaaaaaaattggcgtcacattcgcagaccgtctcactcctctcgcacagcatccgcttctcctgccaaaccctagcacctccgtcctccgaccccctcagctccggcgatggcctccaccccgcaccctccgccgctcatcggcaagtcgggaaacctcacggtgttcttcacgccatcggcggagcacgagagcccggggtccgagttctctacgcccccgacgagccctcgcgccgaggactcccctgaatcaccaccggcgcagacagcccctccgcccgcgcctgtttactcagtatccacgccgcagcttgtcaagatgggtctccccgccgctttcccgccgagaaagctcntcccgaccctcgctgggtccaggttaccgtcggcgccccgtcaagtcgggtcttcaacgcccgctgcaaggcaccaaaagggtctcttccctggctccttggccacccgggttccagggtgcccccccctttggaaatttcccgggaaaggggcttccggccggggatcccaaaggggattgccctggctttggcggtttccttcgggggaaacccggggttttcccccccctttggcaaaaaaaaacccccccccggaaacctttgggaaaaaaaccacaattttcgcgggagaag

SEQ ID NO: 77306 - DNA, 693 bp, Zea mays
  misc_feature: Ceres CLONE 1562243
  misc_feature: Encodes the peptide sequence at SEQ ID NO. 77307
  misc_feature (652)..(652): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
ctccccgcggtggcggccgctctagaactagtggatcccccgggctgcaggaattcgtctcacccctagaaaaaaccacatctaatccttcctcccagctggtccctgcggccgctgctgctcgtccctacaagtatatcaaccaacagtgctcacatcatgcactctgtggtgtcttggtagtagttgttggggtagctagctagagagagcagcaggccagcacagcagcatggggaggtcgccgtgctgcgagaaggcgcacacgaacaagggcgcctggaccaaggaggaggaccagcggctcgtcgcctacatcaaggcccacggcgaaagctgctggaggtcgctccccaaggccgcgggcctgctgcgctgcggcaagagctgccgccctcggtggatcaaactactgcgccccgacctcaagcgcggcaactttcaccaggaggaggacgacgtcatcatcaagctccaccaggtcctcggaaaacagtggtcgctgatcgccgcccagctgccggggcggaacgaacacgagatccaagaccttctggaacccgcacattcaagcgcaagctcatcgcccgggggatcgacccccgggacccaccattcgggcaattgccccccccaattttcccccgggcgncnnnggggggggggcaaaaaaagcttttcgccccccggggg

SEQ ID NO: 77307 - protein, 153 aa, Zea mays
  misc_feature: Ceres CLONE 1562243
  misc_feature (14)..(61): Pfam Name: Myb_DNA-binding Pfam Description: Myb-like DNA-binding domain
  misc_feature (141)..(141): Xaa is any aa, unknown, or other
  misc_feature (142)..(142): Xaa is any aa, unknown, or other
MGRSPCCEKAHTNKGAWTKEEDQRLVAYIKAHGESCWRSLPKAAGLLRCGKSCRPRWIKLLRPDLKRGNFHQEEDDVIIKLHQVLGKQWSLIAAQLPGRNEHEIQDLLEPAHSSASSSPGGSTPGTHHSGNCPPQFSPGRXXGGGKKSFSPPG

SEQ ID NO: 77308 - DNA, 923 bp, Zea mays
  misc_feature: Ceres CLONE 1562245
  misc_feature: Encodes the peptide sequence at SEQ ID NO. 77309
tccccgcggtggcggccgctctagaactagtggatcccccgggctgcaggaattcgtctcacccctagaaaaaagtggtggccgccgcggccgcacgcggccgcgctgtaaagcccctgttcctcgtcctcgtccaccacagccgccccgcgccccgcctcccccgccgaaccgcccgcgcccggccgctgcgcttcctctcctgctcgacctcagcgccgccgctgttcgcagccgtcgcatccatggactcgccgccccagggttaccgcaccaacgtcggcatctgcctcgccgacccatccctcaccaagattttctcggcttctaggatcgacattcctagcgcgtggcagatgcctcagggtggtatagatgcaggggaagaaccaagggcggctgccttcagggaattgagagaagagactggtgtcacatccgcagagatcgtggctgaggctcccgtctggttaacatatgatttcccgccagatgtcagaaccaaactgaatgccaggtggggaacccgatggaaaggccaagctcaaaaatggtttttatttaggcttactggaaatgacgatgagattaacctttatggtgatggatctgagaagccagaagttggtgaatgggacatggatgacaccccaggaagttatcgaaaagggcagttgatttcagaaacctgtatatgaggaagcattgaaacactttgcccccctacctgcagtcagatccagccgcttcatcatagaagaattgggccatttgcttgcatccctgctgtatctggacccccattatttgacacgacgcatgtagccctgaggggtgcatcaaatttgatatgggtgggcccggttgaaggaatttatattgccagcttggatccccgcctccacctaggccataagttacaa

SEQ ID NO: 77309 - protein, 150 aa, Zea mays
  misc_feature: Ceres CLONE 1562245
  misc_feature (8)..(151): Pfam Name: NUDIX Pfam Description: NUDIX domain
  misc_feature: SWISSPROT Homolog: EC 3.6.1.52 Diphosphoinositol-polyphosphate diphosphatase
MDSPPQGYRTNVGICLADPSLTKIFSASRIDIPSAWQMPQGGIDAGEEPRAAAFRELREETGVTSAEIVAEAPVWLTYDFPPDVRTKLNARWGTRWKGQAQKWFLFRLTGNDDEINLYGDGSEKPEVGEWDMDDTPGSYRKGQLISETCI

SEQ ID NO: 77310 - DNA, 770 bp, Zea mays
  misc_feature: Ceres CLONE 1562246
  misc_feature: Encodes the peptide sequence at SEQ ID NO. 77311
ctccccgcggtggcggccgctctagaactagtggatcccccgggctgcaggaattcgtctcacccctagaaaaagcgattttctagagtgcgtacagtcgtcgccagtctccgggagcccaaagcaagtgcccccactgccccggcggctgccgaacctctgctccggcgactaggttcccgcctccccgactctgccccaagcgagcgcggcacgcgtgtcgccttggcttcctctcttctgcttcagtctcgcgccgccggtttctatcctgccgtcgcccggagctcatcgtgctgacctccagtgacgcgctgaagggatctgggaacttcgaggatgctttgctgtgctggccaccaggcgtcccttctcctcttcgctctgctctctgtctcctcccttctgctcgtcgacggatcccatcaggaccaggaattcggtgaagctgttggatccagaattcttcaaacaaatccagacgcacatgaggtgcattgctcaagggaaaggagccgtgcagcttgggaagctattgatgagtatttgatgcccttcgtggaaaaagaaaaatatgaactcccaagcaaatgtagacttcgtcctgataatgacatgtttcgggagcaagagcaacataagattcattttgattattaaatgagtgggcactgtggcttttgcaagaaagctttccgaagcagagaaagtcattggatcagcatttttgaaatcgccacaagaaccctggtgaataattagtgaaaaga

SEQ ID NO: 77311 - protein, 106 aa, Zea mays
  misc_feature: Ceres CLONE 1562246
MLCCAGHQASLLLFALLSVSSLLLVDGSHQDQEFGEAVGSRILQTNPDAHEVHCSRERSRAAWEAIDEYLMPFVEKEKYELPSKCRLRPDNDMFREQEQHKIHFDY

SEQ ID NO: 77312 - DNA, 792 bp, Zea mays
  misc_feature: Ceres CLONE 1562249
tccccgcggtggcggccgctctagaactagtggatcccccgggctgcaggaattcgtctcacccctagaaaaattggttcattcggaccggctatggcagtccgacaggtcttctccgctctccttcgataaagattcagactgcgtgcggcctgctcctcctcgacgcgcaccttggggtcgtcctcctcgcggagtcaccggcgcgtgcactctcttacgagcgaccgcgggaaggagctcgtggcggcgctcttggagagccccgggatccgccacgcggtcaaccggatgaacggcgcgccggagatgcggatctaggtaagggaggacggggcgcccaagcacgtctacctgttccagcgcgagtacgccacagtggatccagcacgcgtccagttagttggcacagatgacgctactacatgcattggtgatgtacttcgcaacgacaagactggaatgtaagtgtaagagaagtgagcatttatctgatcctgacctctgttagccagatggatgttccaggacatgtcgagggtaggatcgggtccatgttagcattgcctggtgatgacgatgcaccagttgatgttcaccttgatggggggctttgctgatgctgacaaagagggtgctacggtcctctgggatagatacctatcaatcgggaagggcacttcctattccactatgtggcaaaagtagctggaaatggcttgattagtgccaagctacgaatttcaaattttcgattgcttttggtggccctgggggaggaaaaacaaagaa

SEQ ID NO: 77313 - DNA, 875 bp, Zea mays
  misc_feature: Ceres CLONE 1562250
  misc_feature: Encodes the peptide sequence at SEQ ID NO. 77314
  misc_feature (697)..(697): n is a, c, t, g, unknown, or other
ctccccgcggtggcggccgctctagaactagtggatcccccgggctgcaggaattcgtctcacccctagaaaaaagccagccaggcccaggagcgcgagttctgtgcctgtgcctctgctccacctcccctgcccctgcgccccaagtccacgtccaccactcagcactcacgctgctcgctcgctcgctcgtacacgcgcccgcttcgcgcagggaaggaaccgtgggagggaagcggacggacatgatgcacgccaagtcggagtcggacgtgacgagcctggcggcgtcgtcgccgcctcggtcgcctaagcggggcggcggcggcgccggcaacggcggctactacgtgcagagcccgtcgcgggagtcgcacgacggcggctacaagtcctcgtcgatgcagcccacgccggtctacaacagccccaacgagtcgccgtcgcacccctcctacggccgccactcccgctcctcctccgtcagccgcttctccggcaacctccgcaagggcgccgccggggaccgcaaggtgctcaacgacaaagggtggcccgagtgcaacgtcatcgaggaggagggcccgtacgaagacctcgccagcgatagcggcctctcccgccgctggcagatcatactcgggctcctcaacttcgtcctcctctttcacgtcttctggctcatcatctggggcgnccgccctgtcgtacgagcccgaagtcatcgtccagaagcttggtgatggacgacttctacgcagggtgaagcacggaccaaagcggcggtcaacaaaattggtcacaacaaatggtctctgcacatagcggtcataaacctgccacaatggttggaatacaagtcactcctggcccaa

SEQ ID NO: 77314 - protein, 165 aa, Zea mays
  misc_feature: Ceres CLONE 1562250
  misc_feature (151)..(151): Xaa is any aa, unknown, or other
MMHAKSESDVTSLAASSPPRSPKRGGGGAGNGGYYVQSPSRESHDGGYKSSSMQPTPVYNSPNESPSHPSYGRHSRSSSVSRFSGNLRKGAAGDRKVLNDKGWPECNVIEEEGPYEDLASDSGLSRRWQIILGLLNFVLLFHVFWLIIWGXRPVVRARSHRPEAW

SEQ ID NO: 77315 - DNA, 934 bp, Zea mays
  misc_feature: Ceres CLONE 1562252
  misc_feature: Encodes the peptide sequence at SEQ ID NO. 77316
  misc_feature (340)..(340): n is a, c, t, g, unknown, or other
  misc_feature (440)..(440): n is a, c, t, g, unknown, or other
acccgcggtggcggccgctctagaactagtggatcccccgggctgcaggaattcgtctcacccctagaaaaaaaaaactgtctctcccacgtccttccgggtcctatcgctcctctccgtcgccggtggagctcatggcatcctccatggccgccgccgccaccgccaccgccctcccgctgccgtccgggacgacgcagaggccgtctgcccagggccgcctcctcttcaccgccgcgcccgcccgctccctccgcctccgccccgccggccgccggtcggcccgctcctcgcctcgggccaccaaggctgtggtggcagcgttggctgatcctctcanggtcatgatatcaggagctccggcgtccggcaagggcacacagtgcgagctcatcaaaacaaatatcaactggcgcacatctcccgccgagatttgttgngggcggagatcgctgctggctctaagaacgggaagccgggcaaaggaattcatgggagaggggccacctcctgcctaaaaaaaattgcctttaaaatggggaaagggaacccttttggaaccaaaaccccttaaaaaaagggttgggtttttgggccgggttccccaaaagactttttcccgggccctggggccttggaaaaacttttgaaaaacccgccgaagaaatttcctttttgttgaaaagttcccaaaagaacacccctttttaaaaaggtgggtgttgaagaggggttttttttttttttagggggaaaaaatatctttttggggatttctccccgcccaaaaaagaaaaaaaactctctgggggggtttcccaaaatatttttccacacaaaaaaaaaaaatttttttgggggggggggtttttttcaccaaaaagggcgcgcctcttcctaaaacaaaagaaaaatattttttttggggggggag

SEQ ID NO: 77316 - protein, 127 aa, Zea mays
  misc_feature: Ceres CLONE 1562252
  misc_feature: SWISSPROT Homolog: EC 2.7.4.3 Adenylate kinase
  misc_feature (69)..(69): Xaa is any aa, unknown, or other
  misc_feature (102)..(102): Xaa is any aa, unknown, or other
MASSMAAAATATALPLPSGTTQRPSAQGRLLFTAAPARSLRLRPAGRRSARSSPRATKAVVAALADPLXVMISGAPASGKGTQCELIKTNINWRTSPAEICXGRRSLLALRTGSRAKEFMGEGPPPA

SEQ ID NO: 77317 - DNA, 804 bp, Zea mays
  misc_feature: Ceres CLONE 1562259
  misc_feature: Encodes the peptide sequence at SEQ ID NO. 77318
  misc_feature (348)..(348): n is a, c, t, g, unknown, or other
  misc_feature (363)..(363): n is a, c, t, g, unknown, or other
  misc_feature (368)..(368): n is a, c, t, g, unknown, or other
  misc_feature (369)..(369): n is a, c, t, g, unknown, or other
  misc_feature (383)..(383): n is a, c, t, g, unknown, or other
  misc_feature (415)..(415): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (743)..(743): n is a, c, t, g, unknown, or other
  misc_feature (784)..(784): n is a, c, t, g, unknown, or other
  misc_feature (785)..(785): n is a, c, t, g, unknown, or other
ctccccgcggtggcggccgctctagaactagtggatcccccgggctgcaggaattcgtctcacccctagaaaaaggggttaacttccaaggaaccagttcattgctggttctgctagcaggaggttggatttcagaggcagaagctttcagccaggcgggctcagggcgcgggcacatcaatggctggcaaggaaatcctccacaaggtgaaggacaaggtgaaagatgcatttagttcatcaggaccagaaacagggaaaggcaagacaaagttatcaggcaagcgtgtcaagcatggttaccatctggtgaagggcaaatctaatcatccaatggaggattatctnagtggcagagtaccnggcannagttggtgaacatngatttgggggattgggtttggctataatttcnaaaggggttaaccccgggggcgcccacacgtggtttccccaaaaaattttttttaggaaaccccccccccctttttttttataaaaaaaaaaaacccctttgggggggggggggcgcccaacaaaaaaatttcttttggggggggggggggggcccaaaaaaaaaaaaaagggtgttttttttttctacaaaaaaaaaaagaaaaccccccccccccccccctccttttttttgggggggggagagggnnnnaaaaaaaaaaaaaaatttttttttgtgggggaagagaaaaaacccccccccccccccccccccccccnnnnnnntnttttttttttaaaaaaaaaaaaaaaaaagagaggagaagannccccccccccggcccccct

SEQ ID NO: 77318 - protein, 65 aa, Zea mays
  misc_feature: Ceres CLONE 1562259
  misc_feature (63)..(63): Xaa is any aa, unknown, or other
MAGKEILHKVKDKVKDAFSSSGPETGKGKTKLSGKRVKHGYHLVKGKSNHPMEDYLSGRVPGXSW

SEQ ID NO: 77319 - DNA, 796 bp, Zea mays
  misc_feature: Ceres CLONE 1562265
  misc_feature: Encodes the peptide sequence at SEQ ID NO. 77320
  misc_feature (683)..(683): n is a, c, t, g, unknown, or other
  misc_feature (750)..(750): n is a, c, t, g, unknown, or other
  misc_feature (789)..(789): n is a, c, t, g, unknown, or other
ctacccgcggtggcggccgctctagaactagtggatcccccgggctgcaggaattcgtctcacccctagaaaaaagtgagccgccccgccgctcctcagccatcctctccatctcggtgtcacacactccgcatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctctcctacgacttcggcgcgctggagccggccatctcgggggagatcatgcgcctgcaccaccagaagcaccacgccacctacgtcgccaactacaacaaggcgctggagcagctcgacgctgccgtcgccaagggcgacgcctccgctgtcgtccagctccagggcgccatcaagttcaacggcggcggtcatgtgaaccattcaatcttttggaagaacctcaagcctattagcgaaggtggtggggagccgccacatgggaaacttggctgggccatcgatgaggattttggttcatttgaggcacttggtaaagagatgaatgcagaaggcgctgctttacaggatctggatggggtggtggttagctttgggataaagaggcnaaaaagctttcagttgaaactacagcctatcagggatcctctgggtgactaaaggtgcaagcttggntcccgctgtttgggggattgatggtctgggaagcatgcngtactac

SEQ ID NO: 77320 - protein, 183 aa, Zea mays
  misc_feature: Ceres CLONE 1562265
  misc_feature (32)..(113): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
  misc_feature (167)..(167): Xaa is any aa, unknown, or other
MALRTLASKNALSFALGGAARPSAASARGVTTVALPDLSYDFGALEPAISGEIMRLHHQKHHATYVANYNKALEQLDAAVAKGDASAVVQLQGAIKFNGGGHVNHSIFWKNLKPISEGGGEPPHGKLGWAIDEDFGSFEALGKEMNAEGAALQDLDGVVVSFGIKRXKSFQLKLQPIRDPLGD

SEQ ID NO: 77321 - DNA, 847 bp, Zea mays
  misc_feature: Ceres CLONE 1562273
  misc_feature: Encodes the peptide sequence at SEQ ID NO. 77322
  misc_feature (768)..(768): n is a, c, t, g, unknown, or other
  misc_feature (799)..(799): n is a, c, t, g, unknown, or other
ccccgcggtggcggccgctctagaactagtggatcccccgggctgcaggaattcgtctcacccctagaaaaagagtttgaagctagaggtgtcagaaaagttaccacagggataactggcttgtggcagccaagcgttcatagcgacgttgctttttgatccttcgatgtcggctcttcctatcattgtgaagcagaaaaccgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaagaaggccgccgcggcggcggcggcggcggcggcggcgaagcctgccacgagggcgtacgtgacgttcctggcgggcgacggcgactactggaagggcgtggtggggctggccaagggcctgcgcaaggtccgctcggcctaccccctggtggtggccgtgctgcccgacgtgcccgagtcccaccgccgcatcctcgtctcgcagggctgcgtcgtccgcgagatcgagcccgtgtacccgcctgagaaccagacgcagttcgccatggcgtactacgtcatcaactactccaagctccgcatctgggagttcgtggagtacgagaggatggtgtacctggacgcggacatccaggtgttcgagaacatcgacggcctgttcgagctcgagaaggggtacttctacgncgtgatggactgcttctgccagaagacgtgnagccacaccccgcagtcaggatcggctactgccagcattgccgggaca

SEQ ID NO: 77322 - protein, 175 aa, Zea mays
  misc_feature: Ceres CLONE 1562273
  misc_feature (33)..(173): Pfam Name: Glyco_transf_8 Pfam Description: Glycosyl transferase family 8
  misc_feature: SWISSPROT Homolog: EC 2.4.1.186 Glycogenin glucosyltransferase
  misc_feature (149)..(149): Xaa is any aa, unknown, or other
  misc_feature (159)..(159): Xaa is any aa, unknown, or other
MAPELMTAKMTAKKAAAAAAAAAAAKPATRAYVTFLAGDGDYWKGVVGLAKGLRKVRSAYPLVVAVLPDVPESHRRILVSQGCVVREIEPVYPPENQTQFAMAYYVINYSKLRIWEFVEYERMVYLDADIQVFENIDGLFELEKGYFYXVMDCFCQKTXSHTPQSGSATASIAGT

SEQ ID NO: 77323 - DNA, 833 bp, Zea mays
  misc_feature: Ceres CLONE 1562275
  misc_feature: Encodes the peptide sequence at SEQ ID NO. 77324
  misc_feature (680)..(680): n is a, c, t, g, unknown, or other
aaagctggagctccccgcggtggcggccgcttccgaactagtggatcccccgggctgcatgaattcgtctcacccctagaaaaaccccaactccccgtcgcgctttctcctagtgaggctactgggtgaccgccgcctctgccgccctacgccaggttccaggtcttcgtcactccctttcattatcttcgtcgtctcattcgccggcgacgagcacccaccagaaatcatagctgctttgggtatggaggcgctgtttgggagcaataaccatggcggccacaaggccgctgatttggcctcgcttataattacccaggttgccttggaggtgccaaggttacttgggctccttgccatgattctgcataatgaaatctttacatctggtggagaccagaatttgattactaggattctgggcaaaagcgaagatgaaactaatcctgagaacaaagatgatggagagtccgatgatgataatgatgatgaaggagacgatgatgatgctgaaaacgaggaggaagatgatggtggtgatgaggggatcagatgacaatgaggaatgaggaagatgacgattggagatgatgatgatcctgcagccaatggcgaagggggaagcgatgaccacgaagatgatggtggagaggatgaagaggatgatgacgaacacgacnagaatggggacgatggcatatatggaagaggagaagaattcggaagaggagaggaggaagattacagggcccgaccgcccgccccaataggaaatgtaaggggctgggagcggcggtgggcaaaaggcagatatgatggaggtgtagtacgtt

SEQ ID NO: 77324 - protein, 103 aa, Zea mays
  misc_feature: Ceres CLONE 1562275
MEALFGSNNHGGHKAADLASLIITQVALEVPRLLGLLAMILHNEIFTSGGDQNLITRILGKSEDETNPENKDDGESDDDNDDEGDDDDAENEEEDDGGDEGIR

SEQ ID NO: 77325 - DNA, 836 bp, Zea mays
  misc_feature: Ceres CLONE 1562279
  misc_feature: Encodes the peptide sequence at SEQ ID NO. 77326
  misc_feature (533)..(533): n is a, c, t, g, unknown, or other
  misc_feature (565)..(565): n is a, c, t, g, unknown, or other
ctggagctccccgcggtggcggccgctctagaactagtggatcccccgggctgcaggaattcgtctcacccctagaaaaaacctccacagctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctggggaaaaagagcgagctgctcctccgcgccaacccggtgcacaagaagatccccgtgctgctgcacgacggccgccccgtctgcgagtccctcgtcatcgtgcagtacctcgacgaggcgttcccggcggcggcgccggcgctgctccccgccgacccctacgcgcgcgcgcaggcccgcttctgggcggactacgtcgacaagaagctgtacgactgcngcaacccggctgtggaagctccaggggggacngccaggcgcaaggcgcgcgcccgagattggtcgagaatctccggcacgccgggagggcccgcctccggggacgggcccttttctttcgggggggaaagccccctgggggttttcttcaaaatttccggcctcgtggccccttttacggggtgggggggtgtcctgcgccctttaaaaaacccttttttgggggggggtcaaccgggggaggaaaaaagagaggcgccccccaaagagggggggcccccctgtggggccaaaaaaaccgtct

SEQ ID NO: 77326 - protein, 215 aa, Zea mays
  misc_feature: Ceres CLONE 1562279
  misc_feature (7)..(80): Pfam Name: GST_N Pfam Description: Glutathione S-transferase, N-terminal domain
  misc_feature: SWISSPROT Homolog: EC 4.4.1.5 Lactoylglutathione lyase
  misc_feature (115)..(115): Xaa is any aa, unknown, or other
MAEEKKQGLQLLDFWVSPFGQRCRIALDEKGLAYEYLEQDLGKKSELLLRANPVHKKIPVLLHDGRPVCESLVIVQYLDEAFPAAAPALLPADPYARAQARFWADYVDKKLYDCXNPAVEAPGGTARRKARARDWSRISGTPGGPASGDGPFSFGGESPLGVFFKISGLVAPFTGWGGVLRPLKNPFLGGGQPGEEKREAPPKEGGPPCGAKKTV

SEQ ID NO: 77327 - DNA, 814 bp, Zea mays
  misc_feature: Ceres CLONE 1562281
  misc_feature: Encodes the peptide sequence at SEQ ID NO. 77328
  misc_feature (657)..(657): n is a, c, t, g, unknown, or other
  misc_feature (677)..(677): n is a, c, t, g, unknown, or other
ctccccgcggtggcggccgctctagaactagtggatcccccgggctgcaggaattcgtctcacccctagaaaaacccgttgccacacatacggatccaacaaaatctcccgcaaagacaacggcgagccaaccaccaccagcgtcccgcgctagctgcggcaccgcatggctgccgtgaccagcaccgcctccatctgcccggccgcagccggcgccctctcttcgctgccgtccttcatcacgcgcaagcccaccagcggcagcaggaggttgcagcaggcagcagcgacgacagtctgccactgccgctctgctcgggtagaggaggggctgctgggccggagggacgccttattgctcggcatcgtcttctccgccgcgacgccgccgctgctcgcccctgccggcgctctggcggacgaggccaccgccgagtcgcaggagggcttcactacgtacgaggatgaggccaacaagttcagcattcaagttccgcaaggctggctggtcggcgccggcgaggccagcgtcatcaagtctgtcacggcgttctaccccgagcaggccgccaccgactccaatgtcagcgtcgccatcccagggatctggccggacttcaccagacctcaagtccttcggcgacatcaatgccttcngccgagggtctgggtgaacngcctggacagggagctggcagaagccggcctggggctcgcccgccaaagctcatcgactgcagggcgggcaaacggacctgtaactacctgggagtacacggctgcagaaaccccgagcgagcgaacgggggccacc

SEQ ID NO: 77328 - protein, 216 aa, Zea mays
  misc_feature: Ceres CLONE 1562281
  misc_feature (164)..(164): Xaa is any aa, unknown, or other
  misc_feature (171)..(171): Xaa is any aa, unknown, or other
MAAVTSTASICPAAAGALSSLPSFITRKPTSGSRRLQQAAATTVCHCRSARVEEGLLGRRDALLLGIVFSAATPPLLAPAGALADEATAESQEGFTTYEDEANKFSIQVPQGWLVGAGEASVIKSVTAFYPEQAATDSNVSVAIPGIWPDFTRPQVLRRHQCLXPRVWVNXLDRELAEAGLGLARQSSSTAGRANGPVTTWEYTAAETPSERTGAT

SEQ ID NO: 77329 - DNA, 809 bp, Zea mays
  misc_feature: Ceres CLONE 1562284
  misc_feature: Encodes the peptide sequence at SEQ ID NO. 77330
ctccccgcggtggcggccgctctagaactagtggatcccccgggctgcaggaattcgtctcacccctagaaaaaacctcgcccccgaaccttggcgtctgccctaccaaccgcagcagcgacactagaatggccgcggcgccgtcatccctcgcgtcctcccacctctccccaatcgcggcggtgtccactcccgccgtcccacatcagcttcgcatcggctgctcccgccgccgcgcccagcgcatcgttgccatggctggatccggcaagttcttcgtcggaggcaactggaagtgcaatggaacaaaggactccattagcaaacttgtctctgaattgaatgctgctacccttgaaactgatgtagatgttgtggtggcacctccattcatctatattgatcaggttaagaattcactaactggtcgcattgaggtttctgctccgaatgtgtggattggaaaaggaggagcctaccccggagagatcagtgcagaacaactggtggacatccgctgtcaataggttattcttggacactctgaacgtaaacatattattgggggaaaaggaggaatttatgggaaagaaagctgcatatgcattgaacccaaaatgttaaggttattggcctgcataaggaaaacctgctggaaaaaaaagggaaacccggccaaaacctctgaagggatggtgtttagggccaaaatagaaggcttttttgccaaatagtaattttcacaaccgagggcaaaaaatgttggtaaatttggcctatccaaagcccgttttttgggggccaaaatg

SEQ ID NO: 77330 - protein, 132 aa, Zea mays
  misc_feature: Ceres CLONE 1562284
  misc_feature (49)..(131): Pfam Name: TIM Pfam Description: Triosephosphate isomerase
  misc_feature: SWISSPROT Homolog: EC 5.3.1.1 Triose-phosphate isomerase
MAAAPSSLASSHLSPIAAVSTPAVPHQLRIGCSRRRAQRIVAMAGSGKFFVGGNWKCNGTKDSISKLVSELNAATLETDVDVVVAPPFIYIDQVKNSLTGRIEVSAPNVWIGKGGAYPGEISAEQLVDIRCQ

SEQ ID NO: 77331 - DNA, 821 bp, Zea mays
  misc_feature: Ceres CLONE 1562285
  misc_feature: Translation starting site: 505
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
ggagctccccgcggtggcggccgctctagaactagtggatcccccgggctgcaggaattcgtctcacccctagaaaaatccgctgcaggtggtctaggatcgccaaacacctgcctggcaggaccgacaacgaggtcaagaaccactggaactcgtacctcaagaagagggtcgagggcaaggatggacccagcacgccgccgtccgattcagacgactcgcattgcgccaagcccgggggcggaagcacggcgcgggagacgggagacgaccgcccagcggactactccggctcgtcggagccgcgcgagccgtcgtcgtcgtcgtcgcccgacacgagctgcctgacgggcccgcccaaggtcatgttcgtggactggctcgacatggactgcatggtggggnnnnggggtggttgccccgccgggcgcggcggcagcggcagcggcacctggtctgggcgctgctgcgggcgtggccagggccagcacgggcgatgatcagatgacgatggatgatgggtcggcgtccggtcgtgccgacgtgtccctgcacggtacgttcggtgacagcggcggcgccggctgctgggagttccacgagagcttcgatcagatgcaggcggccggcttctgcgacctgctctcctccattggcgagtactacttcggactcgactaggctctcggccctggttggttgatcggtcgttgctcaaggatttgcgcgtttttttttttttttacttttgttagaagtttcgatggatggctttgtctgtgcttgtaaattggtgtcgtgtacggtatagatagagcaat

SEQ ID NO: 77332 - DNA, 912 bp, Zea mays
  misc_feature: Ceres CLONE 1562287
  misc_feature: Encodes the peptide sequence at SEQ ID NO. 77333
ctccccgcggtggcggccgctctagaactagtggatcccccgggctgcaggaattcgtctcacccctagaaaaaaccgcccccgatccaccattcctcctccggatttcgcagtcagcggtggtgaaggtagcgggcgcggaggaagatggggctcgcgttcgggaagctcttcagccggctcttcgccaagaaggagatgcggattcttatggtcggtctcgacgccgccggtaaaaccaccatcctctacaagctcaagctcggcgagatcgtcacaaccatccccaccatcggtttcaatgttgaaactgttgagtacaagaacattagcttcacggtctgggatgtcgggggtcaggacaagatcagacctctctggaggcattacttccagaacacacagggtcttatctttgttgtggatagcaatgaccgtgaccgtgttgttgaagccagagatgagctgcacaggatgctgaacgaggatgagctacgtgatgctgtgctgcttgtttttgccaacaagcaagatcttcctaatgccatgaatgctgctgagatcactgacaagcttggattacactccctgcgccagcgacactggtacatccagagcacttgtgccacaactggcgagggtctgtacgagggcctggactggctgtccagcaacattgcgagcaaggctttgatatcaaatgcgaactgactaggagctcccgatgtatcatggaaacttaggacagaatcgcctctgcaaccctgttagtgtcttctaccggcacaatatatttttttgtttggataatgtaatgatgttacgggtcaacgtttattctaccctacaatactggtgggatgtccttggggcctgtttcattttgcacaagaatgggagttccaatatcag

SEQ ID NO: 77333 - protein, 187 aa, Zea mays
  misc_feature: Ceres CLONE 1562287
  misc_feature (5)..(177): Pfam Name: Arf Pfam Description: ADP-ribosylation factor family
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKALISNAN

SEQ ID NO: 77334 - DNA, 803 bp, Zea mays
  misc_feature: Ceres CLONE 1562288
  misc_feature: Encodes the peptide sequence at SEQ ID NO. 77335
  misc_feature (569)..(569): n is a, c, t, g, unknown, or other
  misc_feature (643)..(643): n is a, c, t, g, unknown, or other
ctctccgcggtggcggccgctctagaactagtggatcccccgggctgcaggaattcgtctcacccctagaaaaaatcctcaagacatcagctagctagccttccctacagcaactgcttacatacaacacttccatcttcccgagctcgtattcgatcaattcccaattcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgctggaggcgctcgtcgacgcggaacggcgcggcgaggttgtggcgccggtggacgacctggactgggaggacatcttctacatccacgacggatgccagtggccgtccgacccgccggcgttcaaggagaccatgcgcgagtaccgcgccgagctgaagaagctcgnccagcgcgtcatggaaggcatgggacgagaacctcggcctcgccaggggcaccatcaagggcggccttctccancgggcggcgggacaagcccttctttcggaaccaaaggtcagccaattacccggccttgcccccggcccggaaacttattaaaggggcctgggcggcgcaaacaccaaaacccgggggggggtatttccctgggttttccagaaaaaaaaaaaagggcggc

SEQ ID NO: 77335 - protein, 204 aa, Zea mays
  misc_feature: Ceres CLONE 1562288
  misc_feature: SWISSPROT Homolog: EC 1.14.17.4 Aminocyclopropanecarboxylate oxidase
  misc_feature (127)..(127): Xaa is any aa, unknown, or other
  misc_feature (152)..(152): Xaa is any aa, unknown, or other
MVVPVIDFSKLDGAERAETLAQIANGCEEWGFFQLVNHGIPLELLERVKKVCSDCYRLREAGFKASEPVRTLEALVDAERRGEVVAPVDDLDWEDIFYIHDGCQWPSDPPAFKETMREYRAELKKLXQRVMEGMGREPRPRQGHHQGRPSPXGGGTSPSFGTKGQPITRPCPRPGNLLKGPGRRKHQNPGGGISLGFPEKKKRA

SEQ ID NO: 77336 - DNA, 785 bp, Zea mays
  misc_feature: Ceres CLONE 1562289
  misc_feature: Encodes the peptide sequence at SEQ ID NO. 77337
  misc_feature (708)..(708): n is a, c, t, g, unknown, or other
ctccccgcggtggcggccgctctagaactagtggatcccccgggctgcaggaattcgtctcacccctagaaaaaatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccatgcaagatcgatctggagccccaacagattgtggacttcatcaagtttgatgttggcaacgtcgtcatgggtgactggtnggaggaacactgggcccgtggtgggtgttatcaagaaccaggatgagcaccagggcagctttgagacccatcacgtt

SEQ ID NO: 77337 - protein, 175 aa, Zea mays
  misc_feature: Ceres CLONE 1562289
  misc_feature (94)..(168): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTMQDRSGAPTDCGLHQV

SEQ ID NO: 77338 - DNA, 1333 bp, Zea mays
  misc_feature: Ceres CLONE 1562290
  misc_feature (49)..(49): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (334)..(334): n is a, c, t, g, unknown, or other
  misc_feature (988)..(988): n is a, c, t, g, unknown, or other
  misc_feature (1064)..(1064): n is a, c, t, g, unknown, or other
  misc_feature (1196)..(1196): n is a, c, t, g, unknown, or other
cccaacgagagtgcggccggtccacccttcttcccctctaaacatggtnttttnnnnnnnggannnnnnnnaaaaactggagctccccgcggtggcggccgctctagactagtggatcccccgggctgcaggaattcgtctcacccctagaaaaaagcagccagctcccactcgcaccgcccgtccgcccagaactatctcgctcgtccgcgttcagctcagctactccaatttcgcaacaagttgcaagcaataaccgaccaagtacgacgaacgggtgcgatggccacgctctccccctgcagccgcctgaggagcggtaccgggagccgcnaccatccaccggcagccggcccgtgcctggagccgcccctcgtcgtcacctgcatggcggaacttcctccgggaccgtcccgggccggggtccgtttatcaccgccggcggtcgcccgggtggcctaaaaaccgccgaaaacccgggggtgttcccctcccccccccggggggggggttcgaagctccgggggggggcgcccgggtgcctccgtgaaagatcaattgtgcccgggccttcccggccccctgtttttggggcggagtggggttggacgcgccgggttttttatgatgccccgggccgtgcctcatcgcaaatatgagcgcccccccaacaacaaggggtgtttccgcgtggggtacgggctttttcccagttgagagggatgctccctaccccgcccgcccctgctcttgcggttctccctttgcgaatactcacgccccgttcacttcgctcgagcgccattcgccttcgaggtgccagagttgcggaaaatctgtctagagtgcctcgtccccgcctgtttctgatgatgagccgctgcgtatgtgtttgacgccttcgaggcgtgtccgctacggaagataacttctctctgtatctgagatctcgtgtcgccaatcttctgtcctcgcgtctcctcctatnctacacactccacgtggtacacctctgaggagcgggggtggcttctgcctatcctcggacgttctcaccgctcgcntgatacacagtctctctgtgtgtgtgtgattccacccgttgcatcactgacgcgtaggagcgtgagtgatgggctgcctgtcgacggcgacccgcggcgtttcgtgcgaatcacatagagtcgtgtgggctntattgtgtcagcgggacatcccggacgtcgctattaatattagagtgtgtgcggatgcgtcgctcacgctcgacatgctgtgtgcagatagtgactgcagcgccgctacggagagcgaacgagtgtgtgcgtgccgc

SEQ ID NO: 77339 - DNA, 782 bp, Zea mays
  misc_feature: Ceres CLONE 1562291
  misc_feature (209)..(209): n is a, c, t, g, unknown, or other
  misc_feature (228)..(228): n is a, c, t, g, unknown, or other
  misc_feature (257)..(257): n is a, c, t, g, unknown, or other
ctccccgcggtggcggccgctctagaactagtggatcccccgggctgcaggaattcgtctcacccctagaaaaactgggaacgttgacaattcagtagagacatcaagtgctgcaactgccttcaaagatgataggttaacctttgtttggttagatggagaagtacaaaagcaaatttgtgccttctaccttgccactgattatactnggagcctgtggcctctcgnagaacttttgggaggatgaccaatggatnaaaccctggaaaaattttttatttgtttcgaatttccccaaaaagaaaattgccccccctttttttttggggggccctgaaaacctaaaaaaaaaaaacaaaccttgtgggaagttttttccccggggaaaacaaattgtttataggccccccccccctattttggggggaaaggggaaaaagggggccccccctttttttttttttttgaagaaagaaaaaaaaaaagggggggggggtttcctcctcaaaaaaatttttcccccaaggggggggggggagtaattcttctccaaaaaaaattttcccccccccccccttttttttcccccatttaaaaggggggggggcgcccaaaatttatttttttgttctccccctcggagggaaaaaaaagaaacaacaccccccccccccccgcggcgggggggggggtttttttttttttaaaaaaaaaaaaaaaaatttccccccccccccctcccgccgcgcgggggggaagaaaaaaaaaaaaaaaaataaaaa

SEQ ID NO: 77340 - DNA, 801 bp, Zea mays
  misc_feature: Ceres CLONE 1562292
  misc_feature: Encodes the peptide sequence at SEQ ID NO. 77341
ctcaccgcggtggcggccgctctagaactagtggatcccccgggctgcaggaattcgtctcacccctagaaaaagcatcttgcctgcccacccaagcttccctttcgttcctcctcgccccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacccttttgatggctacgctcaccttttcgtccgggcttgcctgtggccttgctggggctgcagctggcatggccatcggcatttggtggtgatgctggagtcaggccgaatgcacacagccgaagctttttgtgggcatgatcctcatccccatttttcgcaaagcgcttgctcgggacgggcccattggttgaattacccctttcatccggggcggtcaatcccgaggaaaataagtggccctacctttctgggaattaccggacgggttatttggccattccaagaaaattgaaacctttggcccctgggcaaggttattcctgttacccgtgtt

SEQ ID NO: 77341 - protein, 185 aa, Zea mays
  misc_feature: Ceres CLONE 1562292
  misc_feature (14)..(79): Pfam Name: ATP-synt_C Pfam Description: ATP synthase subunit C
  misc_feature: SWISSPROT Homolog: EC 3.6.3.14 H(+)-transporting two-sector ATPase
MSSVFSGDETAPFFGFLGAAAALVFSCMGAAYGTAKSGVGVASMGVMRPELVMKSIVPVVMAGVLGIYGLIIAVIISTGINPKAKPYYPFDGYAHLFVRACLWPCWGCSWHGHRHLVVMLESGRMHTAEAFCGHDPHPHFSQSACSGRAHWLNYPFHPGRSIPRKISGPTFLGITGRVIWPFQEN

SEQ ID NO: 77342 - DNA, 883 bp, Zea mays
  misc_feature: Ceres CLONE 1562295
  misc_feature: Translation starting site: 471
atagctggagctcaccgcggtggcggccgctctagaactagtggatcccccgggctgcaggaattcgtctcacccctagaaaaaacgcacccgagtcagtctatctctaccttgtcaccgccaccgtccgatccaggtcagcagactgctctcctcctccatcttccgctctgaatggcccgcacaacagcgaacggcccacctggcgactgggcggggacgcgccgcgcaaactgctggccaccaacgcggcccgcgagtcggcccctgccacggcctgcctgaataacccccaccaattcatcctcggcacgctctcgctcctcgagatccccgggtaccacaagcatggcggagctgctcttccgcaatctccccttccagcgctgtctcccgcaagatctcccgtgacttcgagacggacctgcggttccactcctcgctcgtgacgtggctactggtggccccccatgcgtacctggtggtgctcttcaaagacacgatgcctctgctgcatccactggatgatggtgacgaccgtggccatggacatcaggatcgtccgccggcaaaggagcgagaggggttgtactgctacgctgcttctgttagtcgatgacatggctggaacctgaggaagcgggtgactttctacgccgtgcccatgtggctacctaggatgttgtgtcctcactgaatgaaaaacggaatgctattgctcatctgaagatagacgatgactttgtcgctgttgacaattacaaagatggtgtctcaaatcgccatcacgcctactattacaaagcctaagggaactaactcctagcctccacctcatgggcgaccgcatttgttcatggcccgctaccccccgttattgacg

SEQ ID NO: 77343 - DNA, 846 bp, Zea mays
  misc_feature: Ceres CLONE 1562296
  misc_feature: SWISSPROT Homolog: EC 5.3.99.8 Capsanthin/capsorubin synthase
ctggagctccccgcggtggcggccgctctagaactagtggatcccccgggctgcaggaattcgtctcacccctagaaaaaaaccgatatgatggctaggcttttggttttcttggactacagagattgtttcaaaatggaattctctcaccttgaacaagaaaatctcaccttcctgtatgctatgcccatgtcatgcacacgaggtttctttgaggaaacatgctcagcttctacagatgcatagggctggagatctactggataggatgctgatgtgtgtgttgaacgccatgggaatccggatgctggaaagagtatgatgaggaatggtcctacattcctgttggagggtccttaccggacactgatcggaaagacattggctttggtgctgcatccagtatggtgcatcctgcatctgggtagtcactggtcagatctttgtctgaggctccaagatatgcttctgtgatatcggacatctgaggagatcagagttcctgcagaaatatgctcggagagtcgctaaattgcgtacctcaatgcttgcatggagaacactgtggactcaagagaggaaacgccaacgatccttcttccttatctgattagcgttgataatccaactgaataatgaatgcataccaacattcttcgaggcatccttcgtggtgccgtagatggatgtgcgcgatgatctctctggctcgacccatgtcatcatgcgatgtcatactgttagccatttctacatgtgtagcgataccacagactctttgcgaatggaaccctgtgcagacatctgctgatagtgaccaaacgtggctcatcccaggatcaagat

SEQ ID NO: 77344 - DNA, 811 bp, Zea mays
  misc_feature: Ceres CLONE 1562297
  misc_feature: Encodes the peptide sequence at SEQ ID NO. 77345
  misc_feature (52)..(52): n is a, c, t, g, unknown, or other
  misc_feature (661)..(661): n is a, c, t, g, unknown, or other
aaagctggagctccccgcggtggcggccgcatcagaactagtggatcccccngggctgctccaatcgtctcacccctagaaaataaaaggaggtggaattttttctattggggatgtggtgcagccaaaagtaaaaacaacgccattggtagccgacaagccacactacaatgtgaaccttaagacaatcgatgttggtggcactactctacaactcccagctcatatttttgaaccaggagaaaaaaagggtaccataatcgacagtggtaccaccttgacataccttccagaattggttttcaaagaagtaatgctcgcggtatttaacaagcatcaggatataaccttccatgatgttcaaggttttttgtgtttccaatatcctggaagtgtagatgatggattcccaaccatcacattccattttgaggatgatcttgcactacatgtgtatccccatgagtactttttcgcaaatgggaatgacgtatactgcgtgggattccaaaatggtgcatcacagtcaaaggatggaaaggacattgtgcttatgggagatcttgtcctttccaacaagttgggtatctatgacttggaaaatcgagtcattgggtggactgactacaactgttcgtcgagcattaaaattaaagacgancaaacgggcgcaacatctactgttaattcacatgaactgtcctcaagaatggaagttccactggcacatggtccccggttcctattggtgggtaacaaccggggtgccagtaatttaatttgcctaacccccctggaacgggaaaaccct

SEQ ID NO: 77345 - protein, 166 aa, Zea mays
  misc_feature: Ceres CLONE 1562297
  misc_feature: SWISSPROT Homolog: EC 3.4.23.12 Nepenthesin
  misc_feature (116)..(116): Xaa is any aa, unknown, or other
MLAVFNKHQDITFHDVQGFLCFQYPGSVDDGFPTITFHFEDDLALHVYPHEYFFANGNDVYCVGFQNGASQSKDGKDIVLMGDLVLSNKLGIYDLENRVIGWTDYNCSSSIKIKDXQTGATSTVNSHELSSRMEVPLAHGPRFLLVGNNRGASNLICLTPLERENP

SEQ ID NO: 77346 - DNA, 856 bp, Zea mays
  misc_feature: Ceres CLONE 1562298
  misc_feature: Encodes the peptide sequence at SEQ ID NO. 77347
  misc_feature (747)..(747): n is a, c, t, g, unknown, or other
ccgcggtggcggccgctctagaactagtggatcccccgggctgcaggaattcgtctcacccctagaaaaaacacacgcgaatcctcaaatctgcccttgccgccgccaccgcccgatccaggtctgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctccccttccagcgcttcgtccgcgagatcgcgcaggacttcaagacggacctgcggttccagtcctcggccgtggcggcgctgcaggaggccgcggaggcgtacctggtggggctcttcgaggacaccaacctctgcgccatccacgccaagagggtcaccatcatgcccaaggacatccagctcgcccgccgcatcaggggcgagagggcttgagctgtcgcgctgctgctgttcgtcgttgtaatgtctgaagtatatggtggtgggtgctttctatgccgtgcctatttggctatttcggacgtgttgtcctcactgaatggaaaatggaatgcgattgctcgtctgaaattaacgaatgactttttacctgcaaaaaaaaaaaaaaaaaangtcctcacgccgccctcacgcctccaacagaagaaacctaagctgccctcgctccgacgccgccacctcgtcgtccgaccgcatcgattcgatggcccgcatctccgcc

SEQ ID NO: 77347 - protein, 136 aa, Zea mays
  misc_feature: Ceres CLONE 1562298
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRFVREIAQDFKTDLRFQSSAVAALQEAAEAYLVGLFEDTNLCAIHAKRVTIMPKDIQLARRIRGERA

SEQ ID NO: 77348 - DNA, 776 bp, Zea mays
  misc_feature: Ceres CLONE 1562300
  misc_feature (212)..(212): n is a, c, t, g, unknown, or other
  misc_feature (560)..(560): n is a, c, t, g, unknown, or other
  misc_feature (594)..(594): n is a, c, t, g, unknown, or other
  misc_feature (595)..(595): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
ctccccggcggtggcggccgctctagaactagtggatcccccgggctgcaggaattcgtctcacccctagaaaaaacaggtcgcaacaaccccaacgagcaaaccccccatttgccaccaaccccgacgagcggcgatgaccggcacggtgtctaagctggcggcgccccgtccggcggcaccgccgctccggccggcgtccctccgcaccngccgccctcgcctttcgcccccctcgcgcgccgggtcgcgtctcgtcgcggggcagccaggaccccctcattgccatgggcttcggccaggaagggaatgggggcccccacccaaaagggcgggcccttttggaattcttaaaaatctcccggggcctgtccccgggggaacaaaaaccttttgggcgccccttttcaacaaaaattttggggccccctttttttcccccccgggggggttccgcggggggggtcccccccccgaaaccccaccagggtgtttttccccaaaagggggggttcttttttttctccccccgggcgggttttggtagggtggagcgcganttaaaaagaaacggcccccttttttttttttccnntnnnnnaaaaaaggaaaaccccccccaaaaaaaacacccccctcccttcgggggggggaaacaacccccctcttttatggagggaggggggatcccccccccccctattggagggggcgggggggcgccagagaaaaattttttttgtgttgtgtggagcgcgcgccccccccttccttta

SEQ ID NO: 77349 - DNA, 795 bp, Zea mays
  misc_feature: Ceres CLONE 1562301
  misc_feature: Translation starting site: 168
  misc_feature (526)..(526): n is a, c, t, g, unknown, or other
  misc_feature (587)..(587): n is a, c, t, g, unknown, or other
  misc_feature (743)..(743): n is a, c, t, g, unknown, or other
  misc_feature (745)..(745): n is a, c, t, g, unknown, or other
  misc_feature (763)..(763): n is a, c, t, g, unknown, or other
  misc_feature (773)..(773): n is a, c, t, g, unknown, or other
tggagctccccgcggtggcggccgcctctagaactagtggaatcccccgggctgcaggaattccgtctcacccctagaaaaaagaataggtgggtcgaacttcgaaggggttcgaggaacttcagctatggcatctgtgggacgtgcaggacgaggagggaaaggagatggaggggaagggagaagggtcgctggctcgcagggcgtggaggcagtacctgctccagctccagcaacatcctctccgcacaaagatgatcacggcggggtgcctcgccggcgtcagtgactccgtggcgcagaagctctctgggttccagaagattgagaaacgcagactcctgctcaagatgctctttggttttgcatatggtggcccatttggacatttcttgcacaaaattttggattacatcttccaagggaagaaggataccaaaaccatagcaaagaaggtgttattggagcaagtgacatcttctccctggaataacatattgttcttgttctattatggatatgttgnttgagaggaggcctttgaaggaggtgacgaccagggtgaagaaacaatacccttctgtgcnaactcagcgcttggatgttttggccgaatagttggttggataaaccaccagtacatgccttttacaattccgagtgatcttccacagctttgtcgcatgttggttggggggattttccctgaacccttcgtgcaaggggctatgtctctgaagcangncctagatggttttagaangaacgtatangcagccaagcctcctgccccgg

SEQ ID NO: 77350 - DNA, 830 bp, Zea mays
  misc_feature: Ceres CLONE 1562303
  misc_feature: Encodes the peptide sequence at SEQ ID NO. 77351
  misc_feature (534)..(534): n is a, c, t, g, unknown, or other
  misc_feature (557)..(557): n is a, c, t, g, unknown, or other
  misc_feature (564)..(564): n is a, c, t, g, unknown, or other
  misc_feature (723)..(723): n is a, c, t, g, unknown, or other
ccgcggtggcggccgctctagaactagtggatcccccgggctgcaggaattcgtctcacccctagaaaaaagtttctttcttgtgagggaggccaaacgatacaggaatacgatacgccgctcgcctgaatcgagaccaccaccgctcccgctctgcctcacctcgccgactagagtttttgccgccgcggatctcgccgtccccgccatggatacgtcgggctcctccgcagccgccggcgacgccccgaccaccggggagcaccggatggggaccaccattgtcggggtctgctacgagggtggcgtcgtcctcggcgctgattccagaaccagcactggaatgtatgtagccaaccgtgcttcagacaagattacccaattgacagacaatgtgtacgtttgtcgctctggatctgctgctgatacacaagtcatttcggactatatacgttatttccctccacaacacacaatccagcttggacaaccagctactgttaaaagtgcagctaacttgattaggttgctagnctatcagaataagaacatgttgncagctgncatgattgttggaggatgggataagtacgaggggagccaattttctcagtccctcttgtgggacgatcttgaagcaacatttgcaatggaggctccaggtcagttatcttttgcacttcctgatcctggatgaaaaaggggatgagccccggagaagcnaaaaatttgggggggagggagtttcccttggtatggccccggatgggctaacggaaggggtttccctacatttccaaaaaaggggaagggcggaaagggaactttcc

SEQ ID NO: 77351 - protein, 162 aa, Zea mays
  misc_feature: Ceres CLONE 1562303
  misc_feature (19)..(159): Pfam Name: Proteasome Pfam Description: Proteasome A-type and B-type
  misc_feature: SWISSPROT Homolog: EC 3.4.25.1 Proteasome endopeptidase complex
  misc_feature (109)..(109): Xaa is any aa, unknown, or other
  misc_feature (117)..(117): Xaa is any aa, unknown, or other
  misc_feature (119)..(119): Xaa is any aa, unknown, or other
MDTSGSSAAAGDAPTTGEHRMGTTIVGVCYEGGVVLGADSRTSTGMYVANRASDKITQLTDNVYVCRSGSAADTQVISDYIRYFPPQHTIQLGQPATVKSAANLIRLLXYQNKNMLXAXMIVGGWDKYEGSQFSQSLLWDDLEATFAMEAPGQLSFALPDPG

SEQ ID NO: 77352 - DNA, 924 bp, Zea mays
  misc_feature: Ceres CLONE 1562305
  misc_feature: Translation starting site: 185
ctggagctccccgcggtggcggccgctctagaactagtggatcccccgggctgcaggaattcgtctcacccctagaaaaaacctcccttcccgacccaattctcctcaatcaaagaaagtccccacgcagagcaagccaagatctgcgccgcggcgaggcgaagcaaagcaccggctggctcccatggccgtggacctgatggggtgctacgccccgcgccgcgccaacgaccagctcgccatccaggaggcggcggcggcggggctccgcagcctggagctcctcgtgtcgtcgctgtccacgcaggccgccgcgccgcacagggccgcggctcaccagctgcagaagccgccgccgcagcagccgatcggcgagatcgccgaccaggccgtctccaggttccgcaaggtcatctccatcctggaccgcaccggccacgcccgcttccggcgcgggcccgtcgtcgagccgccaccggtgcctcctccggccgtctccgctcccgctcccgctccggcccccgctctccccgtggcgcacgtggtggctcccgtcggcgcggcgcagccccagagcctgaccctggacttcaccaagccgaacctggccgtgtcgggcggcgccacgtccgtcacctccacgtccttcttctcctcggtcacggccggcgagggcagcgtgtccaagggccgcagcctggtgtcctccggcaagccgccgctgtccggccacaagcggaagccctgcgccggcgcgcactccgtaggccacaacccacggcggccgctgccactgcttccagagaaagaaaaaccgcctgaagaggaccttagaagtgccggcgatcagcggcaaaatcccggaaatcccgcccggacgaattcctctgtggaagaaataccggcccgtaaccctcctcaggg

SEQ ID NO: 77353 - DNA, 884 bp, Zea mays
  misc_feature: Ceres CLONE 1562308
  misc_feature: Encodes the peptide sequence at SEQ ID NO. 77354
  misc_feature (363)..(363): n is a, c, t, g, unknown, or other
  misc_feature (458)..(458): n is a, c, t, g, unknown, or other
ctccccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaaactcaagaacncccccagcacccccgccgacaggcggcgccgccctgcaactgcctcaagaacgccgcccaggggcgtcagcggccctcaaggccgggcacgccgnccagcatcccccttccaagggggggcgttgggcattcccttaaaccatcaggaccctccccccgattggtttccggggtggactaaaaaacctagaacaccgccgcgaacaaacggcccgccctggattctaatcgaaacaaacctttttctcccccgttcccccccccgggccgggaataaaaccgggcggggccccccccggggggaaaaatctttttcaactctctccccccgtgaaaaaaacacaaaggggccaaatttttttcccccccgggccttgtgggcccccccccaaaaaaaaaaaattcctctcccccccccggtgggggtgggtaaaaacacaaaaacccctctttttatttgtggcccgggggggggaacaactttattatttttaaaaaaaaaagttttctttttttttttt

SEQ ID NO: 77354 - protein, 240 aa, Zea mays
  misc_feature: Ceres CLONE 1562308
  misc_feature (67)..(67): Xaa is any aa, unknown, or other
MARTQSAVAVAVVAAVLLLAAAATTSEAAITCGQVSSAIAPCLSYARGTGSGPSASCCSGVRKLKNXPSTPADRRRRPATASRTPPRGVSGPQGRARRPASPFQGGALGIPLNHQDPPPDWFPGWTKKPRTPPRTNGPPWILIETNLFLPRSPPRAGNKTGRGPPRGEKSFSTLSPREKNTKGPNFFPPRALWAPPQKKKIPLPPPVGVGKNTKTPLFICGPGGGTTLLFLKKKVFFFFF

SEQ ID NO: 77355 - DNA, 775 bp, Zea mays
  misc_feature: Ceres CLONE 1562310
  misc_feature: Encodes the peptide sequence at SEQ ID NO. 77356
ctccccgcggtggcggccgctctagaactagtggatcccccgggctgcaggaattcgtctcacccctagaaaaaaaaacaaatttagctgttttttctttcgacgttttcgtccctacctcgcggttggggctcgcggctctcgcggcccgcctgtgctactgctgcacccgcacggccgcgcgcacctccaccgcaacggtcacttctagctctcgtgcagtcgtgcgtcctccatcgtcgcctctcctcccgcggtcagggtaacgccgcgtgtctcccgtcgcatactcgctcacacccatggccgcaccgccggccgcctcgctagtggcacgcgccgccctcccgccgcgccttcgcccaaccaccgcttctccccttggccccgccgtcctcggtcccagcagccgccgccggtacctccgtctccgccgctcgccatcgctggcggggactgccgcggcggcggcgagctccccatccgtgccttcctcgtttccggggcccgggccaggtatcggcgatgccctcggcgacgtcgaaatctactccgcggccaccggcgagcccgtcctgttcagagacctgtgggaccaggacgagggagtgtctgttgttgcgctgctaaggcatttcgggtgcccatgctgctgggagttggcctctgttctgagggaacaaaggagagatttgattctgctggagtaaaactgattgctgttggtgttggcactccagctaaagcccgtattcttgccgagcgctttgccttt

SEQ ID NO: 77356 - protein, 43 aa, Zea mays
  misc_feature: Ceres CLONE 1562310
MLLGVGLCSEGTKERFDSAGVKLIAVGVGTPAKARILAERFAF

SEQ ID NO: 77357 - DNA, 770 bp, Zea mays
  misc_feature: Ceres CLONE 1562312
  misc_feature: Translation starting site: 97
  misc_feature (313)..(313): n is a, c, t, g, unknown, or other
  misc_feature (533)..(533): n is a, c, t, g, unknown, or other
  misc_feature (580)..(580): n is a, c, t, g, unknown, or other
ctccccgcggtggcggccgctctagaactagtggatcccccgggctgcaggaattcgtctcacccctagaaaaactccactacacacaaacacacaatggcaccagaaacgatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgnagtgagatccaaagctccggagccttcagcgtcccactcgccgccgacctccacggcgccgactgccacgcgcagctccacagcgccgccaataacgcgccttgccctgggcaggagccgtccaggatcgcgcccatgtcaggcggcaccttcgtcgccgtgcctggcagatgcactacccgtccgcggagtgcgcgtccgcgtttctctgctcccgatncagagcacttgttagatcacttccacaaggcacccctgccggtgccngagtaccacccggtgcctgaccacagcaaagcgccggttgcgggagtaccaccccgttgcctgaacacagcaagcggggccccgggattccacccttccccccgccgggaatcccaccctcccccctccgggggttcggggcgagccaaaggcaaactccgaattttcccatccctccccccctgaaaaa

SEQ ID NO: 77358 - DNA, 834 bp, Zea mays
  misc_feature: Ceres CLONE 1562317
  misc_feature: Encodes the peptide sequence at SEQ ID NO. 77359
  misc_feature (228)..(228): n is a, c, t, g, unknown, or other
  misc_feature (280)..(280): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (480)..(480): n is a, c, t, g, unknown, or other
  misc_feature (481)..(481): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (531)..(531): n is a, c, t, g, unknown, or other
  misc_feature (532)..(532): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (764)..(764): n is a, c, t, g, unknown, or other
  misc_feature (765)..(765): n is a, c, t, g, unknown, or other
tcaccgcggtggcggccgctctagaactagtggatcccccgggctgcaggaattcgtctcacccctagaaaaagcgggtgagccggggaccctcctacgtctcgccaccctgctggtatagcccgccggtcggtccacgccatggccacacaaaatgcaccgatattccctgctatggcatgtggcttcgtcgccttccctccgccggtgccgacgacgaacccgccngctgccgcgcgccgcggcggcggcggcgtccaactccccgcggtggcccaanccccctttcaggggggcgggcgggcaaaaaggggcccctcgggccccttgtcggggctttatttttcccccccccccccaattagctatgacacagagtgagcgaccccnnncccccctgggggggagaaaaaaaaaaaagggcccttatttttgggggttttccccccccgggggaaaaaaaaaaaaaaccgggagggnnggtnnnntaaaaaaaagagattttatctgccccagaagtcataaatgagnntttattaaccctagagnnnngggttttttttttttaaaaaagtttttaaccccccccgggggggggttttttttttggaaaaaagagaaaaaaaacccccctttttttttttccccccaaaaaaaaaaaaatttttttttaaaaaccccccccccgcggggtttttttttttggggaaacccccctttttttggggggggggggggaaaaaaaatttttttttccccccccnncggggggagaaaaaaaaaaaaaaaaaagggagggcctccttttttttttttaaaaaggggggccccaaa

SEQ ID NO: 77359 - protein, 79 aa, Zea mays
  misc_feature: Ceres CLONE 1562317
  misc_feature (47)..(47): Xaa is any aa, unknown, or other
MATQNAPIFPAMACGFVAFPPPVPTTNPPAAARRGGGGVQLPAVAQXPFQGGGRAKRGPSGPLSGLYFSPPPPISYDTE

SEQ ID NO: 77360 - DNA, 1009 bp, Zea mays
  misc_feature: Ceres CLONE 1562319
  misc_feature: Encodes the peptide sequence at SEQ ID NO. 77361
gcgagtacgccgcgtgcgacctcgaggctcgagcttgacgcccgcgtgccatggctcccacggcgccgacgcagcggccgacgatgcgccactcctccgcgttcctcctcccttcaaccgcaccgtcatcgcccgcgcctggtcccgatgacgccgccgtcgcgctcgtcgtcctcaaccagccgctgccccgcttcgcgcccctcctctggtccagagcggcggtgcgggtgtgcgcggacggtggcgccaaccgcgtcttcgacggcatgccggccctgctccccggccaggaccccgacgaggttcgcgcgagttacaagccagatgtaatcaaaggggatatggactcagtaagaccagaagtgaaggagcattattccaacttgggcaccagaattgttgacgagtcacatgaccaggacacgaccgatttacacaaatgcatagcttttatagctgagaattattctgccactaacaaatctaacctcagcatcttggtccttggagcacttgggggaaggtttgatcacgagatgggaaacatcaatgtgcttcatctcttcccaagcatcaatatcgtcctcctatcagatgattgtctgatctttctgctctcgaaaatgcatacccacgagattcacgttgaaaagtcgatcgagggaccccactgtggattgatcccgattggcatgccgtcgactagcaccacgaccaccgggcttcgatggaatctagataataccagtatgagcttcggaggattgatcagcacgtcaaatatcgtggaagaggacaaggtaacggtcacctcggattcagaccttatgtggacaacatcgctccggaagtgaatctacactggagtatagagtatcagtatactgttgtaatattagagaaataagtgacatgcttttaatatatatatatatatatatatatatatatatatatatatakatagagagagtgagatatatttatatatatataaataagtata

SEQ ID NO: 77361 - protein, 268 aa, Zea mays
  misc_feature: Ceres CLONE 1562319
  misc_feature (43)..(183): Pfam Name: TPK_catalytic Pfam Description: Thiamin pyrophosphokinase, catalytic domain
  misc_feature (194)..(262): Pfam Name: TPK_B1_binding Pfam Description: Thiamin pyrophosphokinase, vitamin B1 binding domain
  misc_feature: SWISSPROT Homolog: EC 2.7.6.2 Thiamine diphosphokinase
MAPTAPTQRPTMRHSSAFLLPSTAPSSPAPGPDDAAVALVVLNQPLPRFAPLLWSRAAVRVCADGGANRVFDGMPALLPGQDPDEVRASYKPDVIKGDMDSVRPEVKEHYSNLGTRIVDESHDQDTTDLHKCIAFIAENYSATNKSNLSILVLGALGGRFDHEMGNINVLHLFPSINIVLLSDDCLIFLLSKMHTHEIHVEKSIEGPHCGLIPIGMPSTSTTTTGLRWNLDNTSMSFGGLISTSNIVEEDKVTVTSDSDLMWTTSLRK

SEQ ID NO: 77362 - DNA, 776 bp, Zea mays
  misc_feature: Ceres CLONE 1562320
  misc_feature: Encodes the peptide sequence at SEQ ID NO. 77363
tggagctcaccgcggtggcggccgctctagaactagtggatcccccgggctgcaggaattcgtctcacccctagaaaaaagtttctttcttgtgagggaggccaaacgatacaggaatacgatacgccgctcgcctgaatcgagaccaccaccgctcccgctctgcctcacctcgccgactagagtttttgccgccgcggatctcgccgtccccgccatggatacgtcgggctcctccgcagccgccggcgacgccccgaccaccggggagcaccggatggggaccaccattgtcggggtctgctacgagggtggcgtcgtcctcggcgctgattccagaaccagcactggaatgtatgtagccaaccgtgcttcagacaagattacccaattgacagacaatgtgtacgtttgtcgctctggatctgctgctgatacacaagtcatttcggactatatacgttatttcctccaccaacacacaatccagcttggacaaccagctactgttaaagttgcagctaacttgattaggttgctagcttatcagaataagaacatgttgcaagctggcatgattgttgggagatgggataagtacgagggaggccaaatttttctcagtccctcttggtgggaacgatcttgaaagcaacattttgcatttggaggctccagtttccagttatctttatgcaccttcttgatcctgaatgggaaaaagggaattgaacccaggaagaggcagagaaaatttggggggggaaagtagtttt

SEQ ID NO: 77363 - protein, 143 aa, Zea mays
  misc_feature: Ceres CLONE 1562320
  misc_feature (19)..(143): Pfam Name: Proteasome Pfam Description: Proteasome A-type and B-type
  misc_feature: SWISSPROT Homolog: EC 3.4.25.1 Proteasome endopeptidase complex
MDTSGSSAAAGDAPTTGEHRMGTTIVGVCYEGGVVLGADSRTSTGMYVANRASDKITQLTDNVYVCRSGSAADTQVISDYIRYFLHQHTIQLGQPATVKVAANLIRLLAYQNKNMLQAGMIVGRWDKYEGGQIFLSPSWWERS

SEQ ID NO: 77364 - DNA, 741 bp, Zea mays
  misc_feature: Ceres CLONE 1562322
  misc_feature: Encodes the peptide sequence at SEQ ID NO. 77365
acccgcggtggcggccgctctagaactagtggatcccccgggctgcaggaattcgtctcacccctagaaaaagcctgctgctgccatggcgacctccgcggcgctctccaccgccgccaatcccacccagctctaccggtcccgcgcttcgctgggcaagccggtgaaggggcttggcctgagcatgggccgcgagcgcgcccagcggatcattgtgtgccaggcggctagcagcatctccgccgaccgcgtccccgacatggagaatcggaagctgatgaacctcctcctcctcggcgccatctcgttgcccaccgtcggcatggtcgtcccctacggcgccttcttcgtccctgccggctccgggaacggcggcggcgggacctacgcgaaggacaagctgggcaacgacatcacggtggaggcgtggctcaacacgcacggtcccaacgaccgcacgctcgcgcaggggctcaagggtgaccccacgtacctggtgggagggagcaggtaaagacgcctggccacctactgggatcaaatgccgtggggcgcttcaccctcgggcttgccgtcgtggccttgggaaacggggggctggaaaaacaaagttttcaaccctgccccccctggccaacgggaattcccccacaggtacaaagcaacacctctgcggggcaaatggggggggggtccccgcctggggggaaaccggggcggcgcgcccttctccgttttgcc

SEQ ID NO: 77365 - protein, 142 aa, Zea mays
  misc_feature: Ceres CLONE 1562322
  misc_feature (54)..(92): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
MATSAALSTAANPTQLYRSRASLGKPVKGLGLSMGRERAQRIIVCQAASSISADRVPDMENRKLMNLLLLGAISLPTVGMVVPYGAFFVPAGSGNGGGGTYAKDKLGNDITVEAWLNTHGPNDRTLAQGLKGDPTYLVGGSR

SEQ ID NO: 77366 - DNA, 845 bp, Zea mays
  misc_feature: Ceres CLONE 1562325
  misc_feature: Encodes the peptide sequence at SEQ ID NO. 77367
  misc_feature (637)..(637): n is a, c, t, g, unknown, or other
  misc_feature (693)..(693): n is a, c, t, g, unknown, or other
  misc_feature (705)..(705): n is a, c, t, g, unknown, or other
  misc_feature (706)..(706): n is a, c, t, g, unknown, or other
  misc_feature (730)..(730): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (756)..(756): n is a, c, t, g, unknown, or other
  misc_feature (758)..(758): n is a, c, t, g, unknown, or other
  misc_feature (766)..(766): n is a, c, t, g, unknown, or other
  misc_feature (777)..(777): n is a, c, t, g, unknown, or other
  misc_feature (778)..(778): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (815)..(815): n is a, c, t, g, unknown, or other
  misc_feature (823)..(823): n is a, c, t, g, unknown, or other
ctccccgcggtggcggccgctctagaactagtggatcccccgggctgcaggaattcgtctcacccctagaaaaaacgcaaaaaacaaacacactcgaaggcagcgaagcccgagccttcccttccctccaatcgatcacccgcttcgatccgctagctagctagcagcgcgatggcttccctcaccgtgtccacgaagaccgcggcggccggcggcaacaagcagcgcgagggcgcggaggtcatcacgggcgcggaggcctgcttcgcgcactccaagcagatgctccaggcgctgggcttcccgggcggcgtgatgccgctgcgggggctggaggagtgcggctgggtgcgcgagaccgggttcgtgtggatgcggcagaaggccccctacgagcactacttccgcggcacgggcacgcgggtgcgctacgacgccgaggtcaccgcgtacgtggaggacggccggatgaagcgcatgaccggggtgcgcagcaagcaggtcatgctctggggtgcccatcgtcgagatgagcctcgacggagagaagcgcgacaagatctacttcaagtccaaacgtcgggatccggccgctcgtttccccgcctccgcccttcgctgacgagaacgaaacaanccgaaggaaggagagagaaagaagaagatgagaaccagggaggaggacaagcgacnaagccagcccgnnccgccgccgccccatgcccgcggnacatgagacgaaccccannnagccgncntgtgtgcntccttgcgggnnaacatggcgcnnnncggggggtagcacgttgccgagnatctcggncgtaacacgcgtgaaatgcaac

SEQ ID NO: 77367 - protein, 217 aa, Zea mays
  misc_feature: Ceres CLONE 1562325
  misc_feature (19)..(167): Pfam Name: DUF538 Pfam Description: Protein of unknown function, DUF538
  misc_feature (156)..(156): Xaa is any aa, unknown, or other
  misc_feature (179)..(179): Xaa is any aa, unknown, or other
  misc_feature (187)..(187): Xaa is any aa, unknown, or other
  misc_feature (193)..(193): Xaa is any aa, unknown, or other
  misc_feature (196)..(196): Xaa is any aa, unknown, or other
  misc_feature (199)..(199): Xaa is any aa, unknown, or other
  misc_feature (203)..(203): Xaa is any aa, unknown, or other
  misc_feature (207)..(207): Xaa is any aa, unknown, or other
  misc_feature (215)..(215): Xaa is any aa, unknown, or other
MASLTVSTKTAAAGGNKQREGAEVITGAEACFAHSKQMLQALGFPGGVMPLRGLEECGWVRETGFVWMRQKAPYEHYFRGTGTRVRYDAEVTAYVEDGRMKRMTGVRSKQVMLWGAHRRDEPRRREARQDLLQVQTSGSGRSFPRLRPSLTRTKQXEGRREKEEDENQGGGQATKPARXAAAPCPRXMRRTPXSRXVCXLAGXHGAXRGVARCRXSR

SEQ ID NO: 77368 - DNA, 817 bp, Zea mays
  misc_feature: Ceres CLONE 1562327
  misc_feature: Encodes the peptide sequence at SEQ ID NO. 77369
  misc_feature (708)..(708): n is a, c, t, g, unknown, or other
tggagctccccgcggtggcggccgctctagaactagtggatcccccgggctgcaggaattcgtctcacccctagaaaaaagcatcccctagtcctcgcctggactccgcggagtctttggttgctccgagttcctcgcctggttttcggcaaggccaaggaaaggtggtcacttcacttctgttttttttttttttttactgccgccgcaaacctccgctcctgtgccataccgccattccattcttaatctgggcgccgaagaagagaggacgggagcgaggtccggtcgaaaatcgtagcggattggggggaaggggggagcggcggcggcggcggcggaggccggtcggtatgattcaactgctgttcctcgtgctgttcgcggagggcgcggtggcgctgctcctcatggtgaaggtcgggccgctgcgggagctcgcgatgcgcggcgtggaccaggtgaagacgggcaagggcccggccacggtcaagacgctggcgtgcacgctctccgtcatcctcatgtccagcgtcgccagcatcctcaagatccagaacagggggctcaagctcggcaccgtcagccccatggaccaggtgctctggaggacgcacctcctcgaggcatccctcataggatacacgctattcctttgcatttgtaatcgaccggctgcaccactacctgcgaaagctgatgacactngaggaaaaatccagcacatcccagagaagaaggtggagaaacttcagatggggagaaccggtcgctccgcgaaaaaaggaggaggaagtccctcccagtgaagaccgaa

SEQ ID NO: 77369 - protein, 151 aa, Zea mays
  misc_feature: Ceres CLONE 1562327
  misc_feature (119)..(119): Xaa is any aa, unknown, or other
MIQLLFLVLFAEGAVALLLMVKVGPLRELAMRGVDQVKTGKGPATVKTLACTLSVILMSSVASILKIQNRGLKLGTVSPMDQVLWRTHLLEASLIGYTLFLCICNRPAAPLPAKADDTXGKIQHIPEKKVEKLQMGRTGRSAKKGGGSPSQ

SEQ ID NO: 77370 - DNA, 821 bp, Zea mays
  misc_feature: Ceres CLONE 1562328
  misc_feature: Encodes the peptide sequence at SEQ ID NO. 77371
  misc_feature (561)..(561): n is a, c, t, g, unknown, or other
  misc_feature (685)..(685): n is a, c, t, g, unknown, or other
  misc_feature (691)..(691): n is a, c, t, g, unknown, or other
ctggagctccccgcggtggcggccgctctagaactagtggatcccccgggctgcaggaattcgtctcacccctagaaaaaagccatccaatgctccaccaaacaacgctcatccctccctccgtctccgccgcctcctcctcgcctttcctccacgccgccaccacagccccggctccgggtggaggttcctgcaccccagccttcctgcgaggcgcctctgccatgccgtcgtacgcgcaccaccgtagcagccctctggacgatggcaggatggacgcgctgaagtgtaacaacagcgtcctgccggaggagaccaccgcggacgccgccggggcgttcgtggagaaagacgggttctcggtcgaggacctgcttgacctggaggagttcgccgagcctgacaaggacgtcgccgaacgcgaggatgacgacgcgccaccggcagccgccgcggccgcggagaggtcgaaagcggactcgcagccgtcgtcggtcgtgaagtacgacctccctccgctgctgccgccgccgccggagatggttgacctgccgtcgcacnacgtcaaggagctggagtgggtctcccgtatcatggacgactcgctctccgagctgcagccccaggcgcagccaaagccggccgctgctggtgtcgcgtcttccgcagcgcggccccctctgcncaacancggggttcgtttccgcacgacgtacttaccgggggggggcgggggggcccccccaaggcgggcccaaaaggaacccaaacatttgggccggttaaggggggcaaaaatccggtaaaggaaaaccccacaa

SEQ ID NO: 77371 - protein, 193 aa, Zea mays
  misc_feature: Ceres CLONE 1562328
  misc_feature (113)..(113): Xaa is any aa, unknown, or other
  misc_feature (154)..(154): Xaa is any aa, unknown, or other
  misc_feature (156)..(156): Xaa is any aa, unknown, or other
MPSYAHHRSSPLDDGRMDALKCNNSVLPEETTADAAGAFVEKDGFSVEDLLDLEEFAEPDKDVAEREDDDAPPAAAAAAERSKADSQPSSVVKYDLPPLLPPPPEMVDLPSHXVKELEWVSRIMDDSLSELQPQAQPKPAAAGVASSAARPPLXNXGVRFRTTYLPGGGGGAPPRRAQKEPKHLGRLRGAKIR

SEQ ID NO: 77372 - DNA, 893 bp, Zea mays
  misc_feature: Ceres CLONE 1562329
  misc_feature: Encodes the peptide sequence at SEQ ID NO. 77373
  misc_feature (893)..(893): n is a, c, t, g, unknown, or other
ctccccgcggtggcggccgctctagaactagtggatcccccgggctgcaggaattcgtctcacccctagaaaaaaacttgcgtagagagttgggcgcagagaatccccaagcaaacaaacagggtagagggagaggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccacctctgcaggatggtgacttgttcctcttcgaatcccgagcaatccccccctcttctgctcccaaaaacaagcccgatctgttgatggacggacacctctaggaggctgctatggtgcatgtttggatctaggttgaggcttacccttacccccctgctctttaccccctcctcttcctgttccctctccttcctatccttttgggaccccccccccccccacttttgccctgatcccccttataccctttactaccgtccttctatttcttcccctgccccccctcccccattttccacttcccccccccttatactttccttctccttctctcacctcaactctttatgttcgctctccctcccttccttgttttcttccccctccttcccctttttttccctcttcccctacctcccctttttccggcctccttttcttctctctccatgtcctgatgtcccttcccttctccagcctctctctttcctccttttcccctctctcccccttttaatttttttttccccttccccctctcctgtcn

SEQ ID NO: 77373 - protein, 89 aa, Zea mays
  misc_feature: Ceres CLONE 1562329
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
MAPMKLYGAVMSWNVTRCATALEEAGSDYEIVPINFATAEHKSPEHLVRNPFGQVPPLQDGDLFLFESRAIPPSSAPKNKPDLLMDGHL

SEQ ID NO: 77374 - DNA, 826 bp, Zea mays
  misc_feature: Ceres CLONE 1562332
  misc_feature: Encodes the peptide sequence at SEQ ID NO. 77375
ggagctccccgcggtggcggccgctctagaactagtggatcccccgggctgcaggaattcgtctcacccctagaaaaatctccccactccctctcgtcgccgtccatctacgttatcaatgccacgctccccacctccgaattggccccgaagcgaggtaggcagggcaccggtgggggccgacaagaagacggattaagtgacgaaccctctgttctagaaaaggcctaagcaattcggcatcaggggcgcgttgcctcccaagaaagacctgcaccgattcgtcaagtggcccaagtgtctgcgcatccaacgccagcgtcgcatcctcgagcagggcgtcaaggtgggtccggcgctcaatgagttgaaccgcaccctcaacatgaacctcgctaccaacctgttcaagatgcttcttaagtacctgccccaagacagagctgccgagatggagaggcttctgaagagggcccaggctgagaatgaacgagacactgtcgagtccaacaaaccaattcttgtgaactatggtcttaaacatgtgacttacctcattgagctgaacaaggctcacctcgttgtcatcgctcatgatcgtgatccgattggaactggtctgtttggcctgccagcccctgttcatgaaagatggaaagtccccattactggatttgtttaaaaggaaagggctaccccttttggattcgaatcggttttaccaaaaaggaaaggcctctccgttctttggtgtcctgaagcccctgtttccaataaacggaaggcaccatgctttgaggtgttcccaaaaaatttcttttgggag

SEQ ID NO: 77375 - protein, 98 aa, Zea mays
  misc_feature: Ceres CLONE 1562332
MNLATNLFKMLLKYLPQDRAAEMERLLKRAQAENERDTVESNKPILVNYGLKHVTYLIELNKAHLVVIAHDRDPIGTGLFGLPAPVHERWKVPITGFV

SEQ ID NO: 77376 - DNA, 958 bp, Zea mays
  misc_feature: Ceres CLONE 1562336
  misc_feature: Encodes the peptide sequence at SEQ ID NO. 77377
  misc_feature (852)..(852): n is a, c, t, g, unknown, or other
gctctagactagtggatcccccgggctgcaggaattcgtctcacccctagaaaaagcacccgagcgctcagctcaaacatccctactctcctgctcctcttcttcctcctcctctcgctctcaagcgcgtcttcactccggcctagctcggacggatcgacatctaggggaaagggaataagtgggggcgccagcatatggatccatggatcagcagccagccttctctgagccttgacctgcgcgtcgggctgacgccgctcagcctccaccaggcgccggtgggccgtcgcccttggccaggcccaagtgctcttcgagagaacttccgctgctcccaaaaagaacagagtgggggggttgttttttcccccccatttttgggggatgaccaaggagaaccgggccttgacgaaagccctggccccgggggtttccaagaacgaaggggcttgggccacccgccacacggagaatgggggggccgccttttttccctctttagaaagggggcggggtcccatgtttccccgtctccgggaaaaggcccaaaataaacaaaagagaggggggggaaaacacagggggccccccgggggggaagaagggttcttttttcacaccaaaataaaaatacgcactccttgtggggggggggagaaacctttgtttcgcgaaagatgaaacactttctccggggggagggggaaggcctccccccgtgggcaagaactccaacttttttggttcgttaaacactctccttataaaaataatgggtgaagagtacccgatgagttataggaggatcccccgtcccaggaaaagatggggcgaaatccttttattttntgcgctgcctcacaccgcgcggttaattctgtaatagtagtggagggataggaggacggggacacctccggtggtgtcggtttgtcggacgcaaaagtgtaggagt

SEQ ID NO: 77377 - protein, 119 aa, Zea mays
  misc_feature: Ceres CLONE 1562336
MDPWISSQPSLSLDLRVGLTPLSLHQAPVGRRPWPGPSALRENFRCSQKEQSGGVVFSPPFLGDDQGEPGLDESPGPGGFQERRGLGHPPHGEWGGRLFSLFRKGAGSHVSPSPGKGPK

SEQ ID NO: 77378 - DNA, 858 bp, Zea mays
  misc_feature: Ceres CLONE 1562340
  misc_feature: Encodes the peptide sequence at SEQ ID NO. 77379
ctccccgcggtggcggccgctctagaactagtggatcccccgggctgcaggaattcgtctcacccctagaaaaatatcttggccaatccttctccaatcttattttacccaattagcagcacagaggtgcgctgtttggttgatgtccctggtcagaaggtgccttccatagctaccggtgaaatggcaaactatctcaaaactgttgttgcaccccagattcctccagaaatctatgactctttcatagcagccattgataagggaagcatacggacaatgccaaacaggagcatgccagcggctccacatccgacccctggtgcacttctgatgggggatgcgttcaatatgagacaccctttaactggtggaggaatgactgttgcattatctgacatcgttgtcctgcgtaatctgcttcagcctcttcgcaatcttcatgacgcatcttccctgttgcagtaccctgaatcgttctatacactgtcggaaacccggtgctttcacaataaacacatgggcgcgtgctcttgtacaaaggtcttcagtggcttcgcctgatcaagctaggaaatgagatgcgcccggccttgtttttgattacttttaacccctcggaagcgttctttctcgacggggcctatcgccttttactctcctgggctttaccctccgggccccccggagttttattgggcgcccctcctttttggggggggggaacaaaaaccggggggccgcccccctataaaggcgcccccctttttcttccccaaaaaaaaaaaattgggggttttggggaccaaaaaccgaaatttttttggggggaaggggggaataatctttcccccctct

SEQ ID NO: 77379 - protein, 126 aa, Zea mays
  misc_feature: Ceres CLONE 1562340
  misc_feature (1)..(126): Pfam Name: SE Pfam Description: Squalene epoxidase
  misc_feature: SWISSPROT Homolog: EC 1.14.99.7 Squalene monooxygenase
MANYLKTVVAPQIPPEIYDSFIAAIDKGSIRTMPNRSMPAAPHPTPGALLMGDAFNMRHPLTGGGMTVALSDIVVLRNLLQPLRNLHDASSLLQYPESFYTLSETRCFHNKHMGACSCTKVFSGFA

SEQ ID NO: 77380 - DNA, 846 bp, Zea mays
  misc_feature: Ceres CLONE 1562341
  misc_feature: Translation starting site: 144
  misc_feature: SWISSPROT Homolog: EC 5.2.1.8 Peptidylprolyl isomerase
  misc_feature (441)..(441): n is a, c, t, g, unknown, or other
ctccccgcggtggcggccgctctagaactagtggatcccccgggctgcaggaattcgtctcacccctagaaaaaattctccagcaacgagacaacaaatctcctcctcttcctctccgtatccgcatcagtccatcaccttcaatggcggcggcggcggctgctgccacctccttcaccaccctcgccgtcgcgcgttcggcggggcagcggtcccttcttgcctccaaggccgcaccttcgccgctcctctccctccgtggcgcccgcatcccctcgcaggccgtctccttctccgggggccttgcggcgtcgccctctcacagccgcgcgcgcttcgctacatccgccagcgccgagcccaaggaagcagatcttcagtctaaaatcaccaataaggtgtattttgacataagcattgggaaccctgtggggaagaatngttgggaggattgtcatcggcttgtatgggggatgatgttccacaaacagcagagaactttcgtgctctttgcactggagagaaagggtttggatacaagggatccagtttccaccgtgtcatcagcgactttatgatccaggggcggagattttgacaaaggcaatggtaccggtggggaaaagcatatatgggacgcactttcaaagatgagaacttcaaatttggttcacactgggacctgggagtggtcagcattggctaatgcgggaaccgaacacaaacggcagccaagttttttcatttgcattgtcaaaacccccttggtttggatggaaaggcatgtcctgttttggccaggtcgggggaaaggatggataattgtaaaggcttgatccattcaaa

SEQ ID NO: 77381 - DNA, 765 bp, Zea mays
  misc_feature: Ceres CLONE 1562342
  misc_feature: Encodes the peptide sequence at SEQ ID NO. 77382
ctcaccgcggtggcggccgctctagaactagtggatcccccgggctgcaggaattcgtctcacccctagaaaaaagctgtcctatttcaatttcgaatctccccttcccctcagtctctcacacgcacgctcctcccctacgcagcaaaaccctaaccctagctgcggacgccgtcgccgcctccgcgcccaaccgatgtctgattctgaggcgtccccaccgcccactccggccgccgcaacgcccgcagcgccggtggagacctccccgtcctcggcgaggaaggaagaactgctgcctgtggaggaaaagatctcggaattaagtgaatcacaatcagagcttctagggaggctccgtgggcttaaggaggatttgctgagttggaggagtaatttagactcccaagtgacgaaatacaaagtggaactctctgacatcaagagtgcactcaataatgaaatagagcagcttcgctcagatttccaagagctgaggaccacccttaagaagcagcaggaagatgtgtcacttagcttgaagaatttggggctttcagatgctaccgaaaatgatggggacaaaggaaatggagacggcacaaaatgaggtcttgtcagctaactgggggacttgaaaactggatggttcctcctgaaaactatgatgaaagccgagagtcaaagggagaaccagttggaaacaccgaaccctggctgggggatggcatcgtccaacaaagctcctaagggagacaagctcca

SEQ ID NO: 77382 - protein, 137 aa, Zea mays
  misc_feature: Ceres CLONE 1562342
MSDSEASPPPTPAAATPAAPVETSPSSARKEELLPVEEKISELSESQSELLGRLRGLKEDLLSWRSNLDSQVTKYKVELSDIKSALNNEIEQLRSDFQELRTTLKKQQEDVSLSLKNLGLSDATENDGDKGNGDGTK

SEQ ID NO: 77383 - DNA, 865 bp, Zea mays
  misc_feature: Ceres CLONE 1562344
  misc_feature: Encodes the peptide sequence at SEQ ID NO. 77384
  misc_feature (496)..(496): n is a, c, t, g, unknown, or other
  misc_feature (501)..(501): n is a, c, t, g, unknown, or other
  misc_feature (543)..(543): n is a, c, t, g, unknown, or other
  misc_feature (549)..(549): n is a, c, t, g, unknown, or other
  misc_feature (559)..(559): n is a, c, t, g, unknown, or other
  misc_feature (562)..(562): n is a, c, t, g, unknown, or other
  misc_feature (565)..(565): n is a, c, t, g, unknown, or other
  misc_feature (571)..(571): n is a, c, t, g, unknown, or other
  misc_feature (631)..(631): n is a, c, t, g, unknown, or other
  misc_feature (733)..(733): n is a, c, t, g, unknown, or other
ctggagctccccgcggtggcggccgctctagaactagtggatcccccgggctgcaggaattcgtctcacccctagaaaaatctccgtcccagaacgccccagccttccacctcgaactccgcggtgcccagcgccctcggtaaccgccctccgccctgccacagagacaggtcgacgagacagacaaaggccggccgccatgggagaggacaagaaggcgggcaacaaggacgccgccggcggcgacaagaagaaggacgccggcgccggggccgcgccgcagcccatcgtgctgaaggtcgacttgcactgcgccggctgcgccaacaaggtccgcaaggccatcaagcacgccccaggtgtggagtcggtgacgccggacatggcggcgggtaaggtggtcgtgaccggtccggcggacgcggtggagctcaaggagcgcatcgaggccagggcgaagaagcccgtgcagatcgtctccgccggcgccggcccnaccangaaggagaagggatagaaagcggacggcggcgagaagaagcngacaangagaagggcngcngcngcgganagaataatgccgactatgagaatggctgctgtatatgataaggccgactaggattatggncggcggaaagaataatgcctaacaagaaaaggggccgcggcaataaaaaagccaacagggaaaagggtgccaaacacgcccagggggaaaaaaaaaaacccngggggggaacctgtaacccttaaaaatccgctgcccgtgggaagggtggcttaaagcgccttaaggcccccattcccaaaaaaaaagggggtaaaagaaagggggttttaacccccccaaagcccccgtgga

SEQ ID NO: 77384 - protein, 105 aa, Zea mays
  misc_feature: Ceres CLONE 1562344
  misc_feature (30)..(92): Pfam Name: HMA Pfam Description: Heavy-metal-associated domain
  misc_feature (101)..(101): Xaa is any aa, unknown, or other
MGEDKKAGNKDAAGGDKKKDAGAGAAPQPIVLKVDLHCAGCANKVRKAIKHAPGVESVTPDMAAGKVVVTGPADAVELKERIEARAKKPVQIVSAGAGPTXKEKG

SEQ ID NO: 77385 - DNA, 706 bp, Zea mays
  misc_feature: Ceres CLONE 1562349
  misc_feature: Translation starting site: 166
  misc_feature (244)..(244): n is a, c, t, g, unknown, or other
gagctccccgcggtggcggccgctctagaactagtggatcccccgggctgcaggaattcgtctcacccctagaaaaaaccacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatattnggagaaggtggctaagactgtagatgtggaagagctcactgttgaggagcgtaaccttctgtctgtgcatacaagaatgtgattggggctcgccgcgcttcatgccgcattgttttctccattgacaaaaaggaggagtccccgtagaacgaaagagcatgtggacccttatcaagggaatatcctgggcagaatcgaaggctgacttgaccaataatcttgggatgggatttcttgaaacctgccttgactctccccccccctaagggggccctttttttttttaaaggggggggggggaaaaaaaaaagaggggggctttttttttttccccccccccaaaaaagagggggggggggtcttccccggggggttttttggggagaaataaaaaaaaaacgggctccaaaaaaaaaaaaaaaaaaattttttttaaaaacacaaaaatgggggggggtcttt

SEQ ID NO: 77386 - DNA, 853 bp, Zea mays
  misc_feature: Ceres CLONE 1562350
  misc_feature: Encodes the peptide sequence at SEQ ID NO. 77387
  misc_feature (853)..(853): n is a, c, t, g, unknown, or other
ctccccgcggtggcggccgctctagaactagtggatcccccgggctgcaggaattcgtctcacccctagaaaaattttggtggcgatatggcgcgtcctttgtcctcgtactgcggcgtgcaaagctccctccctatgcgctctccgccctgtgacagagacaggtcgactagactgacaatggccggccgccgtggctagaggacatgaaggcggtcaacaaggacgccgccggcggctacaagaagaaggactctggcgacggggcctcgccgcaccccatcgtgctgagggtcgacttgctctgcgccggctgcgccaacaaggtccccaaggccatcaagcacgccccacgtgtgcagtccgtgacgccggacatggctgcgggtaaggtggtccccccctctccggcagacgcggtggatctcagggagcgcatcgaggccagggcgaagaagcccgtgcagatcgtctccgccagcgccggcccaccctagaaggagtaggatatgaaagcggacggcggcgagaaaaaggcggacaaagagaatggcggcggcggcggatagaattaagccgactaggagaagggcggcggatattaaataggctacaaggagaagggccgcctaaaagaactatgcccgacaagaaaaaggccggccccaaaaactaaggcctaccagggagatgggtggcccaccttccccatgtaggaaaaagaaaaaagcccccaggagggaaaactggtgaccccttaaaaattccgggcgtgccctggtgaacgggcctggcttttgaagcgccattttaaagcggccggcatttctcccaaaagataacaaatggggtn

SEQ ID NO: 77387 - protein, 96 aa, Zea mays
  misc_feature: Ceres CLONE 1562350
MKAVNKDAAGGYKKKDSGDGASPHPIVLRVDLLCAGCANKVPKAIKHAPRVQSVTPDMAAGKVVPPSPADAVDLRERIEARAKKPVQIVSASAGPP

SEQ ID NO: 77388 - DNA, 1032 bp, Zea mays
  misc_feature: Ceres CLONE 1562351
  misc_feature: Encodes the peptide sequence at SEQ ID NO. 77389
  misc_feature (394)..(394): n is a, c, t, g, unknown, or other
  misc_feature (984)..(984): n is a, c, t, g, unknown, or other
ctccccgcggtggcggccgctctagaactagtggatcccccgggctgcaggaattcgtctcacccctagaaaaaagctggtgctcagcgaccttgtagtccacgacctcacggaacaggccaggggtgagctcgcagtccttgctcccgtagacagccgcctggacgctggccatcatcttggctatctctcgtccggagaagccctgggtcttggccgccgcctcgcggatcaggtcgtcggtgacgcccttcaccacgatcttctggggctggcggcggaagaaacggagccagctcttctcgcgcttgtcgccggctctgatgacgtacttgtccaggtatagcttcaggagcttgaaccgctcgtcttccccgggcagggggaaatccangacctcgtcgatacggtcggcgacggccgtatcgagattcgcagggcctgtttggtgcaagcgcaaaggacatgttccttgtactgggccccctgttgcggaaaaggaaaagcgtcaagggcacctcctttgagcctccccccatggaaagtttttgtttccccccgggaggggaccccccaaaaaaaaaacaaaaaccgggcctgaaatgtgcaaaccccacacttttgccaaattttgtggggggaaaaaatcgagccccctcccgccacaaaaaaaaaattccctcaaaaattttttgtttgcccccttcccccccccacaaaaaaacccccgcgcttctccctatggaaaagaggaaaacacccccgtttttaatttttctccccccgtaaaaaaaatggtgggttctttggggcaacccctttgagcaccaagggggggccactctcccccccggttttttggtggttattatccccccccaaggggggggaaatttttttgtggggcgccccttctaaacaggggtttattaggccccaaataatgtgggcgtgaaaaacaccagatgggcgggccgcctttanaaaataaaaaaaaaaacttctacgtggaggctaccgcggagggagatg

SEQ ID NO: 77389 - protein, 67 aa, Zea mays
  misc_feature: Ceres CLONE 1562351
  misc_feature (24)..(24): Xaa is any aa, unknown, or other
MTYLSRYSFRSLNRSSSPGRGKSXTSSIRSATAVSRFAGPVWCKRKGHVPCTGPPVAEKEKRQGHLL

SEQ ID NO: 77390 - DNA, 794 bp, Zea mays
  misc_feature: Ceres CLONE 1562352
  misc_feature: Encodes the peptide sequence at SEQ ID NO. 77391
  misc_feature (326)..(326): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (553)..(553): n is a, c, t, g, unknown, or other
  misc_feature (558)..(558): n is a, c, t, g, unknown, or other
  misc_feature (560)..(560): n is a, c, t, g, unknown, or other
  misc_feature (619)..(619): n is a, c, t, g, unknown, or other
  misc_feature (620)..(620): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (645)..(645): n is a, c, t, g, unknown, or other
  misc_feature (693)..(693): n is a, c, t, g, unknown, or other
  misc_feature (709)..(709): n is a, c, t, g, unknown, or other
  misc_feature (751)..(751): n is a, c, t, g, unknown, or other
  misc_feature (752)..(752): n is a, c, t, g, unknown, or other
tccccgcggtggcggccgctctagaactagtggatcccccgggctgcaggaattcgtctcacccctagaaaaactcgtccaaaaccctagccctcgcgccgccgcctcctccgccacccagcgctcgagctcctcgcgtcctgcgagcgcgctccgcaacgtcaccatgaagttcaacatcgcgaacccttccaccgggtgccaaaagaagctggaaatcgatgacgaccagaagctgcgtgccttttatgaccgaaggatatcccaggaggtcagtggtgatgctctgggtgaggagttcaagggttatgtcttcaagatcatgnggtggaatgtgataaagcaaaggctttccccaattggaaagccaggggggggttttttttaaaattctttcttgggggggggggggttttttccttctcccccaaaaaaaaaccccccccttctccctttttttttcgggccgctttttgtggcgcccccgaaaaaaaattttttgtgtttgttttttttggaaaaaaaaacaacattttttaaaaacaannnnngnggggngnagagggggggggggggggaagccccttttttttgccgtttgggggggggggcgtccgcnnccccnnnaaaaaaaaaaaaaaaaanaataaagggtggggggggtgagtgttgggtgtttggtgaacccgaggnttatatcatctccccntcccccccgcaaccccccacaaaaaaaaaaagaaataaaaanntttctcgcccggtcccaagtggtaatgacgagggggagggga

SEQ ID NO: 77391 - protein, 73 aa, Zea mays
  misc_feature: Ceres CLONE 1562352
  misc_feature (1)..(71): Pfam Name: Ribosomal_S6e Pfam Description: Ribosomal protein S6e
  misc_feature (54)..(54): Xaa is any aa, unknown, or other
MKFNIANPSTGCQKKLEIDDDQKLRAFYDRRISQEVSGDALGEEFKGYVFKIMXWNVIKQRLSPIGKPGGGFF

SEQ ID NO: 77392 - DNA, 791 bp, Zea mays
  misc_feature: Ceres CLONE 1562357
  misc_feature: Encodes the peptide sequence at SEQ ID NO. 77393
  misc_feature (655)..(655): n is a, c, t, g, unknown, or other
  misc_feature (677)..(677): n is a, c, t, g, unknown, or other
  misc_feature (699)..(699): n is a, c, t, g, unknown, or other
  misc_feature (709)..(709): n is a, c, t, g, unknown, or other
  misc_feature (747)..(747): n is a, c, t, g, unknown, or other
tggagctccccgcggtggcggccgctctagaactagtggatcccccgggctgcaggaattcgtctcacccctagaaaaactccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaagcgctctgntagaaggttgtgaaggtcacangatgagatgaaaggcgtttgcnggcctatggncaagctccgcccttgagcggatgaaacagaaagcaccntcggtggcccgcccagaaagatagcatgctgatggcagagaagg

SEQ ID NO: 77393 - protein, 167 aa, Zea mays
  misc_feature: Ceres CLONE 1562357
  misc_feature (6)..(167): Pfam Name: Ribosomal_L13e Pfam Description: Ribosomal protein L13e
  misc_feature (164)..(164): Xaa is any aa, unknown, or other
MVKHNNVIPNGHFKKHWQNYVKTWFNQPARKQRRRIARQKKAVKIFPRPTAGPLRPIVQCQTLKYNMKSRAGRGFTLEELKAAGIPKRLAPTIGISVDHRRKNKSLEGLQANVQRLKTYKAKLVIFPRRARKVKAGDSTLEELTTATQVQGDYMPITRGEKRSXRRL

SEQ ID NO: 77394 - DNA, 926 bp, Zea mays
  misc_feature: Ceres CLONE 1562358
  misc_feature: Encodes the peptide sequence at SEQ ID NO. 77395
  misc_feature (760)..(760): n is a, c, t, g, unknown, or other
ctccccgcggtggcggccgctctagaactagtggatcccccgggctgcaggaattcgtctcacccctagaaaaaatctgtagccgcgcctctccggttcactccgcgcctctctcccgccaggccgccacccaagcaaccatggcgaccgcgctgctccgccgcgcgctccacctccgccgtgtgctcccctctcccgacgtcaccgccgccgcctcccagcgcctcatccccgccttctcgaccacccccacgccgacccctaccacctcccagcagaacgccgccaccactacgatcgacctctcctccgacgagagccgccgccgcctcctcaataggttggtgtacaggagcaagcagcgaggttttctggaactggacctggtgctcccgacctgggtctagcagcacgtgcacgccatggacgaggcctacatccgcgccctcctgcatgtgctcgacctcgaaaacccagatttgtggaaatggttgactagccaggagcagccaccagagaatctgaattcgaatccggtgtttgctgccatctaatgcaaggtcacagataaactgaccaagcatgcttctcctgagacccgatctacaccaggtcaaccatgggttagaggatgggaccacataaagaaaagctaagatggacccaagtatggaaatcagcgataagctgcttgaaatggggatgacagcttttcgatcctaaataattactgtccccccaccccgacccccaatatgcntggtttggcgactgtgcagaataaagagaactgcgaccggcatgagcgaaatctgattaatcgttagatcagcctgtaaactatgcatggaacctcctgatgttttcccggcgaatcccagccgttcggggaatcgtccacgacttggaaaatgttcatattaaga

SEQ ID NO: 77395 - protein, 88 aa, Zea mays
  misc_feature: Ceres CLONE 1562358
MATALLRRALHLRRVLPSPDVTAAASQRLIPAFSTTPTPTPTTSQQNAATTTIDLSSDESRRRLLNRLVYRSKQRGFLELDLVLPTWV

SEQ ID NO: 77396 - DNA, 870 bp, Zea mays
  misc_feature: Ceres CLONE 1562359
  misc_feature: Encodes the peptide sequence at SEQ ID NO. 77397
atagctggagctccccgcggtggcggccgctccagaactagtggatcccccgggctgctggaattcgtctcacccctagaaaaagcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatctttcggaagatgggcatcctccccccgggagaccgcgctgcccgtggtttaagacggggcggcattcccgcccgcggggcaccctacaaactactgggggcagactcctacacgcctccttcgggcttccaaaatgggggctccagggggctttggcccgaagacccgcccgccccccaggaaagggggaaaaccaccggggcttccctggggcagaggcgttactttccccgggcgccccaaggaaagttctctccccccgggttcccgggggaaaccggttttttacccccgggggtggggccccctttatcaaaaccgattttagtgggttctgagagaagaatacaaaaga

SEQ ID NO: 77397 - protein, 231 aa, Zea mays
  misc_feature: Ceres CLONE 1562359
  misc_feature (55)..(215): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAVGAIAPEIFRKMGILPPGDRAARGLRRGGIPARGAPYKLLGADSYTPPSGFQNGGSRGLWPEDPPAPQERGKTTGASLGQRRYFPRAPQGKFSPPGFPGETGFLPPGVGPPLSKPILVGSERRIQK

SEQ ID NO: 77398 - DNA, 1157 bp, Zea mays
  misc_feature: Ceres CLONE 1562361
  misc_feature: Encodes the peptide sequence at SEQ ID NO. 77399
cccctcctctcttcggtgcccccctcccccctttccccctctcctaagtattccttttcacccccctttataactggagctccccgcggtggcggccgctctagaatagtggatcccccgggctgctggaattcgtctcacccctagaaaaaaagttacttgaaaaattaaatgctggcatccgagcaaaggcagcagaagttgttagtacaattgtgcagaataatcccaagagtcagcaacttgtcatggaatccaatggactagagccactgttgacgaacttcaaatcagatccaagtacaaatggacggacaaaagctttaagagccatatcttctctaattcgtcataaccagcctggagtttccgcattttcgattgggaaagggctatgcttggattggaagatgctcttggtttccgatgatgccagacttcaaaaggaaaggtttccaatctcatagaaagtttcccccacaatttcaagggtaaaaaagaaaggttgccacaaaagcttggtccttccgaaagctgatgaaagcaccctgttggtccagcgaagaatcccttaaagggcgtggaagcttgcttttaaagagggccccctttttaatttcggcgcgggggaaaaagaaacatcttgggggagcgccccctcccctggttccacaggaaaaaacctctaaaaaaacaatgtctcctagataactcccaaatatgagaagggggatttctctcgcacaattgtggaaacccgtttacaaagaatttcccaaatgttcgttttccacgaagagagaattctggcggagcctgggggggggaaatcttccccttttggtaaagggagatgttctataaaacacacaaaaccatatgtgcttttcctgagagggagaaaagggggccccgctagcacagtcgttttccgggaaaaaagaatacaccccccctaaaaagctcgccacaccaaatattttttctccgggaaaagaattttttattacgtccccgctttctcttgatacggggagtgggctaaaaaactttgctcagcgaaagaacaataccccaatatttgtgggagacggaataaaaaagaatagccttatgacgtcgctttatgttttttttaccgccccttttagcgcaaa

SEQ ID NO: 77399 - protein, 72 aa, Zea mays
  misc_feature: Ceres CLONE 1562361
MESNGLEPLLTNFKSDPSTNGRTKALRAISSLIRHNQPGVSAFSIGKGLCLDWKMLLVSDDARLQKERFPIS

SEQ ID NO: 77400 - DNA, 863 bp, Zea mays
  misc_feature: Ceres CLONE 1562363
  misc_feature: Encodes the peptide sequence at SEQ ID NO. 77401
  misc_feature (790)..(790): n is a, c, t, g, unknown, or other
ctggagctcaccgcggtggcggccgctctagaactagtggatcccccgggctgcaggaattcgtctcacccctagaaaaaacctccgaatttactgatccatccatctccatccccatcccgtgacccgtgcacgccgccgcttcaagtcctaacaagccgcatcgcatcgcatgcgtgtgctgtccgaccgccatctccgcagccggctggcctagctacctcacctcacctcacgcaggcacactgcacacacacccatggtggtggcggcgatgctgcggccgtgcgctgtgccagcgctgctggtggcggcggcgacagcgacgctagtgcttctgctgctgctgtcaccgtagagcgcgcagccggtgccgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggagggcctcgtcggctccaaccccgtctgcctctgcgagctcctctgcggcgccgccaactcctacagcatcgccgtcgactacggccgcgcgatcaagctccccgtgggtctgccgcgacagcacaccgcacgtgctcacgtgaacagacctcagatatcagcgtccctgtggcccaactgcagcacccatgtttagggacgccctcgaccatgttctggcatctcttccctgcagggaaggtcccacacgttcccaagtaacatnggctaaacccctggccggcggccttcgaacaggtaacgcgggcgcagacgaatcctgcgggggggggccttgt

SEQ ID NO: 77401 - protein, 90 aa, Zea mays
  misc_feature: Ceres CLONE 1562363
MSDCLPYVSQGSTARRPDAPCCPELEGLVGSNPVCLCELLCGAANSYSIAVDYGRAIKLPVGLPRQHTARAHVNRPQISASLWPNCSTHV

SEQ ID NO: 77402 - DNA, 757 bp, Zea mays
  misc_feature: Ceres CLONE 1562365
  misc_feature: Encodes the peptide sequence at SEQ ID NO. 77403
ctccccgcggtggcggccgctctagaactagtggatcccccgggctgcaggaattcgtctcacccctagaaaaatgaggtcttcactgagtataaactcccaaagtgaggtgacatggatgacatgggcagcacttgaggaggaacagggggatccagttcgagctgaagaaattcggaacctttactttcagcagcgtactgaagttgtggatgatgcatcctgggtcataggcttcctcgacatcatcgaccctgccctagacagcgtgaagaggctactaaacctggatcagccttctagaccggcgaggcaagatgatgttaaaagcacaacagaaccgtgtcctcccactgccaagtcttcagaaacttctgcgggcaatgatgctcgtaacaacgggagcgaagcaatggggactctaacaagtgatttcgatttggatgctttcattaagaagaggctggccctcgacccatcggagctggatgccgtgctcgagggctctgacccgaggggtgttgtttctcagaggaggaaacagcggctgcccaggaagccactccctcttctccctgtcccgtaaattttccagatcggtctgtctcatttccattccaccggtaaaatccataagggctagtttgtttgagactccatttttttttccaagtgttaaaaaataaaatcccttgaaaaaaaatgagggttatcaaactagcccctaaatcccttaactgtagcagccctgcaatac

SEQ ID NO: 77403 - protein, 170 aa, Zea mays
  misc_feature: Ceres CLONE 1562365
MRSSLSINSQSEVTWMTWAALEEEQGDPVRAEEIRNLYFQQRTEVVDDASWVIGFLDIIDPALDSVKRLLNLDQPSRPARQDDVKSTTEPCPPTAKSSETSAGNDARNNGSEAMGTLTSDFDLDAFIKKRLALDPSELDAVLEGSDPRGVVSQRRKQRLPRKPLPLLPVP

SEQ ID NO: 77404 - DNA, 754 bp, Zea mays
  misc_feature: Ceres CLONE 1562368
  misc_feature: Translation starting site: 370
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (661)..(661): n is a, c, t, g, unknown, or other
  misc_feature (686)..(686): n is a, c, t, g, unknown, or other
  misc_feature (693)..(693): n is a, c, t, g, unknown, or other
tggagctccccgcggtggcggccgcctctagaactagtggatcccccgggctgcaggaattcgtctcacccctagaaaaatccgctgcaggtggtctaggatcgccaaacacctgcctggcaggaccgacaacgaggtcaagaaccactggaactcgtacctcaagaagagggtcgagggcaaggatggacccagcacgccgccgtccgattcagaacgactcgcattgcgccaagcccgggggcggaagcacggcgcgggagacgggagaacgaccgcccagcggactactccggctcgtcggaaccgcgcgagccgtcgtcgtcgtcgtcgcccgacacgagctgcctgacgggcccgcccaaggtcatgttcgtggactggctcgacatggactgcatgggtgggnnnnngggtggtggcccgccgggcgcggcggcagcggcagcggcacctggtctgggcgctgctgcgggcgtggccagggccagcacgggcgatgatcagatgacgatggatgatgggtcggcgtccggtcgtgccgacgtgtccctgcacggtacgttcggtgacagcggcggcgccggcctgctgggagttccacgagagcttcgatcagatgcaggcggccggcttctgcgacctgctctccctccattgncgagtactacttcggactcgactangctctcngcccttggtttggtgatcggtcgttgctcaagggatttgccccgttttttttttttttacc

SEQ ID NO: 77405 - DNA, 818 bp, Zea mays
  misc_feature: Ceres CLONE 1562369
  misc_feature: Translation starting site: 192
  misc_feature (334)..(334): n is a, c, t, g, unknown, or other
  misc_feature (335)..(335): n is a, c, t, g, unknown, or other
  misc_feature (368)..(368): n is a, c, t, g, unknown, or other
  misc_feature (379)..(379): n is a, c, t, g, unknown, or other
  misc_feature (412)..(412): n is a, c, t, g, unknown, or other
  misc_feature (566)..(566): n is a, c, t, g, unknown, or other
  misc_feature (677)..(677): n is a, c, t, g, unknown, or other
  misc_feature (682)..(682): n is a, c, t, g, unknown, or other
  misc_feature (689)..(689): n is a, c, t, g, unknown, or other
  misc_feature (737)..(737): n is a, c, t, g, unknown, or other
  misc_feature (777)..(777): n is a, c, t, g, unknown, or other
ccccgcggtggcggccgctctagaactagtggatcccccgggctgcaggaattcgtctcacccctagaaaaaaccgcgcgcaatcggccgctcatcccctcttcctatcgcccgccgccgccgccgccgccgcccgtccgcttcagtacgacgtcgagcaaggggaggtaaaagttcgtttggcgtgcgccatgtttaagaagttctcttcagaagatatatctggacagaatcaagttaaggcttctgtacaacgaaagattcggcaaagtatcgctgatgagtaccccagccttgaacctttgctagatgacttgctcccaaaaaagtcacnnctatgattgttgttaaatgccaaaatcatcttnaatcttgtagntggtgaataatggttcctctatttttcaatatnacgtgatggtccttacatgccaacccctgcgtcttcttcatcagtatcctgatatcatgaaaaaagttccaagtggatagaggtgctatcaaatttgttctatctggcgcaaacataatgtgtcctgggttgacttccacctggtggtgccttnagacgacgaagtcgaggaggaaacaccagtggctataatggctgaaggaaaacacacgccctggcaattggatatacaaagatgtcagcaaaagacataaggacatcaacnaaggnaattggntgttgacatatgcactatctaaatgatggcctatggaagatggaacgnctcgaatgagtagatttctctgaggggtttcatacttgcngcagatcgtattgatggacatatgaaaccagcaggacccta

SEQ ID NO: 77406 - DNA, 854 bp, Zea mays
  misc_feature: Ceres CLONE 1562371
  misc_feature: Encodes the peptide sequence at SEQ ID NO. 77407
acccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccacccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgccaggtcgtgctcatgggcgccgtcgagggctaccgcatcgccggcggcccgctcggcgaagtcgtcgacccgctctaccccgtgcgcagcttcgacccgctcgtgctcgccgacgaccccgaagccttcgccgagctcaaggtcaggagctcaagaacgccgccctcgcatgttctccatgttcggaatttctcgtcagccatcgtcaccgggaatgcccgctc

SEQ ID NO: 77407 - protein, 237 aa, Zea mays
  misc_feature: Ceres CLONE 1562371
  misc_feature (64)..(213): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPPGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPVRSFDPLVLADDPEAFAELKVRSSRTPPSHVLHVRNFSSAIVTGNAR

SEQ ID NO: 77408 - DNA, 862 bp, Zea mays
  misc_feature: Ceres CLONE 1562372
  misc_feature: Encodes the peptide sequence at SEQ ID NO. 77409
  misc_feature (427)..(427): n is a, c, t, g, unknown, or other
  misc_feature (520)..(520): n is a, c, t, g, unknown, or other
  misc_feature (645)..(645): n is a, c, t, g, unknown, or other
ctggagctccccgcggtggcggccgctctagaatagtggatcccccgggctgcaggaattcgtctcacccctagaaaaaatcctcaagacatcagctagctagccttccctacagcaactgcttacatacaacacttccatcttcccgagctcgtattcgatcaattcccaattcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgctggaggcgctcgtcgacgncgacggcgcggcgaagttgtggcgccggtggacgacctggactgggaggacatcttctacatccacgacggatgccagtggccgtccgacccngccggcgttcaaggagaccatgcgcgagtaccgcgccgagctgaggaagctcgcccaacgcgtcatggagggcatggacgagaacttcggcctcggcaggggcacaattcagggcgccttcccancgggcggcgggaagaagcctttcttcggaaccaaggcaaccccttacccgccgtgccccgccccggaacctattaaggggcttggccgggcaaacaaaacccgggggggtttttcctgtttttcagaaaaaaaaaggtcgggggccccgaagggttcaagggaacgccagtgggaccaaatggcaaccctctgggggccccctttttaaaaaaggga

SEQ ID NO: 77409 - protein, 219 aa, Zea mays
  misc_feature: Ceres CLONE 1562372
  misc_feature: SWISSPROT Homolog: EC 1.14.17.4 Aminocyclopropanecarboxylate oxidase
  misc_feature (78)..(78): Xaa is any aa, unknown, or other
  misc_feature (109)..(109): Xaa is any aa, unknown, or other
  misc_feature (151)..(151): Xaa is any aa, unknown, or other
MVVPVIDFSKLDGAERAETLAQIANGCEEWGFFQLVNHGIPLELLERVKKVCSDCYRLREAGFKASEPVRTLEALVDXDGAAKLWRRWTTWTGRTSSTSTTDASGRPTXPAFKETMREYRAELRKLAQRVMEGMDENFGLGRGTIQGAFPXGGGKKPFFGTKATPYPPCPAPEPIKGLGRANKTRGGFSCFSEKKRSGAPKGSRERQWDQMATLWGPPF

SEQ ID NO: 77410 - DNA, 607 bp, Zea mays
  misc_feature: Ceres CLONE 1562374
  misc_feature: Translation starting site: 142
  misc_feature (70)..(70): n is a, c, t, g, unknown, or other
  misc_feature (302)..(302): n is a, c, t, g, unknown, or other
  misc_feature (303)..(303): n is a, c, t, g, unknown, or other
agctccccgcggtggcggccgctctagaactagtggatcccccgggctgcaggaattcgtctcacccctnagaaaaaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggcccgcgtcaccatggtccccgcggaagtggatgcccggnncagcacgccctgcccacctcgacggctcctctcccggggacttcggcttcgatccgctgggcctcgcgaccgtgccggaaaactccagcgggtcaaggaatcaaaggggtacccctgccccctgggcccatgcttttcccgttccccggggaattccctgggggccccggaaaacccctttggggcccctgggggcaaaactggggggtttaaaaagggccccaaaagaaattggggggggggggccccttttcccccccgggggggggggggaaaggggccccccccttttaaaccccgtggg

SEQ ID NO: 77411 - DNA, 982 bp, Zea mays
  misc_feature: Ceres CLONE 1562375
  misc_feature: Translation starting site: 121
ctccccgcggtggcggccgctctagaactagtggatcccccgggctgcaggaattcgtctcacccctagaaaaaattccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggagcgtgtccccgccgacatccgcgcgcaggtcggcgtggcgcgcatgtcggacccgggcctcatccgcgacatcaagcgcgccgtcaccatcccggtcatggccaagcccgcatcgggcacttcgtggaggcccagatctggatgccgtgggcgtcgactacgtggacgagagcgaagtgctgaccccccgccaaaacccgcaccccattcacaagccaaatttccggttccctttgttctgcggttggcgggaccccgggaagggccctcccaaggggggcccaaggggcccccccctgatccccccccaaggggggaaggcccgcccggggcaaactctttttaaggcccggggcccccaggggcccccctttggggggagaatccccccgcccccccaaaaggggaaaaaacaaaaagtcttttccctatccaaaagagaatgccgggcccccaaaaccactttttggaaaaaaaaaaagggggggcccccccccccttggtatttccccggggtggggggtgtcacccccccaaaaaccgtttttttttctcctgtaagggaggggttttttcggggcgggttttttaaaagaggcaccccccgcgcccccccccctttggggtggccccaatagcccacccctgggggg

SEQ ID NO: 77412 - DNA, 794 bp, Zea mays
  misc_feature: Ceres CLONE 1562376
  misc_feature: Encodes the peptide sequence at SEQ ID NO. 77413
  misc_feature (784)..(784): n is a, c, t, g, unknown, or other
ctccccgcggtggcggccgctctagaactagtggatcccccgggctgcaggaattcgtctcacccctagaaaaaatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccatcaagatcgatctggagaccaacaagattgtggacttcatcaagtttgatgttggcaacgtcgtcatggtgactggtggaaggaacactggcccgtggtgggtgttatcaagaacagggagaagcacaagggcagctttgaggacattcacgtggnagactccctg

SEQ ID NO: 77413 - protein, 214 aa, Zea mays
  misc_feature: Ceres CLONE 1562376
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (212)..(212): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGPWWVLSRTGRSTRAALRTFTWXTP

SEQ ID NO: 77414 - DNA, 814 bp, Zea mays
  misc_feature: Ceres CLONE 1562377
  misc_feature: Encodes the peptide sequence at SEQ ID NO. 77415
  misc_feature (618)..(618): n is a, c, t, g, unknown, or other
  misc_feature (619)..(619): n is a, c, t, g, unknown, or other
  misc_feature (647)..(647): n is a, c, t, g, unknown, or other
ggagctccccgcggtggcggccgctctagaactagtggatcccccgggctgcaggaattcgtctcacccctagaaaaagcggagcggccctccacctttatcgccgccgcctccgccgccgttgctgtgttccgtctcttcgccgatggcttcggccaagttcggtgctgcccagcaggtggagaaccgaggcgcgctgtccaaaaggtcacgtaacgacgtgtctgtaagggagggggactggaattgtcctcagtgtggtaatgtcaacttcagttttagaaatgtttgcaaccgtggagcctgtggtgcaccccgtccatcaccgagtccaagtccaagaatgatgccaggacctcctgcttctggatatgaccggtcacctctattttacggaggaaaggtggtggcgccccacctccaattccgcttggaactggtagctatggtgctccatatccacaccttgggatgcgatatggctatggtccaccagtaggacctcctggttcatacggtcttttctcttcatatggtccacctgggccaatgagtggtatgggatatggcccaggacctgagctaggcgatatagctatggggtttagaggttctccnnatgcggtttctagcccatgggtctggtngagcattagcctgaaaacactgacacattgcttcccaaaagcgccgtggaagcccctgatgacttttctgagggtgactggacctgttctaaatgcgaacaccattactttttctttccgagcacttgcaacatgaagaaaatgtggagcctccaggccaacttccg

SEQ ID NO: 77415 - protein, 117 aa, Zea mays
  misc_feature: Ceres CLONE 1562377
  misc_feature (29)..(60): Pfam Name: zf-RanBP Pfam Description: Zn-finger in Ran binding protein and others
MASAKFGAAQQVENRGALSKRSRNDVSVREGDWNCPQCGNVNFSFRNVCNRGACGAPRPSPSPSPRMMPGPPASGYDRSPLFYGGKVVAPHLQFRLELVAMVLHIHTLGCDMAMVHQ

SEQ ID NO: 77416 - DNA, 755 bp, Zea mays
  misc_feature: Ceres CLONE 1562378
  misc_feature: Encodes the peptide sequence at SEQ ID NO. 77417
ctggagctccccgcggtggcggccgctctagaactagtggatcccccgggctgcaggaattcgtctcacccctagaaaaaagccgcctcatcctctagccgatctccttttttgtcgcctccgtgcgtgccccgggggccttgatcgcgcgcaccggtcagctcagcccgtctgattcgcgtgctgccagccctccgccgatcgtgaaacacaaccgtcggtggtttgcttgcttgatcgctgatcctcgcggacgctcacggtcatggcgcctcagcctttgcgcgctccgaggctgagcgcccccgctggccacgcggcgtgcaggtgctcggccgcgccgctattcgggaagcgggcgccccccgtcgtcgcgttcccccgcgcccgtagcggcggcgccgtcgcctcgtgctcggccgtgcaggagtcgtccacctccaccactgttagcaagaagaaggatgccgcggacggtgccaaggaggccacagcggatgcggcgaaaccggccgcggccgccagccaaagaaggccgcggcgctgccgctgccggagatgatgcagcaggagatcatcccaccgctgaaggatgctttggaagcggaggacgacgtgtcccaggtgcagctcgcccttccaaacaacccgctggaagggatccttcattaaagaacgacgtccccttattattttttggggcccttctttcccaaaaggagacccttcccaggaccgaaaggacttttgcccct

SEQ ID NO: 77417 - protein, 98 aa, Zea mays
  misc_feature: Ceres CLONE 1562378
MAPQPLRAPRLSAPAGHAACRCSAAPLFGKRAPPVVAFPRARSGGAVASCSAVQESSTSTTVSKKKDAADGAKEATADAAKPAAAASQRRPRRCRCRR

SEQ ID NO: 77418 - DNA, 916 bp, Zea mays
  misc_feature: Ceres CLONE 1562379
  misc_feature: Encodes the peptide sequence at SEQ ID NO. 77419
  misc_feature (750)..(750): n is a, c, t, g, unknown, or other
ctccccgcggtggcggccgctctagaactagtggatcccccgggctgcaggaattcgtctcacccctagaaaaaactcccctcccgtccctatggcggccgttaccacagccactgccgccgcgtcctcctcctccttcctccaccgccgaagccccgcctgcctgcgcgccacgctccgcgccgcgccgcggcactgccgcaactccagctccaggctcgcctgccgcgccgccgaggtgtccggggccgagtcgtcctcggccgcggcggagggcgcgggaggaggcgggggcgcgtcgtgggtgcccgtggtgccgctcgccgcgctgccgcgcggagagcgccgcgtgatcgtgcaggacggggaggagatcctgctgctctggtacaacaaccaggtcttcgccatcgagaaccggtcgccagcggagggcgcctacaccgagggcctcctcaacgccaagctcacgcaggacgggtgcattgtttgtccatcaacagacagcacatttgaccttcgcaccggggagataaaagaatggtatccgaaaaaccctgtcctacgggctcttacgccagccttgaggaaactattcacctaccgcgtgaaaacagacgaagaaaacatatacatcagcttcagcgggggccgatggtgcggggtcagcggagattatattcagcgggaaagctcagcctggtgtgactgcatcggatgtcaatgtggaagatgtgaggatggtcgtcnacgaagatgtcggaggcttcggcttcacagggacacgagctgatcacgggaaagccgcataatcggctcctcctgctgatagattcgaggctctaactggcagggctttctcaggggacgggtcctggacttatctacccagttccggtgcttcactgaaagaaga

SEQ ID NO: 77419 - protein, 233 aa, Zea mays
  misc_feature: Ceres CLONE 1562379
  misc_feature (220)..(220): Xaa is any aa, unknown, or other
MAAVTTATAAASSSSFLHRRSPACLRATLRAAPRHCRNSSSRLACRAAEVSGAESSSAAAEGAGGGGGASWVPVVPLAALPRGERRVIVQDGEEILLLWYNNQVFAIENRSPAEGAYTEGLLNAKLTQDGCIVCPSTDSTFDLRTGEIKEWYPKNPVLRALTPALRKLFTYRVKTDEENIYISFSGGRWCGVSGDYIQRESSAWCDCIGCQCGRCEDGRXRRCRRLRLHRDTS

SEQ ID NO: 77420 - DNA, 850 bp, Zea mays
  misc_feature: Ceres CLONE 1562381
  misc_feature: Encodes the peptide sequence at SEQ ID NO. 77421
  misc_feature (389)..(389): n is a, c, t, g, unknown, or other
  misc_feature (569)..(569): n is a, c, t, g, unknown, or other
  misc_feature (570)..(570): n is a, c, t, g, unknown, or other
ctccccgcggtggcggccgctctagaactagtggatcccccgggctgcaggaattcgtctcacccctagaaaaagtagctttctggcatcgctactaccagacagagaggacaggggaggtcagagtcagagacgctcgctcacgacggcagcagccatggcagcaccgtgcggcggccgcgtggtggtcttcccgttcccgttccagggccacttcaacccggtgatgcgcctggcccgcgcgctgcacgcgcggggcgtcgggatcaccgtgttccacaccgccggcgcgcgggcgccggacccggccgactaccccgccgactaccgcttcgtgcccgtgcccgtggaggtggccccggagctgatggcgtccgaggacatcgccnccatcgtcacggcgctcaacgccgcctgcgaggcgcccttccggggacgcctctcggcgctgctctccgccgccgaccgcgaggcgggggaaggcggggggggccgcgtccgctgcgtcctcaccgacgtcagctggggacgccgtgctgtcggcgggccgcgggcctcggcgtggccgnncgctcggcgtcatgacggccagcgccgcaacgttccgcgtctacatggcgtaccgcaccttggtcgacaagggaatactgccccgtgagagaagagcgcaaggacgactcggtcgccgagctacccccgtaacgcgtgaaggaactgctgcggcacgagactgcgaacctggaagagtcgcgggactgcctgggccccttgtctcggcggcccggctgtcctccgggctcatcttcaaacgttccccttcatcaagccgggacccttggcaagatccgga

SEQ ID NO: 77421 - protein, 166 aa, Zea mays
  misc_feature: Ceres CLONE 1562381
  misc_feature (78)..(78): Xaa is any aa, unknown, or other
  misc_feature (138)..(138): Xaa is any aa, unknown, or other
MAAPCGGRVVVFPFPFQGHFNPVMRLARALHARGVGITVFHTAGARAPDPADYPADYRFVPVPVEVAPELMASEDIAXIVTALNAACEAPFRGRLSALLSAADREAGEGGGGRVRCVLTDVSWGRRAVGGPRASAWPXARRHDGQRRNVPRLHGVPHLGRQGNTAP

SEQ ID NO: 77422 - DNA, 1262 bp, Zea mays
  misc_feature: Ceres CLONE 1562382
  misc_feature: Encodes the peptide sequence at SEQ ID NO. 77423
  misc_feature (1)..(1): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
ngtgggtgggggctgctggtctcccctctcgcctccgtgataagataaataannnnnnnacacnnnnnnaaaagtttggagctccccgcggtggcggccgctctagaactagtggatcccccgggctgcaggaattcgtctcacccctagaaaaaccgcaccgcacccgcatcggtcgccagccgagccgagccctgctctctcctccagctccccaaatcacactccgccatggccggcacgtgcgctcacgtcgagttcctccgcgcgcaaccggcgtgggcgctggcgctggccgcagtgggactgctcgtggccgtgagcgcccccacccgcttcgcgctctgggtctacccaccgtttccccgcccgggcaagcccctgcgcccccgctaccggccctgggcaagcctgacggggtgccccccacgcatccggggggggggtggctttcacactcgacccgttcggtggcccccccactttttttttggaccccaaccgggtaaaagggcgggccgcgttcgcctctgttaaatacaacccaaggcacctcaaagttcccccgcgggtttggggctctttgcggtcccctcccttcacccgcgaccatggggccggcccctcccccgcgacggatagttgccccttttccctacttaccctctcgccttggagacgaccgcctcctgggaggttcagaccatatagttcgactgtgcgggcggttgttcccctcactattgcagggcggacagtccctctggcttgtgcacatgtgtatcaggcgagtgggttcgatagtccgcaccttctgagggacgcgcggggatgggcagacggcggcgctcgtggatgttttgcgactgcgccgccgattgggttacctcccttgtcggcctccccttcctctgcgccccggggggatggacctgtcatctattctcgcggcattggccgggcgctcgcgaccgtgtgaaccgccttcgttcattgtgctatccgttgttccacccgctttgatcccggtgcgctagtgaactcgcttatatattaccagccacagttgatcactctgcttccgatctttatccggggctcgttatctgcattgtcacaccgtattccgtgccctcccagtggtctgcgccaatttgccctcttgcgataaaccgtatacgctctcctagttcggtttacctctcttgtcttgctgcatgacgggtccatcttcttctacacctgttccgtatgcactcttt

SEQ ID NO: 77423 - protein, 101 aa, Zea mays
  misc_feature: Ceres CLONE 1562382
MAGTCAHVEFLRAQPAWALALAAVGLLVAVSAPTRFALWVYPPFPRPGKPLRPRYRPWASLTGCPPRIRGGGGFHTRPVRWPPHFFFGPQPGKRAGRVRLC

SEQ ID NO: 77424 - DNA, 772 bp, Zea mays
  misc_feature: Ceres CLONE 1562383
  misc_feature: Encodes the peptide sequence at SEQ ID NO. 77425
ctccccgcggtggcggccgctctagaactagtggatcccccgggctgcaggaattcgtctcacccctagaaaaactgtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccttgccgtccgcagggcttgctatggtgttcttcgttatgttatgggagagtggtgccaagggttgtgaggtgattgttggagtggaaagctcagggcccaaagagccaagtccatgaagttcaaggatggctacatgatctcatctggtcagccagtgaacgagtacattgactcggctggtgagacacgttcttctcagacagggtggtctcggtatccaaggtgaaagatcatgctttgactgggacccggaag

SEQ ID NO: 77425 - protein, 134 aa, Zea mays
  misc_feature: Ceres CLONE 1562383
  misc_feature (45)..(102): Pfam Name: KH_2 Pfam Description: KH domain
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMGEWCQGL

SEQ ID NO: 77426 - DNA, 860 bp, Zea mays
  misc_feature: Ceres CLONE 1562384
  misc_feature: Encodes the peptide sequence at SEQ ID NO. 77427
  misc_feature (680)..(680): n is a, c, t, g, unknown, or other
  misc_feature (761)..(761): n is a, c, t, g, unknown, or other
ctccccgcggtggcggccgctctagaactagtggatcccccgggctgcaggaattcgtctcacccctagaaaaagccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgccaccgacgagacccccgagctgatgccgctcagccacgtgctggccaccaagctgggcgcgcgcctcaccgaggggcgcaagaacggcacctgcgcctggctgaggcccgacggcaagacccangtggacggttggagtacgtggacgagggcggcgccatggtgccccgtccgccgtgcacacccgtgctcatctccacccagncacgacgagaccgtcacccaacgaccgagatcgcccgccacccttcaaggagcacgtcatccaagcccgtggaatcccctgagaaatacctccgacgat

SEQ ID NO: 77427 - protein, 233 aa, Zea mays
  misc_feature: Ceres CLONE 1562384
  misc_feature (4)..(103): Pfam Name: S-AdoMet_synt_N Pfam Description: S-adenosylmethionine synthetase, N-terminal domain
  misc_feature (118)..(225): Pfam Name: S-AdoMet_synt_M Pfam Description: S-adenosylmethionine synthetase, central domain
  misc_feature: SWISSPROT Homolog: EC 2.5.1.6 Methionine adenosyltransferase
  misc_feature (173)..(173): Xaa is any aa, unknown, or other
  misc_feature (200)..(200): Xaa is any aa, unknown, or other
MAAESFLFTSESVNEGHPDKLCDQVSDAVLDACLAQDPDSKVACETCTKTNMVMVFGEITTKATVDYEKIVRDTCREIGFTSDDVGLDADRCKVLVNIEQQSPDIAQGVHGHFTKRPEEIGAGDQGHMFGYATDETPELMPLSHVLATKLGARLTEGRKNGTCAWLRPDGKTXVDGWSTWTRAAPWCPVRRAHPCSSPPXHDETVTQRPRSPATLQGARHPSPWNPLRNTSDD

SEQ ID NO: 77428 - DNA, 853 bp, Zea mays
  misc_feature: Ceres CLONE 1562385
tccccgcggtggcggccgctctagaactagtggatcccccgggctgcaggaattcgtctcacccctagaaaaacaccaaacccacacaacaaaggccgcgcggctgttggataaccaaggcgtcggaggatttgcctgccgtgtagttcttcctcgttggcacccggctccgcactgagaaagcgcgatgacggcccaggcgaagcggcggcaagcggaggaccctctaaggcccgaattctgacggtcgagggcgaagagcaggatggaggtgcggtggtaggggcggggagggctgaagggaacggcagcaagggggtggagacggtagttggcggagaggctgacgggattagtgtgcgcatcgacccggatgtgctcgattgctccacctgcttcgatcccctccaaccgcccctctaccagtgccaaaatggccatgtagcgtgcttttcctgctggtctaggctcaccaacaaatgccacatttgttctagtgatgctaactttgtaagaaacattgcactggagaaagttgttgagtcagttaagtcatcctgctcatatgccaaatggggctgtaacaagttggtcagctatgcatgcagaaacgctcatgaagaatcctgcctttttgctccatcgatgtgtcctattcctgggttgtgggtacagaggatttactgggatggggggcaggacatttccttacaaaccataatagtgatgggctgcgcttctcctatggtcagtgtttttgatgtgaggttttggaaatgtaagttcccttttctggttctttcagccgaaggaggaacccctattccttttcactcaccaggaacctgattcc

SEQ ID NO: 77429 - DNA, 1108 bp, Zea mays
  misc_feature: Ceres CLONE 1562386
  misc_feature: Encodes the peptide sequence at SEQ ID NO. 77430
  misc_feature (1027)..(1027): n is a, c, t, g, unknown, or other
aaagctggagctccccgcggtggcggccgctctagaactagtggatcccccgggctgcaggaattcgtctcacccctagaaaaaatctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtggtacccgaacaagcagcgaggttttctggaactggacctggggctggggaccccgggtcgagcatctacgtgccccccattgaaaaagggcaaccatccgcccccttctgaaaagtggctcgaacctccaaaaacccagaatttttggggaatgggttgagctagggcagggaggcaatccccccgaaaggaacccggaactcgaaaggcccgcggtggggcccggccattcaacatgcaaaaggggccccccgaacaaaactccgtcccccacgcccttttcttctgtgtccagagaaaccccgcaattattaccccacggggtccaacacccatgaggctttttagatgagatggcggtatccaaaccatgtcacgagcaaagggcctcaaagaatcgggacccccctgtctattgtgtgaatatataaccgctattataactctcgcctctacagaaagagcggtaacgataaaggagtgcttgatctctcctttggataaaaaagactggcggtcctcccaagcccctggaagcgtgcgacaatattccccggattttcgtgggggagccgcgcccgagaagtgacgcgctctcgtcctttgtctccgatcgatgcggtaattatagggtgggcagagccctaaccattattggggagatttggancgaatatggctgcacgtcctttgacatgtctagtctgatcactcctcggcggctggcgctcacggtgtcgtcggacaaggg

SEQ ID NO: 77430 - protein, 105 aa, Zea mays
  misc_feature: Ceres CLONE 1562386
MATALLRRALHLRRVLPSPAVTAAASQRLIPAFSTTPTPTPTTSQQNAATTTIDLSSDESRRRLLNRLVVPEQAARFSGTGPGAGDPGSSIYVPPIEKGQPSAPF

SEQ ID NO: 77431 - DNA, 882 bp, Zea mays
  misc_feature: Ceres CLONE 1562389
  misc_feature: Encodes the peptide sequence at SEQ ID NO. 77432
  misc_feature (855)..(855): n is a, c, t, g, unknown, or other
agctccccgcggtggcggccgctctagaactagtggatcccccgggctgcaggaattcgtctcacccctagaaaaaagagagaaaggaagagaagggggcggagaagcacgtacgtcgtacatcgcccaccgccctttgcctcgcctcgcctcgcctcgcctgcatatctaacagccggagccggagccggagccggagccgacgccggcgccgacaatcgttccaactgatatggctacgacgccaccaggattcacgggcaacctgaagaaagcacttgcaggtctgagaagaatcagtttagatgggttgcgatggcgcgtatttgatgctaagggtcaggtgctcgggcgattggcttcccaaatagctgttgtgcttcaaggcaaggataaaccgacctatgcaccacatgtagaaaatggagacatgtgcattgtacttaatgcaaaggatatcagtgttacaggaaggaaaatgacagataagatttactattggcatacagggtatgttggccatttgaaggaaaggaggctcaaggaccagatggagaaagacccaactgaagtgattcgcaaagctgtgttgcgcatgcttccccgcaacaaactgcgtgaatgatagggatcgcaagctgaggatattttctggaaacgaacatccattccatgaccgccctctggaaccttttgtgatgccgccacggcaagtacgcgagatgcgcccccgtgcaaggcgtgcaatgataagggctcagaaaaaacagcaggcaacagagccaaagagggagaagatgctaagaatgcccgcagcggagtcactgcataggctccctgatgtgggattgcatngctgcaattttttttgcttggtagcat

SEQ ID NO: 77432 - protein, 130 aa, Zea mays
  misc_feature: Ceres CLONE 1562389
  misc_feature (29)..(130): Pfam Name: Ribosomal_L13 Pfam Description: Ribosomal protein L13
MATTPPGFTGNLKKALAGLRRISLDGLRWRVFDAKGQVLGRLASQIAVVLQGKDKPTYAPHVENGDMCIVLNAKDISVTGRKMTDKIYYWHTGYVGHLKERRLKDQMEKDPTEVIRKAVLRMLPRNKLRE

SEQ ID NO: 77433 - DNA, 901 bp, Zea mays
  misc_feature: Ceres CLONE 1562390
ctccccgcggtggcggccgctctagaactagtggatcccccgggctgcaggaattcgtctcacccctagaaaaaattgtcaggtggggagtttggctgaggcagcccaactctgaagttatgttttcctagactgcccatgttccgaggattagcatcagcattctagctacaaacatttcagatatctttcttgtaagggcaaacattatggcatacctagattcacttttcctgcttgtaattttgatcttcattttgaagtaataagtacttgagttaaggggacatttcttgtggaaaaaatgacgggaaatagctggacgttcctctgctacatgaaagagcgaattcacaggcaaactacagatggaaaaccaaaagggctgtcaagaggacccccaaaacattcgccaaaaaccggagaagctggttgtctcccctctcgggtctgggaaaagcaaaagccttgtggggctgttgtgtttttggaaaaaaaaaaaaccacattttgagaggggccccaacacaggcctgggtgggttaaacgccctgtgtttgttcaccattcaggcgacgcccagaattggacgggggggtgtcaaactcaaggggtgatgcggggggacaaaacactcccccaaaaaattgggggcggaaaaaaatccccgcctcttggtcccgccagtgaaaagaacacccccgttaatcttgtttgggggggtccaaaaaaattccttcggagcggtgatcaaaccggggggaaaaaaactttctttcccggtgggggccccaacctgttccccccccgaaagacttccccgaaaaccgcggggctagaaggacactctggtatctgggcccccaccaatttggggggacataaaaaaaaggccctctct

SEQ ID NO: 77434 - DNA, 768 bp, Zea mays
  misc_feature: Ceres CLONE 1562396
  misc_feature: Encodes the peptide sequence at SEQ ID NO. 77435
ctccccgcggtggcggccgctctagaatagtggatcccccgggctgcaggaattcgtctcacccctagaaaaagtacagaacacttcgcttcctggaaggctggaacagaaagaaccctaaaccctagcaatggcggcggcgaacctgctgtcgcgctcccttctccccaccataacatgtgaagttgagctatatgaattgctgctaatataaaactttgcacacaattgttcaaaagggtaaggttaaagtgcagttatgtaagtgaaccatgatgactaagctagtccacacaggatactaaacactattcatccatgacttggatatgttagaatgtaaaacaacttgatgtatggagaaagtcatcagtagtcagtgtatgggtttttgcagatagctataaacagatgcatagtctctgacatgtttttcttctgtatatatcatgatcctatttttgaccgaatactttggtcctactgttaacttgtaatttgcttggcctttacttagtgtaatataaacttaagggttttaattgtgctgttttgactttgactgggctgtcttctaatcttctggatgttattgtggttgttgtgatgcagctattctacagatgagcgaagttccgaatctggtaatatgcctgagcagcgtgcattactcgctgaatcaaagagacaagaggtgctgcaattggacaatgaaattgcttacaatgaagccataatcgagggaaagggagcaagccattcaagata

SEQ ID NO: 77435 - protein, 39 aa, Zea mays
  misc_feature: Ceres CLONE 1562396
MPEQRALLAESKRQEVLQLDNEIAYNEAIIEGKGASHSR

SEQ ID NO: 77436 - DNA, 966 bp, Zea mays
  misc_feature: Ceres CLONE 1562399
  misc_feature: Encodes the peptide sequence at SEQ ID NO. 77437
  misc_feature (851)..(851): n is a, c, t, g, unknown, or other
ctccccgcggtggcggccgctctagaactagtggatcccccgggctgcaggaattcgtctcacccctagaaaaggagaagctaagctgtcttctaactctctctcgagttcatagtttttgctcttcctctctcatggtcacaatgcttgcagctagttctctagtgaacagcaacctcgcttgctcatcaaggatatcatcctgttcagacttcacatatagccactcctggcgtcccatacatgctatgaaactccatcagatgcgtgctgtgagctcaatacgtataagttgtgctgccactaaacctgcaaagactcctgccgaagaagaatggaaagttaagcggcaactgctatcagaaaagcgggtacgaagtgtcgatgtgaaggaagcactgcgccttcaaaaggaaaacaactttgtcattcttgatgtcaggccagaagcagagtttaaagaggctcatccacctggcgccatcaatgtacaaatatacagattaatcaaggaatggacagcgtgggatattgcgaggcgtgcagcgtttgcgttcttcggcatatttgctggaacagaagagaatcctgagttcatacagagtgttgatacgaaggttggggaaagatgcgaagataattgtggcatgctctacaggatggacactgaagccaacgcaaaatttccctgatggggaagcaatctcggtccctgatagctgcgtacctgttggtcctgaatggctacagcaacctgtaccatctgggaagaagactttacacattgttccaaagaaagactaccacctgttgcccgagaagagtaaaaagacattacgacatagtgttcncatgcctgacaaagtggaaatggaagactaaaatcccaaggacctgtagtgatgttgcttgcttccaaaccacaaggttgttccaagtttgtgtcacggatttaaatatccaaaa

SEQ ID NO: 77437 - protein, 185 aa, Zea mays
  misc_feature: Ceres CLONE 1562399
MVTMLAASSLVNSNLACSSRISSCSDFTYSHSWRPIHAMKLHQMRAVSSIRISCAATKPAKTPAEEEWKVKRQLLSEKRVRSVDVKEALRLQKENNFVILDVRPEAEFKEAHPPGAINVQIYRLIKEWTAWDIARRAAFAFFGIFAGTEENPEFIQSVDTKVGERCEDNCGMLYRMDTEANAKFP

SEQ ID NO: 77438 - DNA, 835 bp, Zea mays
  misc_feature: Ceres CLONE 1562401
  misc_feature: Encodes the peptide sequence at SEQ ID NO. 77439
  misc_feature (487)..(487): n is a, c, t, g, unknown, or other
  misc_feature (490)..(490): n is a, c, t, g, unknown, or other
gagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcatcaccttctccacggaggaggcgatgcggaacgccatcgagggcatgaacggcaaggagctggacggccgcaacatcaccgtcaacgaggcccagtcccgcggcggccgtggaggcggcggcggtgggtacggtgggtggccgtggaagcngcngctaccgcggttggcgggcgccttgatgggcgcggcggctactgcgggtggcggcggcggctacgggggcggcggcggctacgggggggggtggcggccgcttacggcggggggcaaccctggggggggggttacggggaactcccaacggggaaattggaggaaacttaacccgggggggcccccccccggcccaaatttatccctggtttccccccccggggtttttttccccccacccccaaagggggttttttcttccttcgggctccaaggttttgttgtgtgcgcccccactccggggtttttttaaaaagcaggggggccccccttttgtgtccacaa

SEQ ID NO: 77439 - protein, 208 aa, Zea mays
  misc_feature: Ceres CLONE 1562401
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (104)..(104): Xaa is any aa, unknown, or other
  misc_feature (105)..(105): Xaa is any aa, unknown, or other
MAASDVEYRCFVGGLAWATDDHSLHNAFSTYGEVLESKIILDRETQRSRGFGFITFSTEEAMRNAIEGMNGKELDGRNITVNEAQSRGGRGGGGGGYGGWPWKXXLPRLAGALMGAAATAGGGGGYGGGGGYGGGWRPLTAGGNPGGGVTGNSQRGNWRKLNPGGPPPGPNLSLVSPPGVFFPPPPKGVFSSFGLQGFVVCAPTPGFF

SEQ ID NO: 77440 - DNA, 939 bp, Zea mays
  misc_feature: Ceres CLONE 1562403
ggagctccccgcggtggcggccgctctagaactagtggatcccccgggctgcaggaattcgtctcacccctagaaaaaacaaaggaacactgcagcctctaccacggccctcgttggcatgctgcgatcgtgtacgttctggggttttggctccttgacttctccaacaatactgtgcaaggtccagcgcgtgctatgatggctgatctgtgcggtaacgttctcggctaattcatttcaggctcttttttttttctaacaacagtttgtgacctgatttgtaactacttttcttttgctcaacgcaggtcatcatgggcctagtgcagccaactcaatcttctgttcttggatggcgctgggaaacatcctaggctattcctctggctccacaaacaactggcacaagtaaagcccaccgctcccacacgaactctacctgtttttttttaaattattctggaactggttttacttaacacgggcgcgttctgaatttctggtgctatcacatgcacaggtggtttccgttccttatgacaaacgcgtgctgtgaagcctgcgcaaacctgaaaggcgcgtttctggtggctgtggtgttcctagtcatgtgcttgactataaccctgttcttcgccaaggaagtgccctacagaggaaaccagaacctcccccacaaaggcaaacggccgaggtcgagacttgaacctttcgggcccactcgcctgtgctcaaagggcttccaagaaacttggcccacgggggaatgccgtccccgtgcctcctcgtaaactgggacctcccctgggtttctcttggtttccctgttttttccccttagaaaccccaaatgggaatggggccccttaaaatcctccccccggcgcacacccccaggggtttacaaacccgctccaagaatactccgggggttataca

SEQ ID NO: 77441 - DNA, 802 bp, Zea mays
  misc_feature: Ceres CLONE 1562410
  misc_feature: Encodes the peptide sequence at SEQ ID NO. 77442
ctccccgcggtggcggccgctctagaactagtggatcccccgggctgcaggaattcgtctcacccctagaaaaaagggccatccacccgtagccccgccccgccccgctgccggcaatggcgcggctcgtgctctccgagtgctgcggcctcgcgccgctgcgcctgcgcgccggccggggcgccattgcggcgccgtcgccccccgcgctctccgcagcggcggcgccgggccgccccgcgcccgcggccatccaccgcgactgggcgctccgcgtctccgcggccacccgcctcacctccgccgtcgaggaggacaagaggagctccccccttggggagggcgacgagcacgtggcggccagcggcgccgcgggcggggagttcgacccgggggcgccgccgccgttcgggctggcggagatccgcgcggccatccccaagcactgctgggtcaaggacccctggcgctccatggcctacgtgctgcgcgacgtcgtcgtcgtcctggggctcgccgcggccgccgcgcgcctcgacagctggctcgtctggccgctctactgggccgcgcagggcaccatgttctgggcgctcttcgtcctcggccacgactgtggacacgggagcttctcgaacaaccccaagctgaacagcgtggtcggccacatactgcattcctccattcttgtccccctacacggatgggagattagccacatgacgcaccatcaaaaccacggccactttgagaaagacgagtcctggcacccgctaccagagaagctgtacaaaagcctggt

SEQ ID NO: 77442 - protein, 228 aa, Zea mays
  misc_feature: Ceres CLONE 1562410
  misc_feature: SWISSPROT Homolog: EC 1.14.99.33 Delta(12)-fatty acid dehydrogenase
MARLVLSECCGLAPLRLRAGRGAIAAPSPPALSAAAAPGRPAPAAIHRDWALRVSAATRLTSAVEEDKRSSPLGEGDEHVAASGAAGGEFDPGAPPPFGLAEIRAAIPKHCWVKDPWRSMAYVLRDVVVVLGLAAAAARLDSWLVWPLYWAAQGTMFWALFVLGHDCGHGSFSNNPKLNSVVGHILHSSILVPLHGWEISHMTHHQNHGHFEKDESWHPLPEKLYKSL

SEQ ID NO: 77443 - DNA, 915 bp, Zea mays
  misc_feature: Ceres CLONE 1562412
  misc_feature: Translation starting site: 305
  misc_feature: SWISSPROT Homolog: EC 1.18.1.2 Ferredoxin--NADP(+) reductase
agctccccgcggtggcggccgctctagaactagtggatcccccgggctgcaggaattcgtctcacccctagaaaaactccgcctctactagaatgcacagaacctcggttccctctccagttattcaacctccccttggcacatggccatgggtgcccgatgcaccgcctgcggtcgatctatatgtcctcctcctccgcctcgtcccctgctgctgctgccaaggcctaggcggcgtctccgtctctcctccccatgcaggcacctacaattcctgtatgcggccatcccgcagcagccgtagatggtcggccccccctcggtgcacgggtcggtgtccaccaactacaccgttcgacgcggtggcggtgaagacggacacaaccttgatcaggggctggtcacaagcaaatacaatccccaggaggcgtacgtatggaggtgcctctccaactcctcgatcagcaggcacgacgcgccatgggagacgtggaagatggtcttcaccacagaacgctagatcccttatacataggggcagtccatcggcatcatctcttattgcataagactagaacgagtagacgcacaagctcaagctattctacatcgactgcagcgccctcggatatgtcagccactccaagacggtgtctctatacttgaacaggctagtctacaacaacgatcacgcggagagtgtaatacgagtctgctctaagtttctgtgtgacttgaaagcaggcgcccatgtgaacatacacgaccagtgcgagaggagatgctcatgccatatgacccaatgcaacagtccttatgttcgcaagcgggaactggtattgttcggctgcgctggcttatatggaataagttcctgtgaggacatcattgtctttaatgtcgccgacctttttt

SEQ ID NO: 77444 - DNA, 967 bp, Zea mays
  misc_feature: Ceres CLONE 1562413
  misc_feature: Encodes the peptide sequence at SEQ ID NO. 77445
cggccgctctagaactagtggatcccccgggctgcaggaattcgtctcacccctagaaaaaagcccggcacagacactactggcacgcacgcaccagcaccagcaccacaccacatgaatggtggagcctagcacgggcagctagctcccggccggcgacgtgacgaccaccaccaccacatgttgcatgagcagcaggcaccgccaccggcagtagcagcgccaccgccatccatcaaccccgacgacgacggcggccgcgatgtcgaggtcaccacgttccgcgacatccaccctctgacgcccgacgcgccgccgcccgcctccgcgtcctgggacacggccagccaccgctccttgtcgtcgtccgacgaccatgtgtagatgaccatgagccgcgagttcacggccatggtcgccgccggggcgaccatgcagcccggcggctacgacggcgccgccgaccagctcaccagcatcggggaggactagctggaggagacctacccgctggccatcgtccccgaaaggcacccccatcgccacgtcctccaggtccagggatgtccagggctggaaagttgtggccatcgtggcccggggaccgcaagagacccgaggcaccatgtaggcccacccctgtcctaataaaggaagtagggggggagaaccaagggtcaccgggtctgggtatgacgcgacccagggtcccccaagaatcaaacaaccgccgcccaaaaagggaaggacgggggccacaaaaagaggggggaagacctaacgagggtgggaaaagggcctccccggtgggttccaagaaagaaaggagaacggaaaaccgttcgtagacgtattgcgccgaggggcgtcggaataaccacgccctaccaactttgcccagggtgtcagacaacgggtgtgagaagaataagggcggctgtgttgcacgccctattcggagtactca

SEQ ID NO: 77445 - protein, 67 aa, Zea mays
  misc_feature: Ceres CLONE 1562413
MLHEQQAPPPAVAAPPPSINPDDDGGRDVEVTTFRDIHPLTPDAPPPASASWDTASHRSLSSSDDHV

SEQ ID NO: 77446 - DNA, 812 bp, Zea mays
  misc_feature: Ceres CLONE 1562416
  misc_feature: Encodes the peptide sequence at SEQ ID NO. 77447
  misc_feature (643)..(643): n is a, c, t, g, unknown, or other
  misc_feature (655)..(655): n is a, c, t, g, unknown, or other
  misc_feature (729)..(729): n is a, c, t, g, unknown, or other
ggagctccccgcggtggcggccgctctagaactagtggatcccccgggctgcaggaattcgtctcacccctagaaaaagcgcgctactccactggtccattacttacgcagtcagttcagcgagtgagcactgagcagccatgtagcaatttcaattgcaagttgcaacgcgacgaatacggagccatggacgacggcgccgcaaccacaatcgtccaaggcggcgacgcgcacgtcctgctcctgccgttccctgggatgcagggccacgcgaacccgatgctccagcttggccggcggctggccttccacggcctgcgccccaccttggtggtctcccgccacgtcctctccaccacctccacctccaggtcgtgccccatccccgtggccgccatctcggacggcttcgacgacggcgggatctcctcgtgcccggacaccgcggaatacgtgcgccggatggaggccgcggggtcggagactctggcggagctcctggacgccgaggcccgcgcggggcggtccgtccgcgtgctggtgtacgactcgcacttgccgtgggcgcgccgcgtggcgcgggccgccggcgtggcccgcgccgcgttcatgacgcagatgtgcgcggtggggctcgtctacngcaaggcgtggncccgggcgggtggccctgcccctggcggacggggccgcgctgccccgggagctcgccctggaactggccccccnacaaattggcccccgtttcgtgccggccccccggttggtaacccggggttttagggattcccgcgctaaacccagttcaaagg

SEQ ID NO: 77447 - protein, 198 aa, Zea mays
  misc_feature: Ceres CLONE 1562416
  misc_feature: SWISSPROT Homolog: EC 2.4.1.121 Indole-3-acetate beta-glucosyltransferase
  misc_feature (153)..(153): Xaa is any aa, unknown, or other
  misc_feature (157)..(157): Xaa is any aa, unknown, or other
MDDGAATTIVQGGDAHVLLLPFPGMQGHANPMLQLGRRLAFHGLRPTLVVSRHVLSTTSTSRSCPIPVAAISDGFDDGGISSCPDTAEYVRRMEAAGSETLAELLDAEARAGRSVRVLVYDSHLPWARRVARAAGVARAAFMTQMCAVGLVYXKAWXRAGGPAPGGRGRAAPGARPGTGPPTNWPPFRAGPPVGNPGF

SEQ ID NO: 77448 - DNA, 931 bp, Zea mays
  misc_feature: Ceres CLONE 1562418
  misc_feature (247)..(247): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (588)..(588): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (627)..(627): n is a, c, t, g, unknown, or other
  misc_feature (628)..(628): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (858)..(858): n is a, c, t, g, unknown, or other
  misc_feature (930)..(930): n is a, c, t, g, unknown, or other
ctccccgcggtggcggccgctctagaactagtggatcccccgggctgcaggaattcgtctcacccctagaaaaactttctatttagagtcctaggcaccacatagtatatagcagcagtgctttgctcagtccactttgttgaggctgggttgagagtgtaggagtaaagcctcaagtctctttggtagaggatacaccacaccatccgaccctccaccctttttcctcaacttggtcaacagccgncccatctactcactccaccacgggcatcattaaccattcctctcccatcttttctagaccgcccaagaatcaaccagccggaacaaaagggcggtctgccggaaagaagcatacgtcccccatggatggcgggtaccaccctctccccccccacaaaatcagccgttgacgggggaaagggggtccccacccccggggggcggtgaaagctacgcgtggagggggggggggtttcaagaggacgcccccctgccctgattaaatttaatccccttctttcccgccggaggaaaaaggaaaagagagagaannnagaaaattaatctcccacatctgccccnaaaagggcgctcagcccagcnnnnnnnnncaaggcgccnnccgnnnnntcccctccccccccaggtttacctggacaaaaccctccccaatttgtggccttcccccccgcggaaaaaatgggggttgcccccatttataccaaagggggaccccgccacaaggggggggggaaaaaaaaatttattccttagggaaaccaccaaaaggggtctaaagagggtggggaagcctggacccccccccctcccaaataaaaaagatttaacgcnccccccaggcatttttttcagggtgggggggtggagaaattccagagggagggggcgtcttaagtggagggna

SEQ ID NO: 77449 - DNA, 841 bp, Zea mays
  misc_feature: Ceres CLONE 1562420
  misc_feature: Encodes the peptide sequence at SEQ ID NO. 77450
ctccccgcggtggcggccgctctagaactagtggatcccccgggctgcaggaattcgtctcacccctagaaaaatctgcgggcaacaatgggtcagctaacgctacaggagaaaggaatacttttgctcctgttcgtcttattggatggcgtcgcttacgataggaatgtctgtggggggacactggtcttcatcctgactgggcagtccaacttgagcggacgcggcggcgccaccaacggaacctgggacggcatcgtgccaccacgagtgcgcgccctgggaccgcatcgtccgtctctgcgcagggcatcgcagggagcaggcgcatgagccactgcacgccggtgtccacttgggcaacgtatcactgcgtcgggcacggcatgcccttcacgaacgatgtggatgccagtgagggcgcagccggcatagccacgcgtcctcgtagggctcctgccgtgagcgcatggtggcacgacaatagccaactggtacggggagacggatctggactagcggatggtaacacgacaccaaggcggcagaggcctattgcagcggactacgtcacctgaacaaattgcttgagtaccagtggagagctgtacacacgactgaggcaagatgctgagctcttgcaacagcagatggagactatacagcgtgatgtgtattgacatgtctgccggactgacatcaccgtaatcaagtggagattgcggatgcacacacattggctagtgtactctgcgtgccgacggcagatcaaaaagatatgaactcccgagtgactatccattgatgacatgccgctaccaatcctaggtgacacatcgtc

SEQ ID NO: 77450 - protein, 81 aa, Zea mays
  misc_feature: Ceres CLONE 1562420
MGQLTLQEKGILLLLFVLLDGVAYDRNVCGGTLVFILTGQSNLSGRGGATNGTWDGIVPPRVRALGPHRPSLRRASQGAGA

SEQ ID NO: 77451 - DNA, 854 bp, Zea mays
  misc_feature: Ceres CLONE 1562422
  misc_feature: Encodes the peptide sequence at SEQ ID NO. 77452
  misc_feature (731)..(731): n is a, c, t, g, unknown, or other
ccgcggtggcggccgctctagaactagtggatcccccgggctgcaggaattcgtctcacccctagaaaaaactccaactctcaagcgtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaacagacggagtgcacctccggcgagccgtgccagcgcatccgggaggcggagtgcaagcccaggtgtcgaagctgcacgtgcacgccgacccggncgaaccttagctgggtggtcaggaccggtacccaagggcgcaagtaccgggcagaaggtcaccaaggaaaacccttgtcccgcgggcctactttcgtgggttcttcgccccgggctggccaaa

SEQ ID NO: 77452 - protein, 218 aa, Zea mays
  misc_feature: Ceres CLONE 1562422
  misc_feature (178)..(178): Xaa is any aa, unknown, or other
MDPWISSQPSLSLDLRVGLPPLSLHHQAPVAVALPRPKLLVEENFLLPPPKKEPEVAALETELQRMGEENRRLAEALAEVASKYEALRGQYTEMVAAAATACGNHPSSTSEGGSVSPSRKRKSESTDTAPPAQQLLHQHYPAVAPEQTECTSGEPCQRIREAECKPRCRSCTCTPTRXNLSWVVRTGTQGRKYRAEGHQGKPLSRGPTFVGSSPRAGQ

SEQ ID NO: 77453 - DNA, 809 bp, Zea mays
  misc_feature: Ceres CLONE 1562423
  misc_feature: Encodes the peptide sequence at SEQ ID NO. 77454
ctccccgcggtggcggccgctctagaactagtggatcccccgggctgcaggaattcgtctcacccctagaaaaatttgctgctctccgaccccgagctccgaaggccgcagcatcaggcgcgccccccctcgcgtgtgaccgagatggcgctgccgaatcaggggaccgttgattaccccagcttcaagctcgtcatcgtcggcgatggtggaactggtaaaactacatttgtgaagaggcatctcactggagggtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgaggaaccttttcctgtactttgcaaggaagctgggctggtgatccgaacccttcactttgttgaaactgttgcctcttaagcctccgggagttaccctccaacagggcttttccagcaccaccttgaaacctgaactttggttggaaaacttgcaaaaacctctttcctgatgaccaagaatat

SEQ ID NO: 77454 - protein, 186 aa, Zea mays
  misc_feature: Ceres CLONE 1562423
  misc_feature (15)..(173): Pfam Name: Ras Pfam Description: Ras family
  misc_feature (15)..(128): Pfam Name: Miro Pfam Description: Miro-like protein
MALPNQGTVDYPSFKLVIVGDGGTGKTTFVKRHLTGGFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEEPFPVLCKEAGLVIRTLHFVETVAS

SEQ ID NO: 77455 - DNA, 669 bp, Zea mays
  misc_feature: Ceres CLONE 1562426
  misc_feature (237)..(237): n is a, c, t, g, unknown, or other
gagctccccgcggtggcggccgctctagaatagtggatcccccgggctgcaggaattcgtctcacccctagaaaaactctttccgccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccnatgcctcgtcgccgccttccgcggaacggccggccgcggccgttgggctgccaaaagttctccgtcccccgttcgggtcaatcggggaacccgccccagggccccgttcccccttcgaaatttttcaaaaaaaccctttccccgttttttttcaaagaaaaagggggaaaaaaaaggggggggggtccccccccctgggggggccccgggggggcccccttttggggggggggggaggttttttttttaatttttttttcaaaaaaaaaaagggggggttttttttgggggtaaaaaaaaaggggggaaaaaaaaactcccgcgggttttttcccccccgcccccccccggttggtgtttttttttatccccccgcccccaaaaaaaaaaaaagaccccccctctttttttttatataaaaagaaaaggagg

SEQ ID NO: 77456 - DNA, 808 bp, Zea mays
  misc_feature: Ceres CLONE 1562428
  misc_feature (470)..(470): n is a, c, t, g, unknown, or other
  misc_feature (496)..(496): n is a, c, t, g, unknown, or other
  misc_feature (497)..(497): n is a, c, t, g, unknown, or other
  misc_feature (507)..(507): n is a, c, t, g, unknown, or other
  misc_feature (508)..(508): n is a, c, t, g, unknown, or other
  misc_feature (657)..(657): n is a, c, t, g, unknown, or other
ctccccgcggtggcggccgctctagaactagtggatcccccgggctgcaggaattcgtctcacccctagaaaaatggagtttggacgggctcgcctcggccgctctggcgcttgtgcggtgggtgaagcgcgggtgctggtgcgggaagcctcgccagacctagcgctgccgactgccgagctgggtgcgggcgcgaggagtcgacgggaagacaaggaattatgagtgaaacagggcacactgtacaagtcactaacctctcgagcagagtatctgaaagtgatcttcatgagttcttttcgttctctggtcctattcagcatatagaacttatcagatcagaaggatacggtgccactgcttatgtgacattcaaggaacgctttgccttggaaactgcagtattgctcagtggggctactattgtggatcagccagtatgcataacctattggggacaacctgaggnaactttttatttctgggacaggccannctggggaggnntgagagcaaatcgaatacaggaactacaaaacatgccagtacaacactactccgcaggaagcttttacagtggctcaagatatcatgaagacgatgctaggaaaggggtacgtgctcagcaaggatgctttgggctaaagctagagccntttgatgagtccctatggatttaacggctgcagctggcagccagggctgcaaaaactgaacaagaaaaatggttttaactgaaggggccaaggccggggggttggggcaaatggcaatcaggccaagaaaacctttgggggtaaaaaaaat

SEQ ID NO: 77457 - DNA, 1318 bp, Zea mays
  misc_feature: Ceres CLONE 1562429
  misc_feature (1279)..(1279): n is a, c, t, g, unknown, or other
  misc_feature (1318)..(1318): n is a, c, t, g, unknown, or other
ttgctttctgcccaccccgccactttttcctcctctttttaaggcggagaagggtttatttggtctatgtggtgtctcccgcggtggcggccgctctagactagtggatcccccgggctgcaggaattcgtctcacccctagaaaaaccccaccagtctctggcaggttctcccccccacccctctccgtctccgatcccgtccgcattgcttcgcgccggaccaaggaggaagggtcggcgtcgcaggcattgcggcctgccagccactagggccatggacccgtggcccgttcgttgcggtgctgggcggcaacctggtgcttaaaatgccggtatcaggggccccccgtcgcctccgctgtttgggttcctggttgaccccgggctctccgcccctggctacttcggccgcattcctcctgaaataatcatgccctgccaaaccgccccccccctcccgttgcttgccggtctagttgtggtaaggcttcggccccctgggcacctggtttctttcggccgggcacgccctttcccccccctttcttaaggcttaatccttgttacccgggggcaccgcctcacaaggagaccgtcgttttcttccccttgtgtagggcgcgccactctcctccttgtggggggcggtcttatggatgggagccgattttaccctcccctcgccctgattcgtgcgccttcattttaacttcgacacctcagtcttatttcctcctcttcgacgaagtgactccgtattagcttgatgggtgggacccaatagcattaggggcgaaaccgacgggtttgcgctagtaaccccgccactattggtgctctattttcatcaacaagatggcggtatttgccatcagtcagctctgtcccgcgtttgtttgggagtatataccgcccggacacctatctcacacatttggtcattccaacaagcctacctcaccattatcatgggtatagctctccgagtgagtcagtattgtcatgtgcgatcgagcgcgcacattgcaggagaatatcatcactcacaacattaagtgatggatggatttctcgcctttctatctgatacacctatcaatgataatgcactcatatcagtggtatcctcgcacctcgcgggttgaccttccttcccagtgtactatcaatgcgctgtttagcgttgcatacatcgtgcccctgacacatcgccgcagattgcgggggacagtatattttcctcttgtgtactctcgcatagtacacagtctgctatnatcacttctctcgacctgcctttcccccttcatcgtccn

SEQ ID NO: 77458 - DNA, 863 bp, Zea mays
  misc_feature: Ceres CLONE 1562431
  misc_feature: Encodes the peptide sequence at SEQ ID NO. 77459
  misc_feature (642)..(642): n is a, c, t, g, unknown, or other
  misc_feature (647)..(647): n is a, c, t, g, unknown, or other
acccgcggtggcggccgctctagaactagtggatcccccgggctgcaggaattcgtctcacccctagaaaaagccccatcaagattccgaccccaaaatccctctccgagctcgaccaaaaaccaccctctctgattcattccacccacgtccacgtacgtacgtacattcccaccacctcccagtgcagcgccagtctgtaacccataaccatggtggtcctcaccaaaggcgagctggagcagatcgcgctgccggccgtgcagcgcgcatcgccgccgccgccggccgccgtgccggaggtcgacctggcagccggggacgccgccgccgcgcgcgccgtggccaaggcgtgcgaggaccacggcttcttcaaggtgacgggccacggcgtgccgccgcacctcctggcgcgcctcgaggccgccgcggccgcgttcttcgcgctcccgcagcgggagaaggacagggccgccggctgcccgttcggatacgccagcaagcggattggcgccaacggcgatctcggctgggtcgagtacctcctgcttgccgtcaccgccgccggcgcagcggccgcgccggtgtctgcgtgcgagggcgcggagccgccctgtttccgtgctgtgctggacgagtacntggcngcggtgaggcgcatgacctggcacgttgctgcagcttgatgggcgcaggggctgggcctcgaacaacaagggacgtgttcaagcccgctgggtgcctggacgggggacagccgaccccattggctgaaggggggaaacactaacccggccgcggcccccaagccaaagggggggggggggagaaaaacaaagcgcggcctgaaaacgggggttcca

SEQ ID NO: 77459 - protein, 157 aa, Zea mays
  misc_feature: Ceres CLONE 1562431
  misc_feature: SWISSPROT Homolog: EC 1.14.11.13 Gibberellin 2-beta-dioxygenase
  misc_feature (144)..(144): Xaa is any aa, unknown, or other
MVVLTKGELEQIALPAVQRASPPPPAAVPEVDLAAGDAAAARAVAKACEDHGFFKVTGHGVPPHLLARLEAAAAAFFALPQREKDRAAGCPFGYASKRIGANGDLGWVEYLLLAVTAAGAAAAPVSACEGAEPPCFRAVLDEYXAAVRRMTWHVAAA

SEQ ID NO: 77460 - DNA, 753 bp, Zea mays
  misc_feature: Ceres CLONE 1562432
  misc_feature: Encodes the peptide sequence at SEQ ID NO. 77461
ctcaccgcggtggcggccgctctagaactagtggatcccccgggctgcaggaattcgtctcacccctagaaaaaatggtcaaaacataatatttcagaacaagtccgaacgaactgaaggagaggaggaggaggaggaatggcggacgcagccagaggcctcgggtcttcgtctctcccggtggctaacgtgcaggcgcttgcggagtcttgcaacgacaacggagccgatgcgccggtgcccgggaggtacctcatcaaggatcctagcgccgaggaggtcgtagccgccggcgacagcgcctgcacgattccggtcatcgatttccgcaagctgctcgatccggggtcgtacgaggaggagtgcgccaggctgggagccgcgtgccaccactggggattcttccagctcatcaaccatggcgttccggccgaggtgactgggaacctgatgaaggacgtagctgggttcttcaggcagccgctggaagccaagaaggagtgcgcgcagcaggccggcagcatcgaaggctacggccaggcccttcgtcgtgtcggaggaccagaagctggactgggcggacatgctcttcctcatcgtgcggccgaaggaggccagggacatgcgcttctggccgacgcgccctgagtcttccaggatcccgtggacgcgtactccttgtagctccaaagctagcgtacgcccggctggagtcatggcaagggggctggggtgcccaaccccgcgtccctt

SEQ ID NO: 77461 - protein, 169 aa, Zea mays
  misc_feature: Ceres CLONE 1562432
  misc_feature: SWISSPROT Homolog: EC 1.14.11.19 Leucocyanidin oxygenase
MADAARGLGSSSLPVANVQALAESCNDNGADAPVPGRYLIKDPSAEEVVAAGDSACTIPVIDFRKLLDPGSYEEECARLGAACHHWGFFQLINHGVPAEVTGNLMKDVAGFFRQPLEAKKECAQQAGSIEGYGQALRRVGGPEAGLGGHALPHRAAEGGQGHALLADAP

SEQ ID NO: 77462 - DNA, 839 bp, Zea mays
  misc_feature: Ceres CLONE 1562433
  misc_feature: Translation starting site: 180
  misc_feature (596)..(596): n is a, c, t, g, unknown, or other
  misc_feature (597)..(597): n is a, c, t, g, unknown, or other
  misc_feature (803)..(803): n is a, c, t, g, unknown, or other
ggagctccccgcggtggcggccgctctagaactagtggatcccccgggctgcaggaattcgtctcacccctagaaaaactcaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtcnngtgtgggaggcgctggtgctggagatcgtgatgaccttcgggctggtgtacacggtgtacgccacggcggtggacccgaagaagggcagcctgggcaccatcgcccccattgccatcggcttcatcgtggggcacatccctgggggggggcggcgctttcgacggcgcgtcattgaaccccgccgtgtcctttcggcccgcctcgntcagctgggagtgggccctaccaatggggtgtactg

SEQ ID NO: 77463 - DNA, 860 bp, Zea mays
  misc_feature: Ceres CLONE 1562434
  misc_feature: Encodes the peptide sequence at SEQ ID NO. 77464
  misc_feature (294)..(294): n is a, c, t, g, unknown, or other
  misc_feature (330)..(330): n is a, c, t, g, unknown, or other
  misc_feature (509)..(509): n is a, c, t, g, unknown, or other
  misc_feature (510)..(510): n is a, c, t, g, unknown, or other
  misc_feature (558)..(558): n is a, c, t, g, unknown, or other
  misc_feature (559)..(559): n is a, c, t, g, unknown, or other
  misc_feature (590)..(590): n is a, c, t, g, unknown, or other
  misc_feature (595)..(595): n is a, c, t, g, unknown, or other
  misc_feature (602)..(602): n is a, c, t, g, unknown, or other
  misc_feature (611)..(611): n is a, c, t, g, unknown, or other
  misc_feature (619)..(619): n is a, c, t, g, unknown, or other
  misc_feature (622)..(622): n is a, c, t, g, unknown, or other
  misc_feature (656)..(656): n is a, c, t, g, unknown, or other
  misc_feature (660)..(660): n is a, c, t, g, unknown, or other
  misc_feature (707)..(707): n is a, c, t, g, unknown, or other
  misc_feature (708)..(708): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (717)..(717): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (731)..(731): n is a, c, t, g, unknown, or other
  misc_feature (776)..(776): n is a, c, t, g, unknown, or other
  misc_feature (777)..(777): n is a, c, t, g, unknown, or other
  misc_feature (829)..(829): n is a, c, t, g, unknown, or other
acccgcggtggcggccgctctagaactagtggatcccccgggctgcaggaattcgtctcacccctagaaaaaaacccgccgctagtcggctagtgggtgggaaatccgcagattcccgtcgctacttcggccacatggctgcagcggcggcgtggaccggcgccgcatcccccaactcgctgctgctctcgcgctcgcctccccacgccgccgcgctcgcgccttcgccgggaagctccatgcggaggcggctcctcctcggcgtcggcacccctggccgtggcggcgctggcnggccccgcggccgccccccaaccgggtgtctttccnaggaagggaaacgggcccttggggtttataacccgccgggggcctaatttttttggggggcccttttccaaaaaagatttcccccccccccccggggggggggtttttttttaaaaaaaaaaaaaatattttttttttaaaagagaaaaaagggggtggtttttttgttttttcccttnnttccctacctaacccagagaggtcggagtaagaagaccgacatagtannagcccgccaccccgccgccttccctgccgcntcaanccgggcncccacccanaccccccnggngggtgtgagtaaactcccgtctccgcgcagccgnaggnatgggcgggctgtagtaaataagtttataatatggatacactaaatnnannnggggnggggccccnnnttntttttttttttttttttaaataaaaaaaaaaaaaagattgaaggnntttgtttgtgtttggaggggggggggcttgttttttccacctcccccgaggnatgaggggatgaaatgagggatatatatagc

SEQ ID NO: 77464 - protein, 80 aa, Zea mays
  misc_feature: Ceres CLONE 1562434
  misc_feature (54)..(54): Xaa is any aa, unknown, or other
  misc_feature (66)..(66): Xaa is any aa, unknown, or other
MAAAAAWTGAASPNSLLLSRSPPHAAALAPSPGSSMRRRLLLGVGTPGRGGAGXPRGRPPTGCLSXEGKRALGVYNPPGA

SEQ ID NO: 77465 - DNA, 824 bp, Zea mays
  misc_feature: Ceres CLONE 1562437
  misc_feature: Encodes the peptide sequence at SEQ ID NO. 77466
  misc_feature (773)..(773): n is a, c, t, g, unknown, or other
agctccccgcggtggcggccgctctagaactagtggatcccccgggctgcaggaattcgtctcacccctagaaaaaagaggccggtcaccgagtgccactcctgctcagatctagcgtcggaaatggctgccgccctggccgcagcttccatagtgttcaagaacagcaagacctactccgacaagctcgtcaagggcgccaaggccctgtacaagttcggcaggctgcagcgtgggcgatacagccccaacggatctgaccaggccatcttctacaactccaccagctactgggacgagttcgtgtggggcggtgcgtggatgtacttcgccacggggaacaactcgtacctcaccgtcgccacagccccgggaatggcgaagcacgctggagcatactggtttggaagtccaaactacggagtgtttacctgggatgacaaacttccaggagctcaggttcttctcagcaggttgcgactcttcctaagtccagggtacccttacgaagaaatactgaggacattccacaaccaaaccgacaacgtcatgtgctcgtatttacctgtattcaattcattcaacttcaccaaaggaggattaatacagctcaaccatggaaggcctcaaccgcttcagtacgctgtcaacgcagctttccttgcttctttatacagcgactatcttgaagcggctgacacggcctggggtggtactgtggaacgaacttctacacccatagaagtccctcccgcagtttgcccagtcacagncttgactacatcccttggaaagaacccattgaagatgagcttacgtttgtg

SEQ ID NO: 77466 - protein, 233 aa, Zea mays
  misc_feature: Ceres CLONE 1562437
  misc_feature (1)..(223): Pfam Name: Glyco_hydro_9 Pfam Description: Glycosyl hydrolase family 9
  misc_feature: SWISSPROT Homolog: EC 3.2.1.4 Cellulase
  misc_feature (217)..(217): Xaa is any aa, unknown, or other
MAAALAAASIVFKNSKTYSDKLVKGAKALYKFGRLQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPVFNSFNFTKGGLIQLNHGRPQPLQYAVNAAFLASLYSDYLEAADTAWGGTVERTSTPIEVPPAVCPVTXLTTSLGKNPLKMSLRL

SEQ ID NO: 77467 - DNA, 774 bp, Zea mays
  misc_feature: Ceres CLONE 1562439
  misc_feature: Encodes the peptide sequence at SEQ ID NO. 77468
  misc_feature (632)..(632): n is a, c, t, g, unknown, or other
acccgcggtggcggccgctctagaactagtggatcccccgggctgcaggaattcgtctcacccctagaaaaatgaatggtgtcacaagccgagagcttacacctgcaattactgtgttgcagttgttcttaagttcatccaaacctgttctcagatttgcagctgttcgcacacttaacaaggttgcatcaactcatcctttggctgtcacaaattgtaacatagacatggagagcttaatctctgatcagaacaggagcgttgcaacccttgcaattacaacactgttgaagacaggcaatgagtcaagtgttgatcgtttaatgaaacagatgaccaactttatgtcagacatagctgatgaatttaagattgttgttgttgaagcaataagatccctgtgcttgaagttccctctgaaatatcgctcattgatgaacttcttgagtaatattctacgggaagagggaggattcgagtacaagaaagccatagttgattcaattattatactcattagagatattcctgatgcgaaggaaagcggtttatttcacttatgcgaattcatagaagactgtgaattcaccctatttgtccactcagatacttcacttttttgggaaatgaangccccaaaaacatcagatcccagtaaatacatacgctatatttacaataaggggtgatacttgaaaaatgctaccagttcggagctagtgcaagtcagcacattggccaaaaatggggggggccttgggtgactcactccaa

SEQ ID NO: 77468 - protein, 205 aa, Zea mays
  misc_feature: Ceres CLONE 1562439
  misc_feature (187)..(187): Xaa is any aa, unknown, or other
MNGVTSRELTPAITVLQLFLSSSKPVLRFAAVRTLNKVASTHPLAVTNCNIDMESLISDQNRSVATLAITTLLKTGNESSVDRLMKQMTNFMSDIADEFKIVVVEAIRSLCLKFPLKYRSLMNFLSNILREEGGFEYKKAIVDSIIILIRDIPDAKESGLFHLCEFIEDCEFTLFVHSDTSLFWEMXAPKTSDPSKYIRYIYNKG

SEQ ID NO: 77469 - DNA, 853 bp, Zea mays
  misc_feature: Ceres CLONE 1562440
tggagctccccgcggtggcggccgctctagaactagtggatcccccgggctgcaggaattcgtctcacccctagaaaaaaatcgcgcgcgggccgcggggtataacgcaagcggaggcatacctggcaacaaaggcagcaatggagacggggtggctcgcagggtctctccccctccgctccgcatccacagccccgtcggcggccagggcacagcctctaccctccaccacctcaccagcgccgcatcccatcgtcgactttcggttgccaatggcgggagcgagcaccagctcgtcaccgcgcatgaaccggcgcacggagagtcgagactgcctctagctgctgcctggctgctatataaaatgtcaaatccaatacgaccgactgtaattagcttcacactatatccacgaactatcctacgactggatccgaaaccagacattacgtttcccgtggctgctcatctttaatttcacaataaaaattgttaacaaatctgccgtctgctctttggtggggcagcagaaccagattatagaattgtgggcactcaccatgtcaggatcctgtgcgagaatctagagagatcactggcgtcctgccagacctactgagaatgatggtgaaatactctcggccgaacacaagctctcgaacagggcactggactctaggtgggtacagtagcgatccacgtgactgagctgccgaatcctgatccgataaccggacgctccagccacgggcgtagtgatccggatacctgtctaacgattaaatacgtactgaacctgaaccaaagtctttgatgaagctgaaacaactcgcacctaagcaaatctgggaag

SEQ ID NO: 77470 - DNA, 1220 bp, Zea mays
  misc_feature: Ceres CLONE 1562441
  misc_feature: Encodes the peptide sequence at SEQ ID NO. 77471
  misc_feature (863)..(863): n is a, c, t, g, unknown, or other
ccccccctctgttgttcccgactccttggggttttgccgatcgactttttttggggagcaaaaaaaaaatttgggactccccgcggtggcggccgctctagactagtggatcccccgggctgcaggaattcgtctcacccctagaaaaaactctccagtgccctgccaatcccccgctctcccgcctaccgccaggcccaggcgccagcctccaaagtccaaacccagctagagcttagagctagcatggagtccgccgccccgtgcccgcgcgcgcacgcgcaccccgtggacctccgctggctgctctccgtcgccgccggcggcctcttcgcgctgctgctggtgctgctggccacctccccgtcgttccggctcgcctccacctcgccctcaccccgcctcttcctcggccccgcgtccggctcctcccgggcgcgcccaccactcttcgtcgagcccgccctgtcccgcccggcggcgccgtccccgcccgcgtccgcctcgctcccgcgcttcgcgttaccctcatcttcggctcggccggggacgccggcatgatgcgccgctgcctgctggcgctctaccaccccaggaaaccgctaacggcctcctccttaaacgcgggaagtcgcccgaaccccttaccctggccgggggcctgggccgacctttctttccgaccgtgcaaccccgtgatgccccctccgggcggtcgtcacgaaaacgctggaagggggtcgggtccgtaaaaaagagggccaaagccttgcggtgccacaccctatgagggcgggggctcccccaccctccattgggggtgggacaccacccccacccggcttggatatagaggccctgtnccacgaactcggcgtcgctgacctgtgattagtaggttcgccaagagggccaaaggaaggaccccctctgtggtccatccctaacacagtggggaaccacgtgagttctacatcaaaacggattatgccgggaccccgccgataattaaccccgcgccgccgggcctatggtaaaagggaaagagatattccacactgcactagttattttctatctcataaggcagatgcgctagaggttgtatattaggatagtacaccgcccacgccgagcgtgattgtcacctctccctccacgctaataagatttatcactaaggcgctatattcctcgctatacagtataattgcggctgc

SEQ ID NO: 77471 - protein, 64 aa, Zea mays
  misc_feature: Ceres CLONE 1562441
MMRRCLLALYHPRKPLTASSLNAGSRPNPLPWPGAWADLSFRPCNPVMPPPGGRHENAGRGSGP

SEQ ID NO: 77472 - DNA, 749 bp, Zea mays
  misc_feature: Ceres CLONE 1562442
  misc_feature: Encodes the peptide sequence at SEQ ID NO. 77473
  misc_feature (706)..(706): n is a, c, t, g, unknown, or other
ctggagctccccgcggtggcggccgctctagaactagtggatcccccgggctgcaggaattcgtctcacccctagaaaaagaacccgtctcgcaccacaagcgagcgagggacccggggcggaagaagagagagaagacgtctctctcctctcggcgtccccgttccccaacctctcgtctgctgcctgcctgcctgcctgcctgcaaaaaggagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggcggtgttttcttagtgaacattcatttcccgccagattaccccttcaaacctccaaaggtttctttcaagacaaaggtcttccatcctaatatcaacagcaatggaagtatatgccttgacattctcaaagagcagtggagccctgctctgacaatttctaaggtcctgctctccatctgctccctgctgaccgaccccaacccggacgaccctcttgtcccggagattgcccacatgtacaagacggaccggccgaaagtacgagtcgacggcccgcagctggacgcagaagtacgcgatgggctgacgaacgctttcctgctccgtcaccccgactggcgtcntcagaaaagccgttcctggggcgccattgttccccttgggatt

SEQ ID NO: 77473 - protein, 176 aa, Zea mays
  misc_feature: Ceres CLONE 1562442
  misc_feature (5)..(136): Pfam Name: UQ_con Pfam Description: Ubiquitin-conjugating enzyme
  misc_feature: SWISSPROT Homolog: EC 6.3.2.19 Ubiquitin--protein ligase
  misc_feature (162)..(162): Xaa is any aa, unknown, or other
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKVRVDGPQLDAEVRDGLTNAFLLRHPDWRXQKSRSWGAIVPLGI

SEQ ID NO: 77474 - DNA, 775 bp, Zea mays
  misc_feature: Ceres CLONE 1562445
  misc_feature: Encodes the peptide sequence at SEQ ID NO. 77475
  misc_feature (568)..(568): n is a, c, t, g, unknown, or other
  misc_feature (615)..(615): n is a, c, t, g, unknown, or other
  misc_feature (739)..(739): n is a, c, t, g, unknown, or other
ctccccgcggtggcggccgctctagaactagtggatcccccgggctgcaggaattcgtctcacccctagaaaaaatggtcggtcgtcaatcggccacgattcccagtcatcaccaattattactgtctttcgtccacagctactcatcaatgtgatcgacatgaacctcgcgtccgcggtgcgagtgttcttgtcctactgcctgctgctccaccggtggatggggtccgagcaggccggaggcgtgttcgatcaggggggccatagcgtcagcctcacccgcctcgacgaagcaagggctccgccgaggtgcgccgtgcagtcgtccctgtccagcgcggccagcctgccgccgaagccgctgctcgtcgccgcgccgcgcgagactggggagtacccggtgatcctgttcctacacggctacctcgccgtcaactccttctactcccagctgttcgagcacgtcgcctcccatggctttatcgtcgtcggacctcaggtaggtagtagttatgtaagcagtagttcggacttcagatccaccaaagttagctttagttcacatctngctcgtcgatcgcgcatgcagctgtacaccatatccggggccgacancaaccgaggagatcaactcagcggcggccgtcatcgactggctagccaccgggctgccgtcaactctgcccactcggcgtccgcgcggaacctaaccaagtgtccatctccggccacagccgcnggggggaaaggtgggcgtccgcgcttggcgctggcc

SEQ ID NO: 77475 - protein, 205 aa, Zea mays
  misc_feature: Ceres CLONE 1562445
  misc_feature (22)..(203): Pfam Name: Chlorophyllase Pfam Description: Chlorophyllase
  misc_feature: SWISSPROT Homolog: EC 3.1.1.14 Chlorophyllase
  misc_feature (152)..(152): Xaa is any aa, unknown, or other
MNLASAVRVFLSYCLLLHRWMGSEQAGGVFDQGGHSVSLTRLDEARAPPRCAVQSSLSSAASLPPKPLLVAAPRETGEYPVILFLHGYLAVNSFYSQLFEHVASHGFIVVGPQVGSSYVSSSSDFRSTKVSFSSHLARRSRMQLYTISGADXNRGDQLSGGRHRLASHRAAVNSAHSASARNLTKCPSPATAAGGKGGRPRLALA

SEQ ID NO: 77476 - DNA, 1267 bp, Zea mays
  misc_feature: Ceres CLONE 1562446
  misc_feature (1267)..(1267): n is a, c, t, g, unknown, or other
ccagtcccttcttcgttctcccctgccctcttttccccctcccatagttcttttttatttttttatatctggagctccccgcggtggcggccgctctagaactagtggatcccccgggctgcaggaattcgtctcacccctagaaaaagtttcttttcgttcaggattcccccttccgtcggctgcattcctacgcgcgtgttctgtctgtctctctcggccccctctcgctctccgacgactggtgggccgctgccggcgccgccgccttaacccaggtgttgaagcttttcgttggtctcctccccctccaacaacaccccccaggatgatttctaaaccttaggaggaagtcatagcccagtttgaaattacaaggaaggcccgtgacaaaaaaatttattgggaactcccggaaacaaagaattaattcccagagattttagatggacactttgtgatgcttcaaaaaaaggccctcgaaaacccgaattggcccctcctaattaaccacttcctttttgggaaactccccgcggaattcccaagaaaacccgggatgtaccttttgcgaagggtacccctcgttctaggtttagggtggggattaatttttgggtaggagaacccctctctccatagaaacccctctttccgggtgtgtaaccccgggaaattcataagagggcgtgaaagcttgtttatttttgaatcaccctctccaatggctggtgattatacccccttcctgggggggataataccacccgggtgggtgatctttcccctccacatacttttttggccctgctatggggttccccgcgacaaaaaaacaactctttgtctctattttccgcgtactctctcgtgggcgtggttttatatttatattgagggagaaaacggtgagggtcctcccccccctccggtggtgttgtctcacaaaaacatagctttgggggtcgggctagattcctactctgagatcatttgtgggtgggcgcggtaaataccctacgttaccattagcggtttctgggcgaatattatataagtctttactgttccggtggcgggttctttcttatgaaccacagttgtacacccctctatatgtgagggggtgggctcctcatatgggagaattgtgggaggagatttcttgtacaataagcctctcttgggggaactcattgggacaccaataaactatttttccccctcccctcgggccatggttgtatatacacccggtggtgtgttn

SEQ ID NO: 77477 - DNA, 862 bp, Zea mays
  misc_feature: Ceres CLONE 1562449
  misc_feature: Encodes the peptide sequence at SEQ ID NO. 77478
  misc_feature (356)..(356): n is a, c, t, g, unknown, or other
  misc_feature (391)..(391): n is a, c, t, g, unknown, or other
tggagctccccgcggtggcggccgctctagaactagtggatcccccgggctgcaggaattcgtctcacccctagaaaaaggttcctccattgctcctcgcgtgcgctccctctcccgtctgcccctccctctctctcgtggagacgactgggccgggggccgccgtcgttgctgccctacgcggctacacccacgtcttcttcgggcccttagccgcgacgagcaccaccagggagtagaagaggttaaccttctggttggaaacgatgtacttcgaaggctatggcttccgtggaagtactttcgagcagacatatcgctgctatcctgcgtctttcatcgacaagccacaactntgaggctggtgacaaatttaataatgccaccatcnagctcttgatcgtcttgcatctctgcatattgaataccctatgctatttgaagtccacaatgcagcagcagaacggacttcgcattgtggtgttctggagttcattgcagaagaaggcatgatctacatgccatattggatgatgcaaaatcttctgttgcaagagggagatatggtgttcataaaaaatgccaacctccccaagggcacatatgtgaagttgcagcctcatacaacagactttctagatatttcaaccccaaagcaatcttggagaaactttgcggaacttttcttgtctaactacaggtgacaagcattatgggttgcatataataacaggaagtactacattggatatagtagagacaaaaccctcaatgcttataagtatattggagaccggattggtgagggtgacttttgctcccaccactgaactacaaaggacctggagccggttaaacctgg

SEQ ID NO: 77478 - protein, 90 aa, Zea mays
  misc_feature: Ceres CLONE 1562449
  misc_feature (1)..(88): Pfam Name: UFD1 Pfam Description: Ubiquitin fusion degradation protein UFD1
MLFEVHNAAAERTSHCGVLEFIAEEGMIYMPYWMMQNLLLQEGDMVFIKNANLPKGTYVKLQPHTTDFLDISTPKQSWRNFAELFLSNYR

SEQ ID NO: 77479 - DNA, 866 bp, Zea mays
  misc_feature: Ceres CLONE 1562451
  misc_feature: Encodes the peptide sequence at SEQ ID NO. 77480
  misc_feature (354)..(354): n is a, c, t, g, unknown, or other
ctccccgcggtggcggccgctctagaactagtggatcccccgggctgcaggaattcgtctcacccctagaaaaaaacttgcgtagagagttgggcgcagagaatccccaagcaaacaaacagggtagagggagaggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtccggttccggctcttcangatggtgacttgtacctcttcgaatcccgagcaatctggccccaccctcctcgcaaaaacaatccagagctgtttacgggaaggaaaccttctggacgcagcaatggtggattgtttggatcccacgtggaggctaacccgtacaccgctgcacttgaccccctccctcttcccaggtcctcctccggtcccatgccttggggggaccctcccaccccctagttttttggttaaaaccctttcggaacctttaggaaggggcttagaggttttcccaagcaccccttaaccaattgcccgttcctttcttggagactttcctccgcctcccccaccttgaacccttgtttctttccctctccccccccttttgccttcccccttccccttttgttctccccccccttccccccttttaaggccctgtgggcttctgtcctttttgagagccctcttttccctaaggtcttttcccctctttaaacccctcttttttcaaacgttttcccctt

SEQ ID NO: 77480 - protein, 132 aa, Zea mays
  misc_feature: Ceres CLONE 1562451
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
  misc_feature (59)..(59): Xaa is any aa, unknown, or other
MAPMKLYGAVMSWNVTRCATALEEAGSDYEIVPINFATAEHKSPEHLVRNPFGPVPALXDGDLYLFESRAIWPHPPRKNNPELFTGRKPSGRSNGGLFGSHVEANPYTAALDPLPLPRSSSGPMPWGDPPTP

SEQ ID NO: 77481 - DNA, 951 bp, Zea mays
  misc_feature: Ceres CLONE 1562452
  misc_feature: Encodes the peptide sequence at SEQ ID NO. 77482
  misc_feature (254)..(254): n is a, c, t, g, unknown, or other
  misc_feature (256)..(256): n is a, c, t, g, unknown, or other
  misc_feature (335)..(335): n is a, c, t, g, unknown, or other
agctccccgcggtggcggccgctctagaactagtggatcccccgggctgcaggaattcgtctcacccctagaaaaaacccgctgccatcctcgcagtcgcagcccctcaccatggctgccacactctcctccgtggctgccccttccctccccaagcacgtctccgttaccagagctcagcagcaggcgcctccttccatcatctcggcatcaactaagactgccttccatggggtgtcgctggtggtggacangnaagttggccggccgccacccgaaaaggcaccgcccgcggaagcttcttcagggaaccccaagaccgccccaaaaaatcnaggtggaaggcgaaaaaccccttgggcttaccctgggcaaaaaacccgggggggggcggcgccaccacttctttggaatcccggagggaaaacaccccaaaaccggtttaaaaaaccgggaaaaaaagtccggtaaaaaaaaaacttctttaaaaaaaaaaaatttgggcctgcggaaaaaaatttgggtttcccacaaaaacccttccaaggaaaagggagaaccccccctttaatttttctttgaaaaagggggtggccccaaaatttaaattttaaaacccccccccctaaagagcgcggggccccccccccggtttttgaaaagaaaacccacccttatttcaaaaagagaaaaaaaaaacccacaccttccccctgtattttggggggaaaaaaaactcccccacacaaccttttttaaaaataaaccccagaaaaaaagggtgtgcccacaggaaaaccccccaaaaaaaaagtttttaaagaaaacaccccccccccggaaagaaatttgggggcccttccccctatacccccgaattataaaatttgggaaacgcccccccggggaaagaaattcctcgtaaagccccaataaaccgctctttctgtt

SEQ ID NO: 77482 - protein, 119 aa, Zea mays
  misc_feature: Ceres CLONE 1562452
  misc_feature (48)..(48): Xaa is any aa, unknown, or other
  misc_feature (49)..(49): Xaa is any aa, unknown, or other
  misc_feature (75)..(75): Xaa is any aa, unknown, or other
MAATLSSVAAPSLPKHVSVTRAQQQAPPSIISASTKTAFHGVSLVVDXXVGRPPPEKAPPAEASSGNPKTAPKNXGGRRKTPWAYPGQKTRGGAAPPLLWNPGGKTPQNRFKKPGKKVR

SEQ ID NO: 77483 - DNA, 953 bp, Zea mays
  misc_feature: Ceres CLONE 1562456
  misc_feature: Encodes the peptide sequence at SEQ ID NO. 77484
ggagctcaccgcggtggcggccgctctagaactagtggatcccccgggctgcaggaattcgtctcacccctagaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctggggcatgctgggcgcgctccgggtgcgtgttccccgagctgctcgcccggcacggcgtcaagttcggccgaggccctgtggttccaaggccggggcccagatcttcagccgaagggggggcttgaactacctcggcaaccccgagcctgatccacgccccagagcatccctggcccatctggggcgtgcccagggggtagcctcaatgggcggcccgtccaaggggtacccgcatccccggggggcccgcctcgggggaagtgggtcgaacccgcgtttaccccgggggggaggttttaaaccccttcggggctcccctaacaaccccggaaggcggttcccggaaccctcagggcaaggaaaataaaaaacgggcccgccccccccatgtttcccaaggttcggacttccttcggggagggccatcttccccgggaaaggggccccctttaaaaacccccccaaacacaccctggtgaaactggtaaaaaaaaag

SEQ ID NO: 77484 - protein, 219 aa, Zea mays
  misc_feature: Ceres CLONE 1562456
  misc_feature (58)..(165): Pfam Name: Chloroa_b-bind Pfam Description: Chlorophyll A-B binding protein
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWGMLGALRVRVPRAARPARRQVRPRPCGSKAGAQIFSRRGGLNYLGNPEPDPRPRASLAHLGRAQGVASMGGPSKGYPHPRGARLGGSGSNPRLPRGGGFKPLRGSPNNPGRRFPEPSGQGK

SEQ ID NO: 77485 - DNA, 790 bp, Zea mays
  misc_feature: Ceres CLONE 1562457
  misc_feature: Encodes the peptide sequence at SEQ ID NO. 77486
caccgcggtggcggccgctctagaactagtggatcccccgggctgcaggaattcgtctcacccctagaaaaaaccactcatcaccagctagtagctctagcaaagcacttgccatctaccgaccgccgcattccaaacagcccgacgagctagcagagcggcaggcacctcctccaggaacatggcccgcacgcagcagttggcagtagtggcgacagccgtggtggccttggtgctgctggcggcggcgacgtcggaggcggccatcagctgcgggcaggtggcgtcggccatcgcgccctgcatctcctacgcgcgcggccagggctcagggccctccgccggctgctgcagcggcgtcaggagcctcaacaacgccgcccgcaccaccgccgaccgccgcgccgcctgtaactgcctcaagaacgccgccgccggcgtcagcggcctcaacgccggtaacgccgccagcatcccctccaagtgcggcgtcagcatcccctacaccatcagcacctccaccgactgctccagggtgaactgaacccctaaacgacgacgaacggcgccggcggccgcctggaagacgatccatatcctatccccgccgtccgtcggcggcctgcgggttcgggaccgtcctgaaccatatcctaccttacggcatgatccccgaacttgcaatgttcttacaacctactaccgggaataaaaaaaaaccttctccgggggaaaggttggtcccttggggggcccgggggtggtggtggtgaaaaaaaaaaaaaaaaga

SEQ ID NO: 77486 - protein, 120 aa, Zea mays; identical to SEQ ID NO: 60188
  misc_feature: Ceres CLONE 1562457
  misc_feature (31)..(116): Pfam Name: Tryp_alpha_amyl Pfam Description: Protease inhibitor/seed storage/LTP family

SEQ ID NO: 77487 - DNA, 810 bp, Zea mays
  misc_feature: Ceres CLONE 1562458
  misc_feature: Translation starting site: 186
ctggagctccccgcggtggcggccgctctagaactagtggatcccccgggctgcaggaattcgtctcacccctagaaaaactgtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccttgccgtccgcagggcttgctatggtgttcttcgttatgttatggagagtggtgccaagggttgtgaggtgattggtgagtggaaagctcagggcccaaagagccaagtccatgaagttcaaggatggctacatgatctcatctggtcagccagtgaacgagtacattgactcggctgtgagacacgttcttctcagacagggtgttctcggtatcaaggtggaagatcatgcttgactgggacccggaaggcaagggttggcccgatcactcctctttccggacctg

SEQ ID NO: 77488 - DNA, 879 bp, Zea mays
  misc_feature: Ceres CLONE 1562459
  misc_feature: Encodes the peptide sequence at SEQ ID NO. 77489
  misc_feature (789)..(789): n is a, c, t, g, unknown, or other
  misc_feature (790)..(790): n is a, c, t, g, unknown, or other
  misc_feature (794)..(794): n is a, c, t, g, unknown, or other
ccccgcggtggcggccgctctagaactagtggatcccccgggctgcaggaattcgtctcacccctagaaaaaacgcgagtctccccatcttcttttcctcgcttgccctaattccgcatccccggctgaggcagcagcggcggcgccggcagcggcaccggctcaccagcgataccaggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgccagatgtttgctgggcgtgaaataactgttgtacttgctgcggatacacggaaaaggcctgaggacatgcgtagacgaactggaccaagaggttattctggtcatgaagggcgtcgtccgaatcgtcatggtgcaggacggtcccgttctcgttcatactcgcgttcccgctaccacgccctcgtggtcgtggtagatcacagtcatactcccctgccccgaaaggcgtgatgactactctgctttcccaccccggcaaaggaagaacacccgagtcatcaaacagcctaaagaaataacggnnatangaggagatcctatactcctgatgatataaatgatcgcgtggtgcaaaacatggtcgtgattgaaaggagaggtcccagcaggcag

SEQ ID NO: 77489 - protein, 177 aa, Zea mays
  misc_feature: Ceres CLONE 1562459
  misc_feature (40)..(111): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGRYSPAYSPPRRGHGGRGRSPPPRRGYGGGRGDHGSVSLLVRNIPLRCRPEELRVPFERFGPVRDVYLPRDYHTGEPRGFGFVEFVDAYDASEAQYHMNRQMFAGREITVVLAADTRKRPEDMRRRTGPRGYSGHEGRRPNRHGAGRSRSRSYSRSRYHALVVVVDHSHTPLPRKA

SEQ ID NO: 77490 - DNA, 750 bp, Zea mays
  misc_feature: Ceres CLONE 1562460
  misc_feature: Encodes the peptide sequence at SEQ ID NO. 77491
  misc_feature (638)..(638): n is a, c, t, g, unknown, or other
  misc_feature (639)..(639): n is a, c, t, g, unknown, or other
ctggagctcaccgcggtggcggccgctctagaactagtggatcccccgggctgcaggaattcgtctcacccctagaaaaaaaagcgccactactcacagacagtcacatacacatccaacgagcccgaccgccagagctcgccgccgtcctccgcagacaatccaccatggcgatggtgctgaggatggtgctggggaagatcccggtggagacgcccaagcacgaggtcctccacaccggcgccggctacgagatccgcaagtacccgcccagcatcgccgcggagttgacctacgatcccaaggagatgagaggagaccctgatggcgggttcaccgtcctcgccaactacatcggggtcctcggaaagccgcagaacaccaagcccgagaagatcgccatgacggctcccgtcatcaccaccggcagcggcagcggcggcgactgcgagaagatcgccatgacggcccccgtcatcaccaccgggcggcggcgagcccgagcccatcgcgatgaccggcgccggtgaattacggaccaaccagcaagcgccccgggaaaggtgaacaattgcaatttccgggctgccggtccaaaataaaccccgggggggggaaaggaagggcccccccccggnntccccaaaaaaaaaaaaaaaaaaaggggggggggggggggggttttttcccccgggggggcgccaaaaaaaaaaaaaaaaatttccccgggggggggggagatttacctcg

SEQ ID NO: 77491 - protein, 120 aa, Zea mays
  misc_feature: Ceres CLONE 1562460
  misc_feature (13)..(120): Pfam Name: SOUL Pfam Description: SOUL heme-binding protein
MAMVLRMVLGKIPVETPKHEVLHTGAGYEIRKYPPSIAAELTYDPKEMRGDPDGGFTVLANYIGVLGKPQNTKPEKIAMTAPVITTGSGSGGDCEKIAMTAPVITTGRRRARAHRDDRRR

SEQ ID NO: 77492 - DNA, 739 bp, Zea mays
  misc_feature: Ceres CLONE 1562461
  misc_feature: Translation starting site: 95
  misc_feature: Pfam Name: Cyclase Pfam Description: Putative cyclase
  misc_feature (331)..(331): n is a, c, t, g, unknown, or other
  misc_feature (538)..(538): n is a, c, t, g, unknown, or other
  misc_feature (605)..(605): n is a, c, t, g, unknown, or other
ctccccgcggtggcggccgctctagaatagtggatcccccgggctgcaggaattcgtctcacccctagaaaaaagtaaggcgcatatccattccatggatctcgcgcccctgctccttctctcccagctgctgctgcttccggtggtggcggttgtctccggcgagaccgccgcgcacccgggctacacacacgctgaggaggcatgcagcggtgtgctagaggcagaggcggagaaagcaacggtgctggtgcctgcgccagagcggcgcgaagagttcgacggggggcggatcgtggacatcagccactactaccgcgaggacatgccnggagtgggagtcatcagagggctccggcgagttcctgcagctggcgcggtccatgcgcaacggctccgacatcgctaacttctcggagctccggctcactgcgcactccggcacccacgtcgacgcgccgggacacgtcttcgagcactactacgacaccggcttcgacgtcgacaccctgcgacctcgctgtcctcaacggaccangcgctgttggttgacgttcccagagataagaacatcacagctgatgttatggcatccctaaacatgncctaaaggtggttcgacgtgtactcctttcggaccctaaatacagacagaaagcttatgtggaaagaaagatttgatacaagttatggtggcttcattggaagatgttgcaccaatggttgggttgataatacc

SEQ ID NO: 77493 - DNA, 844 bp, Zea mays
  misc_feature: Ceres CLONE 1562463
  misc_feature: Encodes the peptide sequence at SEQ ID NO. 77494
ggagctccccgcggtggcggccgctctagaactagtggatcccccgggctgcaggaattcgtctcacccctagaaaaaatcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgacccagatcatgttcgagaccttcaacacccccgctatgtacgtcgccatccaggccgtgctctctctgtatgccagtggccgtaccacaggtatcgtgctcgactcgggagatggtgtgagccacaccgtccccatctacgagggatacgccctcccccacgccatccttcgccttgatctggccggtcgcgacctcaccgactacctgatgaagatcctgactgagcgcggctactccttcacaccaccgctgagcggggaatcgtgagggacatgaaggagagctcgcctacatcgccctg

SEQ ID NO: 77494 - protein, 210 aa, Zea mays
  misc_feature: Ceres CLONE 1562463
  misc_feature (4)..(211): Pfam Name: Actin Pfam Description: Actin
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTPPLSGES

SEQ ID NO: 77495 - DNA, 766 bp, Zea mays
  misc_feature: Ceres CLONE 1562465
  misc_feature: Translation starting site: 370
  misc_feature (599)..(599): n is a, c, t, g, unknown, or other
  misc_feature (630)..(630): n is a, c, t, g, unknown, or other
ctccccgcggtggcggccgctctagaactagtggatcccccgggctgcaggaattcgtctcacccctagaaaaactcgccgctccgggctgaccaagggctcgccgcctcccgtgtcctccgactccgacagggaaaggcgaaaccttgggtcggctcgctagtggagtgcagggtacgttgatgacggagctgtggatggaggtgctgccgccgccctacttcgcggggcaggcggcgggcgggtggttcctgccggaccggcgggccgggcccggggcgtggacgctggaggagaacaagatgttcgagcgcgcgctggcgagggtcgactgggacgcgccggaaccggtgggagcgggtggccgcgatgctgcccgggaggacggcgtccgacgtcgcggcccactacgacgacctggagtgcgatgtcggctgcatcgaggcgggcttcgtgcccttcccctgctacggtagcggcggcggcggcggcgcgtcgcaatccgccgggttcacgttcgactgggacgccggcgggctgggctttaagcgctcctgctacgtggtcggcggcggcaagcgcgagcgcgggccggaccnagagcgcaagaagggcgtcccctggacggangaagagcacaagcagttcttgatggggcctgaagaaatacgggcgaggggactggagggacatctcgcgcaacttcgtgacgagcccgacgcccgaccgcaggtgccagccccgccgcagaaattacttcatcccg

SEQ ID NO: 77496 - DNA, 778 bp, Zea mays
  misc_feature: Ceres CLONE 1562467
  misc_feature: Translation starting site: 267
  misc_feature: SWISSPROT Homolog: EC 1.14.13.68 4-hydroxyphenylacetaldehyde oxime monooxygenase
  misc_feature (591)..(591): n is a, c, t, g, unknown, or other
  misc_feature (592)..(592): n is a, c, t, g, unknown, or other
  misc_feature (736)..(736): n is a, c, t, g, unknown, or other
ggagctccccgcggtggcggccgctctagaactagtggatcccccgggctgcaggaattcgtctcacccctagaaaaaaaagtttttgtccattccgttccgtaggatcccacgagtcgactctgtctgaaaccggtagttggactagctgctggagtgtggaggaagacttggggaggctgccttcatatagcggctagttggagcccaacgctcgccattgcaagccttcccggttacttgttcactagcaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagactcacatctcgatccgggacctggacgccaagcacgggcgcaacggcctgctgctcctccgcatcggcgccgtgcccaccctgttcgtgnntctcgccagcgccgccgacgccgtcctgcgcacccaggacacatcttcgcgtcgcggccgcccgtcatggctgccgagatcatccgctacgggccctcgggacgtcgcgtttcgtgccctacgggcgagtactggcggcagggncagaaaactcttcaacaccgcacttgctcagcaacaagaaag

SEQ ID NO: 77497 - DNA, 847 bp, Zea mays
  misc_feature: Ceres CLONE 1562468
  misc_feature: Encodes the peptide sequence at SEQ ID NO. 77498
  misc_feature (738)..(738): n is a, c, t, g, unknown, or other
  misc_feature (748)..(748): n is a, c, t, g, unknown, or other
  misc_feature (765)..(765): n is a, c, t, g, unknown, or other
  misc_feature (847)..(847): n is a, c, t, g, unknown, or other
gcggtggcggccgctctagaactagtggatcccccgggctgcaggaattcgtctcacccctagaaaaagttgttgctgctgctaggtgctagctcccgagtcacggccgccttccactcccacagaattcagctagctttcttactcccgccgtcgcccccgatccgagagcgagcatggcgcactctctcgccgcttccttctcgccagccgccgcccggcgccaggtcacaaatgtgattccaagctggacctcggtttccttccagagccacaggatgacttctgtatccatccgctcaagacaaaggtctcttgggtttaagatttgctgttcggctaagaaagagacagtggacaaggtttgcagtatagtgaaggagcagctggctcttcccgatgggaccgccatcactgccgaatcaaaattcgctgaacttggcgctgattcgctggatacggtcgagattgtgatgggcctcgaggaggcgttcaacataacagtcgacgaaacaagcgcacaggacatcgcaacagtgcaggacgctgcggaccttatcgagaagctcatgctggaggcacctccaaaggtcgtctagatccaacaaccttgcgatcgacgaccttgtgtttgatctatgttgtgtggtaatttgttcgtgttgccccatttgttctttcttgatgatcaagatgaggttttgtattggtgttgctgaggtgaattagatagccccnaaggcacatngagcagatgaggacagntcatcccacttggattttgtatgttgtaacttgtagtgctgctatagagaaaccaatggactggttatgagagtccatgcan

SEQ ID NO: 77498 - protein, 140 aa, Zea mays; identical to SEQ ID NO: 77279
  misc_feature: Ceres CLONE 1562468
  misc_feature (61)..(128): Pfam Name: PP-binding Pfam Description: Phosphopantetheine attachment site

SEQ ID NO: 77499 - DNA, 801 bp, Zea mays
  misc_feature: Ceres CLONE 1562469
  misc_feature: Encodes the peptide sequence at SEQ ID NO. 77500
  misc_feature (729)..(729): n is a, c, t, g, unknown, or other
  misc_feature (733)..(733): n is a, c, t, g, unknown, or other
ggagctcaccgcggtggcggccgctctagaactagtggatcccccgggctgcaggaattcgtctcacccctagaaaaaaccacagtatcagagtagcagcatctttgaggacgccactccggaggaagtgagggacttcttcggggacgacgagttccgtgtgtccaacaagtgggacgacatgcttgtttaccataagacgctggaggagtgccagaccaccgggacgatgaaagtgcattgggtccggaagttccccttcttctgcagtgacagagagtacataattgctcgccggatatggaaactggggggcgcctattattgtgtcacaaagggtataccatgctcgtccattccacggcgcaacaaacctcgaagagttgatctgtattattcaagctggtgcatccgtgcagtggaatccaggagagggaacggagggtcgacagcttgtgaggtgctcttgttccaccacgaggacatgggcatccccgtacgagatcgcaaagctcggtatccggcaagggatgtggggatgcgtgaagagaatcgagcctgggctccgggcctatcagcaagccagggctgcagggggagcccggtgtcacgagtgccctgatggcccagatcaacaccaaagtcggcgacagcttttgtccgggtcgctggagtccgacagcgacgggtcccgaaacgtgggaagcgggaagagagcctgcggagaanccgntgtggcgaaggttccttgtgctttgggagggagcagttgctctgggcctgtactcttgaacaaaggcc

SEQ ID NO: 77500 - protein, 146 aa, Zea mays
  misc_feature: Ceres CLONE 1562469
MLVYHKTLEECQTTGTMKVHWVRKFPFFCSDREYIIARRIWKLGGAYYCVTKGIPCSSIPRRNKPRRVDLYYSSWCIRAVESRRGNGGSTACEVLLFHHEDMGIPVRDRKARYPARDVGMREENRAWAPGLSASQGCRGSPVSRVP

SEQ ID NO: 77501 - DNA, 832 bp, Zea mays
  misc_feature: Ceres CLONE 1562471
  misc_feature: Encodes the peptide sequence at SEQ ID NO. 77502
  misc_feature (802)..(802): n is a, c, t, g, unknown, or other
ctccccgcggtggcggccgctctagaactagtggatcccccgggctgcaggaattcgtctcacccctagaaaaagacgggacgacccgacgcctacctcccccgcgctccgctttattagcaaaagatcccagcagcagagcacaagctgccttgcgcttcggtgatcacgaggacaccaccaagacgacgcaggttcactggttcagcgaccggtttccgcgatgtgccgcgccacggcgatagagggcggcttcctccgcccgcccccgtcccggcgcctcgacatccgcgctttctacctccgcctctcctcctgctccgccacgacgctcgcggagctcacgctggcctaccacccggccatcgggggcgcggcgctgggactcaacggccgcgcgctcccgccagccgcgcccgccaaggtcacgctccgccgggtcgccgccgacgcgtacgcgagcgccgaccgcgtcgccgccgccgagggcgcgcggttcgaggtgctcgccgccgccgcccggggaggaggtcgcggcggagggcgtcttctccgcgcggcgcgagggggggtgggcgcgtggagtgccgccgggcgccggcctcgccggaggtgtgcgtcgcggaaggtggtggtgctcgcggagggcggcgtgctgatgcgggacagggcccgcgcggccggccggggccggatgcggtgcggatgcacccggctgggagggataccggaaggaagacgccaccacgggccttcggcggctggtgccgctgcgagtgcgacacaacgggggggaggggtncgggggaccgtaaagaaagaggaaggacct

SEQ ID NO: 77502 - protein, 203 aa, Zea mays
  misc_feature: Ceres CLONE 1562471
MCRATAIEGGFLRPPPSRRLDIRAFYLRLSSCSATTLAELTLAYHPAIGGAALGLNGRALPPAAPAKVTLRRVAADAYASADRVAAAEGARFEVLAAAARGGGRGGGRLLRAARGGVGAWSAAGRRPRRRCASRKVVVLAEGGVLMRDRARAAGRGRMRCGCTRLGGIPEGRRHHGPSAAGAAASATQRGGGVRGTVKKEEGP

SEQ ID NO: 77503 - DNA, 904 bp, Zea mays
  misc_feature: Ceres CLONE 1562473
  misc_feature: Encodes the peptide sequence at SEQ ID NO. 77504
ccgcggtggcggccgctctagaactagtggatcccccgggctgcaggaattcgtctcacccctagaaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcccacctggtgcactgccggtgggcgatgctcggcgcggcgggcatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgctgggctgacatcatcaagcccggaaagcgtcacaccgaccccatcttccccagcaacaagctcaccggccccgacgtcggggaccctgggggcctctgggttggacccccctcggctgggggaagcggctccgccggaaaagaacaagggacctgccccgccaggaatgatcagaaacggaccccctccccctgcttccccgtcatggggcgccctgggttccaggcccgaataaaaccggggcccggggccccattgaaaaaacctctttttgccacaccctcgcggaaaccttgggccccgcccccaatctttccagggcgt

SEQ ID NO: 77504 - protein, 266 aa, Zea mays
  misc_feature: Ceres CLONE 1562473
  misc_feature (63)..(207): Pfam Name: Chloroa_b-bind Pfam Description: Chlorophyll A-B binding protein
MALVSASSSSTTAVTALPRNGQRASSSFLGGKTLLRQAEAARPSFAVRAAADPNRPIWFPGSTPPPWLDGSLPGDFGFDPWGLGSDPESLRWNVQAHLVHCRWAMLGAAGIFIPEFLTKIGVLNTPFWYTAGEQQYFTDTTTLFIIELILIGWAEGRRWADIIKPGKRHTDPIFPSNKLTGPDVGDPGGLWVGPPSAGGSGSAGKEQGTCPARNDQKRTPSPCFPVMGRPGFQARIKPGPGAPLKKPLFATPSRKPWAPPPIFPGR

SEQ ID NO: 77505 - DNA, 824 bp, Zea mays
  misc_feature: Ceres CLONE 1562474
  misc_feature: Encodes the peptide sequence at SEQ ID NO. 77506
tccccgcggtggcggccgctctagaactagtggatcccccgggctgcaggaattcgtctcacccctagaaaaaatcccctcctcccttatctcccgcgctctgctcctcccagtcccagactcccatcctcgcctccgccatggccgccgtcggcatcccctcccctccggcgccacactgtcttcgcgcccgccgcatctccttcctcctccacgtactccacactgggcccccgccgtctccgcctctccacccgactcggactcgccgccgcggcggcgtcgtgccgtacgcggtgcgctgccgctgccgatggcggggccgcggcttcggaaggtgcctctgcggtggcggagctggagggggaacccgacgctggcacagacgttgccggaagcgccgcgaccttcacgctggcgccctactcgctcatctccgcggacaacgtgcagaaagcgatgcgcggccctcgcattacagatgctgaccactatggaaagcttggagtcaccaagctagcttccactgatgaggaaaaacctgcgtaccaaaagaatggtgaaaaaactaaatgcccaaaaacctggaaaagagggagctttaccaggaaaatggaccccccaaaagaaaccttttacctaaccatcccccggaggaagaaaccaaaaattttttgatttggaacttggtcaaaaaaatggaaaacccctgaaccaaaaatgccggggcccatttgaaaagtgaaacccctggggaagttgggccccaaatccccccaaagggaccccgaaaaaaagatttccccaaaacaaaagtggtttgg

SEQ ID NO: 77506 - protein, 72 aa, Zea mays
  misc_feature: Ceres CLONE 1562474
MRGPRITDADHYGKLGVTKLASTDEEKPAYQKNGEKTKCPKTWKRGSFTRKMDPPKETFYLTIPRRKKPKIF

SEQ ID NO: 77507 - DNA, 927 bp, Zea mays
  misc_feature: Ceres CLONE 1562477
  misc_feature: Encodes the peptide sequence at SEQ ID NO. 77508
tccccgcggtggcggccgctctagaactagtggatcccccgggctgcaggaattcgtctcacccctagaatatccttcccttcctattccctctctctctctctctctctctctctctcttgctcgctcattctgcgggcgcgcacaccagggaagaaggcccggtatgccgactcctactccccgctccctcccctgccgccgggaccgacgccgctgccggtgctgggcccgctgctcttcattgcgagcagcgacttcgacatagagcccgtcctccgccgcatcgcgcgggaccacggctaggtcttcaggttcgcgccgctggggagggcgcacccgggcatcttcatgggcgaacgcggcgcggggcaccgctcgctcgtggaacacagcgccacgttcgcctcccgcccgacctccacggccgtcagggccgtgctgaccagcgggggccgcaacgtcagctcctccccctaccgcgccacatggcggggcgctgcccggaccctctcctcccgggggctcaacccggggcggggtccgggcttttcccccgcgcgccggtgggtgatccggggtaccaaccaaagaatccgcgccgaaggacgccacggggaggctcccctccccgtatgggaaccgttcccgtaggccagattctgttttccccgtccccaatttgcgtccgagggggacccccctggggaaaaacgcacccttccggggaaaacaagggcccccaaggggaactccctgggcagcttcctccggttgcaagggctttcccctcccccccgcgggggaaacaaaccccagggtcccgccaagctctggaaaaggaccctctccccgtggagggttccgcaagaaaaaacttctccttcccgcctttataaaggcccaaacaggaagggcggcgcgggg

SEQ ID NO: 77508 - protein, 100 aa, Zea mays
  misc_feature: Ceres CLONE 1562477
MGERGAGHRSLVEHSATFASRPTSTAVRAVLTSGGRNVSSSPYRATWRGAARTLSSRGLNPGRGPGFSPARRWVIRGTNQRIRAEGRHGEAPLPVWEPFP

SEQ ID NO: 77509 - DNA, 843 bp, Zea mays
  misc_feature: Ceres CLONE 1562478
  misc_feature: SWISSPROT Homolog: EC 2.7.2.4 Aspartate kinase
gcggtggcggccgctctagaactagtggatcccccgggctgcaggaattcgtctcacccctagaaaaaagtaaaagctcggcagtatgatgcatttgatcttggctttataactaccgatgatttcacaaatgcggatattctggaagcaacttatcctgctgttgcaaggaggctacatgtggaatggattaatgatcctgctatacctatagtcactggctttcttggcaagggatggagatctggtgcaataactaccttgggcaggggtggaagcgacttgacagctacaaccattggcaaagccttgggattaagagaaattcaggtttggaaagatgttgatggtgttttaacatgtgacccaaatatccatcctaaggcaaaacctgtgccatacttgacatttgatgaggcagctgaacttgcctattttggagcgcaggttttgcatccacaatcaatgcggccagctagagaaggcgatgtacctgtgagggttaagaattcttataaccgtcgagcccctggtacccttatcactaaagcaagagatatgagtaagactgttttgactagcattgttttgaaatcaaatattacaatgcttgatatagtcagcacacgcatgcttggccagtacggttttctagctaagggtttttcgatatttgaagacttgggcatctctgttgattgtgtggctaccagtgaagtcagcatatctttaacactggattcgtcgaaactatggagttgtgaatttgttcagcccaaaaaagaactggatgatgtcatttaagagcttgagaagaaaacagttgttcatcttctgcaaaac

SEQ ID NO: 77510 - DNA, 807 bp, Zea mays
  misc_feature: Ceres CLONE 1562480
  misc_feature: Encodes the peptide sequence at SEQ ID NO. 77511
aaagctggagctccccgcggtggcggccgcttccgaactagtggatcccccgggctgcttgacattcgtctcacccctagaaaaacaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaaccccaacctggtgcacgcgcagagcatcctggccgtgctcggcttccaggtcatcctcatgggccctcgtcgaggggctccgcatcaacgggcctcgaagggggtccggcgagggcaacaaacctctacccccggcggccaagtacttcgaacccggttggggccttcgccgacgtaccc

SEQ ID NO: 77511 - protein, 213 aa, Zea mays
  misc_feature: Ceres CLONE 1562480
  misc_feature (69)..(210): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGPRRGAPHQRASKGVRRGQQTSTPGGQVLRTRLGPSPTY

SEQ ID NO: 77512 - DNA, 730 bp, Zea mays
  misc_feature: Ceres CLONE 1562481
  misc_feature (292)..(292): n is a, c, t, g, unknown, or other
  misc_feature (304)..(304): n is a, c, t, g, unknown, or other
  misc_feature (305)..(305): n is a, c, t, g, unknown, or other
ctccccgcggtggcggccgctctagaactagtggatcccccgggctgcaggaattcgtctcacccctagaaaaagttgttgctgctgctaggtgctagctcccgagtcacggccgccttccactcccacagaattcagctagctttcttactcccgccgtcgcccccgatccgagagcgagcatggcgcactctctcgccgcttccttctcgccagccgccgcccggcgccaggtcacaaatgtgattccaagctggacctcggtttccttccagagccacaggatgacttnctgtatcccatnnccgctcagacaaggtctcttgggttttagatttgctgttcggctaagaaaagagacagtgggacaaggtttgcattataatgaaaggagcaactggctccttcccgaaggggaaccgccttcctgcccaaatcaaaattcgctgaaacttggcccccgatttccctggggaaacggcccaaaattgggagggggcccccaagggaggggttttcaaaaaaaaaagttcgaaaaaaaaaaagcggccccggggagaatttcccaacacagtggagggggacccctctgggaaccctttttttgagaaaaagtcccctttgtggggggggggggcccccccccccaaaagaggggggtgttttataaaataaaaacaaaaaaacccttttgtggggataaaaaaaaaaaaaacaacttttgggtgtt

SEQ ID NO: 77513 - DNA, 884 bp, Zea mays
  misc_feature: Ceres CLONE 1562483
  misc_feature: Encodes the peptide sequence at SEQ ID NO. 77514
ctccccgcggtggcggccgctctagaactagtggatcccccgggctgcaggaattcgtctcacccctagaaaaactttcctagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccatccaggtcgtcgtcgacgcgatcatcaacagtggaccccgtgaggatgccacccgtattggttccgctggtgttgtgaggaggcaggccgtggatatctcacccctgaggagggtgaaccaggccatctacctcctcaccactggtgccagggagagtgctttccggaacatcaaaaccattgccgagtgccttgcagatgagctgatcaacgctgccaagggctcatccaacagttacgccatcaagaagaaaggacgaggatgagcgtgttgccaaggccaaccgttgaactgagcttgtatcctggtgcactctgcgctggaaaactttatgtcgctggcagtcgtatcggttcttgttttaccatgtttagagtttttgagacctaatgcgggtttggttttca

SEQ ID NO: 77514 - protein, 191 aa, Zea mays
  misc_feature: Ceres CLONE 1562483
  misc_feature (44)..(190): Pfam Name: Ribosomal_S7 Pfam Description: Ribosomal protein S7p/S5e
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGVVRRQAVDISPLRRVNQAIYLLTTGARESAFRNIKTIAECLADELINAAKGSSNSYAIKKKGRG

SEQ ID NO: 77515 - DNA, 827 bp, Zea mays
  misc_feature: Ceres CLONE 1562485
  misc_feature: Encodes the peptide sequence at SEQ ID NO. 77516
  misc_feature (558)..(558): n is a, c, t, g, unknown, or other
gagctccccgcggtggcggccgctctagaactagtggatcccccgggctgcaggaattcgtctcacccctagaaaaaccgtccggatagtgccaggactgccagcccgatctcgcgtcgaacgatgtgaaagaactcctttcttctacgcggacggattcctctcgtctcgatcagctcgcttcgtgacttctctctcctctcgatcgattgcttcctccaccgaggcgggggaaagcgccgcccagatcgccgtaggcaagcggcgatcactccagctctgagcataagtttctgcagggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcgcttcgtgatcgatagagaagagtgcttctcgcataacgtggagtatgagggggatactgtccatgtatccttcgtcgtcatcaaggctgacaccccgtggcatacagcgaagaaggcggtgatcnttgtggtaaagatcctatggcgctcaagtcccgtgaatctcgaggataaactagggaataagtttgagtttctaggtccaaaaaaaaagggggcccatcgcctcctgcttcccgaaataaaatcccccgtccccgaaaacttttaaaatttccgagggggggagggtggggcctttttttttaaaattttgaggcaggggtgggccaaaaagaaaaactttttttgacccacttttttttgggagaaaaaaaccccccgtttttggaaa

SEQ ID NO: 77516 - protein, 117 aa, Zea mays
  misc_feature: Ceres CLONE 1562485
  misc_feature (70)..(70): Xaa is any aa, unknown, or other
MEWLSWRTVCCLSVLCTVLFLRPVEGIRFVIDREECFSHNVEYEGDTVHVSFVVIKADTPWHTAKKAVIXVVKILWRSSPVNLEDKLGNKFEFLGPKKKGAHRLLLPEIKSPVPENF

SEQ ID NO: 77517 - DNA, 859 bp, Zea mays
  misc_feature: Ceres CLONE 1562486
  misc_feature (770)..(770): n is a, c, t, g, unknown, or other
ctccccgcggtggcggccgctctagaactagtggatcccccgggctgcaggaattcgtctcacccctagaaaaaaagtgcagaccattgttggacgcgttcccctcctggcgtccgcctgctctcgtcgtcccgatccgggatggccttctcttcttgagacgttggttccccgagtgctctgggtgagctagtgtgattgcgattttcgcggactacgactgcttcttgttgtgcaggctgcgtgtttgattgctagtatctcggtcagccactgttggatgcttgttcggctttctcctcgcctgcttcggtctcgttgccttgttctggtggtcgagcatcttctgctctgcttctggatccgtatatgagaaagtcgccaaggccccgatctgggactccgacgggatctaaagagacgatcgtatggaggacggcgggatctctcggactgctccgtgctccggctctgtggatgatgtctctgcacgtgacattcttgaatctgtttcgatggatgatggagcttatgtaacacatggaccctgacataggcaaggtgctctgcagcatgtaggaggaactgcaccgatgtgaggtcgtacacgacgaggactttgccgtgatgggtgacctcccatagcacgtcttgctgtagacatcagatcattattgcgtgcagggtggaggaatccctcggcggggttgatgcttgtggaccccggttctcctcgctcatattgctctcgtagttcgtgtatgagtcgnttgcgcttctgatgggtcgtatcatcaaacgtgatttttaagtccaaacatggacatcgtcaacaatacgtgcagctgccaccctatcc

SEQ ID NO: 77518 - DNA, 944 bp, Zea mays
  misc_feature: Ceres CLONE 1562487
tggagctcaccgcggtggcggccgctctagaactagtggatcccccgggctgcaggaattcgtctcacccctagaaaaaaaatgacagggaaaaaaaaccaatcatctcactatctcagcgccgagctcgagcccgcagcctgccatcccctttggcaaccaaatccggcttgcctgcagcggatctccatctggtcggagtggatcgggtctccggtggtgtttctcgcctccgtggcggttagtggcggcggacggaccacgtccccgcagcagcggtcagcggcggctggcctagctgcggtggcttgaggcggctctcggacgggtgcctcgagctggcaccagcgggtgggtgccgcaagtctcaccgctagctggtgtagaggcggcgagtcccggcgccatggagggtaggccgcaagtgtccgcttagagaggggtcaacaaagggacttgtcaagctacgacactgcggtcttcggttgccctgctcagcttgttgttgccgtacatgatccttcatgatttgtgagagatctatattccccgaatcttcaccggctctgccagatcactggcgatcttcttgccagccgcctccgctaacctgcgcggcacagtagagctcaggaaaagcggtggggactgagggagaaaaagaggagatgactagcctgtcgatcacagtgatgacgctgaactgtgatgtaggcgagcaccccaaccgagagtcccaacatcctgggaagaaacgccggggaaatcctgcgttcagcggtcattcaccaggcttactctccttaccattccttttgcacccaaaaaagcgtttaagaatgggaaacgtgaactatcctatcaacacaggtttgtgccaaggtttatagtaacacgtttgggtaacatccagaaacaaagggcccacaaggaagacaccacgg

SEQ ID NO: 77519 - DNA, 1125 bp, Zea mays
  misc_feature: Ceres CLONE 1562492
  misc_feature: Encodes the peptide sequence at SEQ ID NO. 77520
  misc_feature (61)..(61): n is a, c, t, g, unknown, or other
  misc_feature (269)..(269): n is a, c, t, g, unknown, or other
  misc_feature (286)..(286): n is a, c, t, g, unknown, or other
  misc_feature (420)..(420): n is a, c, t, g, unknown, or other
  misc_feature (1049)..(1049): n is a, c, t, g, unknown, or other
ttattatgcggaaaataaattgttaattataggggcgctgtgttttctggctgttggtatnttttttttttttttttaaaactggaactcaccacggtggcggccgctctagaactagtggatcccccgggctgcaggaattcgtctcacccctagaaaaagccgtagacagagcagtgacggtcgtcgtacacagatcacgatgctgctcccacactcttcgtcagcctctgcaactgctaccactcgtgggctagcactagcagcancagcaccgccgccgcgnccgaccgctcgcccccggcgcgcacgcctcctgcctccacgcgcgcgggccgagactcatgcgacgggcgttggcgccgaccgcgcggccaagacgcttctccagagcgggctgcgccgtgagtctctgccgcngcacttcgcggtggtgatggacgggaactcacggtgggcgctccagcgggggctgtaacccccagacggtcacaaggccgggggccgcaacctggaagcgggtcgttgcgctgttgccgcgcctgggggcatccgcggcgctaagcgcccttcggtctgcgtcccgcagagaaacttgcagccggccccccagggcccgagggtacgactacaatgaatgagggctttgtcccgaaattgggcctgaataagggcggaataaacaattctgacaaaagttttcttccgaaaggtcaagtggatggaatcccaggaacctggccaggggttggaatatcagtggcgaaaccgaccctcgcctcgaaagagaaaggagcacgaggtcacctttcttcctttgccgcggaagagcggtcaagaacgggacagttccgggggccccggaaacagagggtgcccacaccaaggggccataaaataacctccaccaaagccttgggcacacattgaatatgcctgggcgcccaattcctggtcatatcaagtccggcgggcgcaaatgagggaaacatggttttcctcgagcgcagtttgtcccgggaagaacctaggcccccggggaaaggccncctaaggcctaaaaaccgagtcattcaggttcccttatacgaaaaattcgtaacaaagttccaatattatgttccg

SEQ ID NO: 77520 - protein, 91 aa, Zea mays
  misc_feature: Ceres CLONE 1562492
  misc_feature: SWISSPROT Homolog: EC 2.5.1.31 Di-trans,poly-cis-decaprenylcistransferase
  misc_feature (23)..(23): Xaa is any aa, unknown, or other
  misc_feature (73)..(73): Xaa is any aa, unknown, or other
MLLPHSSSASATATTRGLALAAXAPPPRPTARPRRARLLPPRARAETHATGVGADRAAKTLLQSGLRRESLPXHFAVVMDGNSRWALQRGL

SEQ ID NO: 77521 - DNA, 872 bp, Zea mays
  misc_feature: Ceres CLONE 1562493
  misc_feature: Encodes the peptide sequence at SEQ ID NO. 77522
  misc_feature (676)..(676): n is a, c, t, g, unknown, or other
  misc_feature (681)..(681): n is a, c, t, g, unknown, or other
ctccccgcggtggcggccgctctagaactagtggatcccccgggctgcaggaattcgtctcacccctagaaaaaatatttgttaagtttcaggcagagagaaagatagaggagcaaacagcaactccagaagatgagtctccctcgccgccgccaccttgtcctgctcgcctgcctcctggtcttcctcgtcttcgccgcgtccgcgtcgacgagttccgccgaggtggccccgagcgtggcggtggacttcgtgcggcggtcgtgccggtcgacggagtacccgcgcgtgtgcgagagcacgctggtcccctgcgcggctggcgtggggcgcagcccgcgcctgctggcgcgagcggcgctgggtggttggcgccgaccgcgcgcgcaactgctcctcctacatccgcggcggcggcggcggcgcgatgaaggactgcgcggagctggcgcgcgacgcggaggagcggctgcggcagtccgcggcagagatggagcggatgggccgtgccggcacaccgcgcttcgcttggtccctcagcaacgtccagacctgggccagcgccgcgctcaccgacacctccacctgcctcgactccctcgcccagcagtcccgcggtggcaaggacagcgactaaccgcaggaaaaaaaaaaagggggggggggggggggggtntttgnaagagggccaaaaaaaaaacgcgcttggggctgggttcaacggggttccaagccgggcgcccgcaccccggcgggggtcctccttgttgaatccttgttagccagcaggctatcccccgggaaaatcctttggatggggtccccccggtcctccattccatggtccgaacattcttcccgtcccccctggt

SEQ ID NO: 77522 - protein, 69 aa, Zea mays
  misc_feature: Ceres CLONE 1562493
  misc_feature: SWISSPROT Homolog: EC 3.1.1.11 Pectinesterase
MKDCAELARDAEERLRQSAAEMERMGRAGTPRFAWSLSNVQTWASAALTDTSTCLDSLAQQSRGGKDSD

SEQ ID NO: 77523 - DNA, 1333 bp, Zea mays
  misc_feature: Ceres CLONE 1562497
  misc_feature: Encodes the peptide sequence at SEQ ID NO. 77524
  misc_feature (964)..(964): n is a, c, t, g, unknown, or other
  misc_feature (1153)..(1153): n is a, c, t, g, unknown, or other
agtgtgtgcccttttggttgtttttttgttgggggggctcctgcgttttctatttttattcctttaattactggagctccccgcggtggcggccgctctagaactagtggatcccccgggctgcaggaattcgtctcacccctagaaaaaacctagctcccccgcgccaagaacacgccagctagcaagcgcgctcgatcgaataccgttaccgtgtcgccatggccgccaccgcgtctctatcagccgtcggggcgccgctgtcggtgcccgggctcaagaagccgctcggcgtgtcgtcgctccggcccctgcagccgagggcggcgaggatgactacgacggccgtgcgggcgtcggcgtcgccctcgtccacgtccatcaaggagaaggctgcggccgggctgaccgcggcggccctggcggccgcgctggtgcagccggacttcgcggaggccgcgcagtccccccgcctcacgccgttcgctcaagaacttcctcctcagcatcgttgtccggcggggtccatgactcgttggtgattgtcagcaccaattgtcggacgtctccagaccttcgacccccgtcataagagggcctgtaatcggcaattctatgcgctatccgaatcagtccctggccctggaggtcccctgctccctgttccccttgttgacttttttatgtaacccggcccggggttggggtgtgctttattttcccccccagtgtgtgggtgcttcgaatccacacatatttgtgggaagaatacattggttctctcggcaatccaccgtatgtgatgcctttattctgtgtcgctccatgtgcgcacacaatgtgtgcttaacttccgcccccccagtatattatggcaacaaaactctttctggggtaccctcgggtgaactaaaaatatatgagcgcgagttgcgacctggggggtgtttcgctgtgtagacgncatacagaaacccacctgcttgatccttgattggcatctcacgagaggtctagaggctcgctcgatgcgtacaagcctatgctccataacgtactctttattttgttcaatatatcccaatgtatcgggtgccgctctccccctcttttatgcccacgcctctctttttctgcgcctcacacatatatnttattattttctccgtgcgcttctttatggcgcggcggcatatctatcatgtttctcatgtatcggtgtgtccttgcgtacactcactcgtaagtggagctgggtagtgcttccgcatcgacacactgtcaatttatggatgacaggtgacatttcacgcatgtccgaagaggggagggt

SEQ ID NO: 77524 - protein, 106 aa, Zea mays
  misc_feature: Ceres CLONE 1562497
MAATASLSAVGAPLSVPGLKKPLGVSSLRPLQPRAARMTTTAVRASASPSSTSIKEKAAAGLTAAALAAALVQPDFAEAAQSPRLTPFAQELPPQHRCPAGSMTRW

SEQ ID NO: 77525 - DNA, 869 bp, Zea mays
  misc_feature: Ceres CLONE 1562499
  misc_feature (277)..(277): n is a, c, t, g, unknown, or other
  misc_feature (321)..(321): n is a, c, t, g, unknown, or other
  misc_feature (324)..(324): n is a, c, t, g, unknown, or other
  misc_feature (325)..(325): n is a, c, t, g, unknown, or other
  misc_feature (339)..(339): n is a, c, t, g, unknown, or other
  misc_feature (342)..(342): n is a, c, t, g, unknown, or other
  misc_feature (397)..(397): n is a, c, t, g, unknown, or other
  misc_feature (401)..(401): n is a, c, t, g, unknown, or other
  misc_feature (840)..(840): n is a, c, t, g, unknown, or other
ggagctccccgcggtggcggccgctctagaactagtggatcccccgggctgcaggaattcgtctcacccctagaacctagaaaaactgtctgtatacctgtcactcacgctaccgccgtgaccgatcgttcgttccttccttctcttctccctcccaattcgcgggccgcgcgcctattttatttactactgtattcgtatcattatactgtttggtttccatccctggcagatctcccactctctcgtcagatcctctcggctagctagctagctnaggacagaggaagggaggggaaggcgctggctatggcgactgcngcnngcgcggcggcggcngcngccatggaggagccggacgtcgtcaacggccgcgacgtggtgagctgggtggcgntccngcgtgggtgctgtggtcgaccgccttcttgctggtgcggggcgctgttccccaaagcgcttctacgacttctgcaaacggcgccgtctccaccatggaacgccgttccccccccctggggctcgcctgcctctccgtcgaacaaatgggtcggtgcccccttttggcccgcttgcccggcgcaatcttccctcccccaaaaaaaaagggcccgggggggtttaccccggcggaaaaaggttgtaaaaaaaacgggggtgttgtcccccttaaagggggaaaacccggttgggaaaaaaccctggggaaccacctgggttaaaaaattttggggaataagggggcgggggttcgccctaaccaaaaatgtccgggaaaaaaaaaaaaggggggccacaattctttctttataaagaaaaataccaaacccccctgtttgnaccttggggggggaaaattcaataaagaa

SEQ ID NO: 77526 - DNA, 697 bp, Zea mays
  misc_feature: Ceres CLONE 1562500
  misc_feature: Encodes the peptide sequence at SEQ ID NO. 77527
agctccccgcggtggcggccgctctagaactagtggatcccccgggctgcaggaattcgtctcacccctagaaaaaatctcccacctcgatccctgcactgcaagcaacaaagttctactctgtccatctagctcccaagaaaccaatccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagccccgacaacgccttcaacccgtcgaaggtgagcgacctgctgagcagcctcccgcgccaagtgggcggacgctggcgtggcccgtccaacgacggggctgccccttctggggccaccaaatgggaaaaagcacgggaacctggcgcagcccaaacgtcttttcaaagaaacaacgggctacctttccaaagggccggcgcctggggccccccccccggaaacacaaggtgggggaaagtcccctcggggggggggggggtttaaacattttcccggcccgggggggt

SEQ ID NO: 77527 - protein, 166 aa, Zea mays
  misc_feature: Ceres CLONE 1562500
  misc_feature (28)..(152): Pfam Name: Ribonuclease_T2 Pfam Description: Ribonuclease T2 family
  misc_feature: SWISSPROT Homolog: EC 3.1.27.1 Ribonuclease T(2)
MAAARRLSLPLVLLVVLAVAGRAAAQDYDFFYLVLQWPGAYCDTKQSCCYPKSGKPAADFGIHGLWPNRDDGTYPQNCSPDNAFNPSKVSDLLSSLPRQVGGRWRGPSNDGAAPSGATKWEKAREPGAAQTSFQRNNGLPFQRAGAWGPPPGNTRWGKVPSGGGGV

SEQ ID NO: 77528 - DNA, 1088 bp, Zea mays
  misc_feature: Ceres CLONE 1562501
  misc_feature: Encodes the peptide sequence at SEQ ID NO. 77529
  misc_feature (472)..(472): n is a, c, t, g, unknown, or other
agtggatcccccgggctgcaggaattcgtctcacccctagaaaaaacctcacagactcctcacacttagtactgttagccaggaacaagccccagcagcagcagcagcaatggccgtggagaacggcagcgccgacgaggcggcagcggtgaccgtgaccgtgaccggcgcccgcaccgtggcgccggccaagaaccgctgcacgctcgccaccttcgacctcccctacatcaccttctactacaaccagaagctgctcctgtaccgcgccgcccccgacttcccggacgccgtggcgcgcatgacggccgcgctcgccgacgcgctccgcgtcttctacccgctcgccggccgcatccgccaggaccacggcggcgcgctggcagtcgagggcgacgagggcgccgaagtcttcgagggccgaggcccagggcgtcgcccgtcgacgaccttgtccggaggggattggcanccacccaagccggaaaaaaggtttttgccagcccctccttgcccctcacccggcgttccttaaacccttccaaggggcttcccgcccccacccttttttcgcccgttccaaattccccaaagactctaagggaaggtgtcttgggcgtgggtgggggtgtgccccttctcacacccacccctttggtgttgtgaatatggccccctcttccccgtggtgcactcttcttatgtttcccctcctgtgtgggctcaaacctctttttccaacggggggataaccccctgggtgtgtggggtgagatacctattttccaaaaccagtgtcctccttgttctcccctccttaggcacatgcgtcgcggtgttatattttcccgcgggcccccccagaaggcccccttttaatataaggtgctatcatatggcgtctataaaatagggctgggtgcgcctccttttttttttttctagaggacccctttgggtgatattatggctcggctcatcacgtctcttcttgcggggagaaaccccatcttctcttttctctccgggtggggtattatgttgggggttcttctacgtgaggagtacgcaataaatttatctttttt

SEQ ID NO: 77529 - protein, 141 aa, Zea mays
  misc_feature: Ceres CLONE 1562501
  misc_feature (121)..(121): Xaa is any aa, unknown, or other
MAVENGSADEAAAVTVTVTGARTVAPAKNRCTLATFDLPYITFYYNQKLLLYRAAPDFPDAVARMTAALADALRVFYPLAGRIRQDHGGALAVEGDEGAEVFEGRGPGRRPSTTLSGGDWXPPKPEKRFLPAPPCPSPGVP

SEQ ID NO: 77530 - DNA, 778 bp, Zea mays
  misc_feature: Ceres CLONE 1562503
  misc_feature: Encodes the peptide sequence at SEQ ID NO. 77531
ctcaccgcggtggcggccgctctagaactagtggatcccccgggctgcaggaattcgtctcacccctagaaaaaccgcctctactgtagccacggcccttggttcccctccattattcgacctcaccttgccaccagccatggctgccgtgaccgccgcggccatctctctgtcctcctcctccacctcctcccctgcggctgctgccaaggccaaggcggcgtccccgtcgtcgtcgccatgcaggcacctccagttcctgtcggcggcgagcccgcggcggcggtggcgggccggcgcccgcgcggtgcgggcgcaggtgtccaccaccgagaccgcggcggcggggccggcgaagacgtccaagaagcaggacgaggggctggtcaccaacaagtacaagcccaaggagccgtacgtcgggaggtgcctgtccaacaccaggatcaccggcgacgacgcgccgggggagacgtggcacatggtcttcagcaccgaaggcgagatcccgtatagagaggggcagtccatcggcatcatcgctgatggcgaagacaagaacggcagccgcacaagctcaggctatactccatcgccagcagcgccctcggagatttcggcgacttccagaccgtgtcgcctttgcgtgaagaggctagtccacacccacgatcagggggaaaatggccaaaggaacccgccccaaacttcccggggtgaacttggaaaccgggcgccccaattggaagataccccggaacccgtgggggcaaagggc

SEQ ID NO: 77531 - protein, 213 aa, Zea mays
  misc_feature: Ceres CLONE 1562503
  misc_feature: SWISSPROT Homolog: EC 1.18.1.2 Ferredoxin--NADP(+) reductase
MAAVTAAAISLSSSSTSSPAAAAKAKAASPSSSPCRHLQFLSAASPRRRWRAGARAVRAQVSTTETAAAGPAKTSKKQDEGLVTNKYKPKEPYVGRCLSNTRITGDDAPGETWHMVFSTEGEIPYREGQSIGIIADGEDKNGSRTSSGYTPSPAAPSEISATSRPCRLCVKRLVHTHDQGENGQRNPPQTSRGELGNRAPQLEDTPEPVGAKG

SEQ ID NO: 77532 - DNA, 932 bp, Zea mays
  misc_feature: Ceres CLONE 1562505
  misc_feature: Encodes the peptide sequence at SEQ ID NO. 77533
ctccccgcggtggcggccgctctagaactagtggatcccccgggctgcaggaattcgtctcacccctagaaaaatttattgaggaacagagctggttttccaaaaaaaaaaattctgctttgattttccataaagaaaacctctcagcctctttcttctagctccatccaagctgtagtcctaatggccgcagccatcgacatgtacaagtactacaataccagcgcacaccagatcccctcctcatccccctcggatcaggagctcgcgaaagcactcgagccttttataacgagtgcttcctcctcttcatcctcctccccctaccatggctactcgtcctctccatccatgtcccaagattcttacatgcctacaccctcttacaccagctacgccacctcgcctcttcccactcccgccgccgcctcctcctcgcagcttccgccgctctactcgtcgccttatgcggcgccgtgcatggccggccagatgggcctgaaccagctcggcccggcccagatccagcagatccaggcccagttcatgttccagcagcagcagcagcagcagaggggctgcacgcgggcgttcctgggcccgcggtcgcagccgatgaaacagtcagggtcgccgtcgccgccgccgccgctggggccggggcaatcaaagctgtaccgcgggtggggaaccgcccctggggcaagggggtgggggaaaatcgggtccccaaaaaccccaaccggctggtgggttgccactttaaaccccggaagaccggggctcgcctaaaaaaagggggccttccgcctcgggggaaacggggcgcctaattcccgggcccccggggggggggggcgacctccgcggacccgttacactcctgggaaccaaattgaaccccatctgaagcccgtggagagaaaaaacaa

SEQ ID NO: 77533 - protein, 103 aa, Zea mays
  misc_feature: Ceres CLONE 1562505
MAGQMGLNQLGPAQIQQIQAQFMFQQQQQQQRGCTRAFLGPRSQPMKQSGSPSPPPPLGPGQSKLYRGWGTAPGARGWGKIGSPKTPTGWWVATLNPGRPGLA

SEQ ID NO: 77534 - DNA, 943 bp, Zea mays
  misc_feature: Ceres CLONE 1562509
  misc_feature: Encodes the peptide sequence at SEQ ID NO. 77535
  misc_feature (865)..(865): n is a, c, t, g, unknown, or other
ggagctccccgcggtggcggccgctctagaactagtggatcccccgggctgcaggaattcgtctcacccctagaaaaactccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggtacgacccgctgaggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggtgggtggagtcaaagcggtgggtggacttcttcaacccggactcccaggccgtggagtgggccacgccgtggtcgcgcaccgctgagaacttcgccaacttcaccggcgagcagggctaccctggcggcaagttcttcgacccgctcggcctcgccggcaccgtcaaggacggcgtctacatcccagacgtcgacaagctcgagcgggtcaagcttgaccgagattcagcacgcccgcatccccatgcttgccatgctcgccttcctccttgaggccgggcaggcaagaaacccgctcggcgagnctcggcctatgatttgcaatgctgccggcgaccaaatcatttcaccaatgccccgggttgggtggaactcctagggag

SEQ ID NO: 77535 - protein, 230 aa, Zea mays
  misc_feature: Ceres CLONE 1562509
  misc_feature (54)..(212): Pfam Name: Chloroa_b-bind Pfam Description: Chlorophyll A-B binding protein
MALAPTSAAVLKTPFLGARRALAKPAPRRALVIAAAAAAKKSWIPAIKSDAEIVNPPWLDGSLPGDFGYDPLRLGKDPAFLKWYREAELIHGRWAMAAVLGIFVGQAWSGIPWFEAGADPSAIAPFSFGSLLGTQLLLMGWVESKRWVDFFNPDSQAVEWATPWSRTAENFANFTGEQGYPGGKFFDPLGLAGTVKDGVYIPDVDKLERVKLDRDSARPHPHACHARLPP

SEQ ID NO: 77536 - DNA, 846 bp, Zea mays
  misc_feature: Ceres CLONE 1562510
  misc_feature: Encodes the peptide sequence at SEQ ID NO. 77537
  misc_feature (413)..(413): n is a, c, t, g, unknown, or other
  misc_feature (417)..(417): n is a, c, t, g, unknown, or other
  misc_feature (425)..(425): n is a, c, t, g, unknown, or other
  misc_feature (428)..(428): n is a, c, t, g, unknown, or other
ggagctccccgcggtggcggccgctctagaactagtggatcccccgggctgcaggaattcgtctcacccctagaaaaaatccggaagaaagggaaaaaaactcgcctttttctctctgctggttcaagaacgccatggaaaatctggagcgctcgctgtgattcctgcgagtacccaagcccaaccaaaccctagcccggcagccattctcttcgttccctctttgctctgcgcgccacaccacacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccagccggagtagctacangcancggcggcngcngccggagctgtccatccgcgccacggcccgcgggcgcgcccgccgcccgtggtctacgcggacgccggcgccgacaacgtgggcctcgctgaagatcaagctcctgaaccccgtgtccggcctgaaccgtggcctggcagccagcccaggaggacctggaccccccgaacccggcgccccggaacctgaaagcggcgggcgggggtcccccgtcaaacctagaagggaacccatataaactccaggggccgggggggggtttctttaaaaaaaagcggtttccttttccgaaaaccctggggggaacccccccttggccccccccagggggcccccccctccctaaaaggtttgggagaagggttccccaggaaaatacaacggggggaacccccattttttaaaaaactgggggagt

SEQ ID NO: 77537 - protein, 123 aa, Zea mays
  misc_feature: Ceres CLONE 1562510
  misc_feature (40)..(40): Xaa is any aa, unknown, or other
  misc_feature (41)..(41): Xaa is any aa, unknown, or other
  misc_feature (44)..(44): Xaa is any aa, unknown, or other
  misc_feature (45)..(45): Xaa is any aa, unknown, or other
MAATWSSSCCAATASSSALLRHARVKSAPWVAGASRSSYXXRRXXPELSIRATARGRARRPWSTRTPAPTTWASLKIKLLNPVSGLNRGLAASPGGPGPPEPGAPEPESGGRGSPVKPRREPI

SEQ ID NO: 77538 - DNA, 840 bp, Zea mays
  misc_feature: Ceres CLONE 1562511
  misc_feature: Translation starting site: 274
  misc_feature: SWISSPROT Homolog: EC 2.7.12.1 Dual-specificity kinase
acccgcggtggcggccgctctagaactagtggatcccccgggctgcaggaattcgtctcacccctagaaaaacttccccccttccccatcccacctcctgctacaaccgcttcgtttcctcccctcccaaatcccccccaaccccaaatcgagctccgagtcgacggcccttgccgaaccgctctccagttcccaaatcccccctccccccaaaattcgccgccggactggcccggccgatggagtgacccagctagggttccgaagccggcaatggaggcgcagtggctcgcggagtatccgcaccagggggccgacaagcggccgcgcaaacgggcccggctcgcctgggatgtcgcgcccacgctgttccagccccccaaggcaattccgatgctatattgcgggcaggaactaattaatggtaatttcacgactgcatttcttccaccaccatcaatttattacaccgggccaccacggaatatttcgcctccttggagaccagatgacaaggatggacactatgtttttgcggttggaggagatctcacaccaagatataggatacttaacaagatggggtgagggacatttggacaagttttggagtgctggggactggaaaaccaagaagcagtggctatcaagattgtacgctccctttcagaaaaccgagaggctgctatgatagaaattgatgtgcttccaagaacttgggaacatgactttactggcaagccgtgtgtgcaaaaacgggacctggttggaccatcgcaaatctaatttggtaaagaattttgagaaagcttgggccaagccccaaatgaactttctggt

SEQ ID NO: 77539 - DNA, 1137 bp, Zea mays
  misc_feature: Ceres CLONE 1562516
  misc_feature: Encodes the peptide sequence at SEQ ID NO. 77540
  misc_feature (769)..(769): n is a, c, t, g, unknown, or other
ctcaccgcggtggcggccgctctagaactagtggatcccccgggctgcaggaattcgtctcacccctagaaaaagctaggtttctacccctctaaatcgatcctcgctccacggccatggtgaggatgaagcaggtaaagatttcggtaaagaaggacgtggattcgtacacaatccgcggcaccaacaaggtcgtccatgtgggcgactgcgtgctgatgcgggcgtcggactcggacaagcagccgtatgtggcgcgggtggagaagatggaggccgacagacgcggcagcgtgcgggtgcaggtgcgctggtactaccgccccgcagaatccaagggcggtcgccggctgttccaccgcaccaaggaacttttcctttccgattatttcggcccacatatgtcccacaccatcgatggggaaatgtgtcgccccctcctttcaagatcttcacacaagccttgatatatgtcgggcctgtaggacgtcctcctcccgtacgttgagtacaaaggcgtgccccctggttttgtttatcccccttgtaccgcacgtgggaatagttaatgtgcataagagggaataaggccctacacctacccccgggtgacaaccctctcttgtatgggcttgtagcccgatatcttctcctctctatggacacggtgtttacattttacttctttattcgggagtggagtgtgcaatgtttaagcaaactagctcaccaccagtcgcccgcaaattaaaattatctctcaccatgntggtctcgcttgtgttgtcagcgcctcccgagactctgcgttatctaataacataaaagaaacggccttttacacaataattagactcctctacctatatgtgactggtgtaccgcactcgtcccgcttgagaattatgctcattacccccaccggcgtcgcgtcaattttctctctgtgcgtgatgagattttcgagatatacacaccgtgctctcttcgtcttctatgtagtgtgcagtggatgactgcaactgattaggggtgggcgagtggcgattccttgagcttttggatgacaatcagacgcgtaggtctacacctgtgtgtcgtatcctttttttccgccccaggtggaacgtatatatt

SEQ ID NO: 77540 - protein, 116 aa, Zea mays
  misc_feature: Ceres CLONE 1562516
  misc_feature (25)..(117): Pfam Name: BAH Pfam Description: BAH domain
MVRMKQVKISVKKDVDSYTIRGTNKVVHVGDCVLMRASDSDKQPYVARVEKMEADRRGSVRVQVRWYYRPAESKGGRRLFHRTKELFLSDYFGPHMSHTIDGEMCRPLLSRSSHKP

SEQ ID NO: 77541 - DNA, 794 bp, Zea mays
  misc_feature: Ceres CLONE 1562518
  misc_feature: Encodes the peptide sequence at SEQ ID NO. 77542
tggagctccccgcggtggcggccgctctagaactagtggatcccccgggctgcaggaattcgtctcacccctagaaaaagacggtgggggtgacttcctcagttcctctccccctacccttccgatctctttccctctgcgaattgttctattaggtttggtacattctgttcccttgctcaaatctctgtctcaaaacgtgaactagaaccaccagccaccatttcatacgatctcatcacacttcttagttaccatctccagcgaccttcctcgggggtactaagccagatccgcgctcgtcgaaatcccgactcccgaggtcctccccaagcccgagggccggtcgtctccatggcggggatcctggcgtgggcggctgacgtggtccggcgggggccggcggcagcgacgacgaggcggacgatgacgcgcgcgccgcggcgtcggccgccatgaccccggcccagcggctccgcgccgccgacctggacgcgcgggcggcttcgctgcgccgcgccatccaggacctccgcctccgggtgcccccgccgcacgtcgcgcagcgcctgccccacctccacgccgactcactcgcgtcgtccgccgcgctcgcgctccagctcaacgcgcactcctccaccatagagcagacccaacaaagagaagtaactctccaagaagataatgcagcctatgagaaagctatatcagagtgtaaacagaaaattcaggaaaagcagatgggagccactcagcttctgagtaatctggaagggaatggtaagtaacat

SEQ ID NO: 77542 - protein, 111 aa, Zea mays
  misc_feature: Ceres CLONE 1562518
MTPAQRLRAADLDARAASLRRAIQDLRLRVPPPHVAQRLPHLHADSLASSAALALQLNAHSSTIEQTQQREVTLQEDNAAYEKAISECKQKIQEKQMGATQLLSNLEGNGK

SEQ ID NO: 77543 - DNA, 920 bp, Zea mays
  misc_feature: Ceres CLONE 1562522
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
  misc_feature (106)..(106): n is a, c, t, g, unknown, or other
nnnnnnnnnnnnnnnnnnnnnnnnnnnnnnnnnnnnnnnnnnnnnnnnnnnnnnnnnnnnnttttnnnngnnccaaactggactccccgcgtggcggccgctctanaactagtggatcccccggctgcagattcgtctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaaccaccggcgtctcgccggcgcgcgacttctacataacggggcttcaccggtccttaacgcgaaccaccgaacgctgcagttgaacgggaatgcagcaaaccaaaattccctttaccgaacccctaacctgaaattaccgggcattcccaaggggccggaaaatccggtacctggggaagcaaacctttcaggggtggcccccagggaaaaaaaacggggggcaaaaaaacaaaaccttgggaaaaaaaaacccccctggaaaaaaaaaaaggggccggggggccccccttgggttttcccggggccctttttgggggagaaaaaaaaaacaacctctcctttccaaaaaaaaatgtggcccccttttttcccttttttccccaaaaaaccccgggatatttaaaaacccccccccttttgggttttcggccccccctaaaaaaaaacccccaaaaaaggggggtttttttgggggaggcgccgggaaaaatttttttgggggggggggtttcattaaagagggggcccccctttagaggggggggggatttatccccccccccccggggggggggcttcccttcaaaaaa

SEQ ID NO: 77544 - DNA, 767 bp, Zea mays
  misc_feature: Ceres CLONE 1562523
  misc_feature: Encodes the peptide sequence at SEQ ID NO. 77545
  misc_feature (626)..(626): n is a, c, t, g, unknown, or other
  misc_feature (633)..(633): n is a, c, t, g, unknown, or other
  misc_feature (679)..(679): n is a, c, t, g, unknown, or other
  misc_feature (680)..(680): n is a, c, t, g, unknown, or other
tcaccgcggtggcggccgctctagaactagtggatcccccgggctgcaggaattcgtctcacccctagaaaaatgaacgacagcggaggcgtcaggaacgcgtcccacctcctcaagtacgactcgatgctcggcaccttcaaggccgacgtcaagatcgtggacgacactaccatcagcgtcgacggcaagcccatcacggtcgtctccagcagggacccgctcaagctcccatggggtgagctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgcggacatcatcagcaacgcgtcctgcacgaccaactgcctcgcgccattcgtcaagatcttggacgaggagttcggaattgtcaaggggaccatgacgacgacgcactcgtacaccggcgaccagaggctgctggacgcgtcccaccgcgacctccggcggggcccgcgcggcggcgctgaacatcgtgccgacgagcacgggcgccgccnaggccgntggcgctggtgctgccgcagcttgaaggggaagctgaacggcatcnncgctgcgggtgccgaccccgaacggtgtccgtgggtgggacctggtggatcaacccccgtggaagacgggcatcaccggccgaagaa

SEQ ID NO: 77545 - protein, 231 aa, Zea mays
  misc_feature: Ceres CLONE 1562523
  misc_feature (1)..(123): Pfam Name: Gp_dh_N Pfam Description: Glyceraldehyde 3-phosphate dehydrogenase, NAD binding domain
  misc_feature (128)..(226): Pfam Name: Gp_dh_C Pfam Description: Glyceraldehyde 3-phosphate dehydrogenase, C-terminal domain
  misc_feature: SWISSPROT Homolog: EC 1.2.1.13 Glyceraldehyde-3-phosphate dehydrogenase (NADP(+)) (phosphorylating)
  misc_feature (185)..(185): Xaa is any aa, unknown, or other
  misc_feature (203)..(203): Xaa is any aa, unknown, or other
MNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRGPRGGAEHRADEHGRRXGRWRWCCRSLKGKLNGIXAAGADPERCPWVGPGGSTPVEDGHHRPK

SEQ ID NO: 77546 - DNA, 775 bp, Zea mays
  misc_feature: Ceres CLONE 1562527
  misc_feature: Encodes the peptide sequence at SEQ ID NO. 77547
  misc_feature (731)..(731): n is a, c, t, g, unknown, or other
  misc_feature (732)..(732): n is a, c, t, g, unknown, or other
  misc_feature (742)..(742): n is a, c, t, g, unknown, or other
  misc_feature (743)..(743): n is a, c, t, g, unknown, or other
  misc_feature (752)..(752): n is a, c, t, g, unknown, or other
ggagctccccgcggtggcggccgctctagaactagtggatcccccgggctgcaggaattcgtctcacccctagaaaaagcctctcaaccactcatcatcgccttcgcaggcatcgccctctcgccgggccgtccgattccgccatggcttccgatgagagcaaaaattcaaaaccagagaagccatcttcagcagctggtgcaggcctccccaatccgtttgatttttcttctatgagcaacttgctcaatgacccatcgataagagagatggctgagcaaattgcaagtgaccctgtgttcaaccagatggctgaacagcttcagaaaagtgctcagggtgctggagaacagggtattcctgcattggatcctcaacagtatatggaaacaatgcaacaagtcatgcaaaaccctcagtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgaagatagagaatgggggtccatctgccaatgtgaaagtattggaatggaccctgaggttcttcaaaagattggcaggggcatggggtgtttacccttccgggaaaattcttagtgtgtccaactggtgctctcctggacccgaaagagacctganngagaaaaggnnagggaattnacccaattgagtccaatggttcc

SEQ ID NO: 77547 - protein, 181 aa, Zea mays
  misc_feature: Ceres CLONE 1562527
MASDESKNSKPEKPSSAAGAGLPNPFDFSSMSNLLNDPSIREMAEQIASDPVFNQMAEQLQKSAQGAGEQGIPALDPQQYMETMQQVMQNPQFVSMAERLGNALMQDPAMSSMLENLTSPAHKEQLEERMARIKEDPSLKPILDEDREWGSICQCESIGMDPEVLQKIGRGMGCLPFRENS

SEQ ID NO: 77548 - DNA, 865 bp, Zea mays
  misc_feature: Ceres CLONE 1562528
  misc_feature: Encodes the peptide sequence at SEQ ID NO. 77549
  misc_feature (42)..(42): n is a, c, t, g, unknown, or other
  misc_feature (100)..(100): n is a, c, t, g, unknown, or other
  misc_feature (404)..(404): n is a, c, t, g, unknown, or other
  misc_feature (427)..(427): n is a, c, t, g, unknown, or other
ctcaccgcggtggcggccgctctagaactagtggatcccccngggctgcaggaattcgtctcacccctagaaaaaaaaaaaaaaacgcccgaacgccccncaccactctctcgacccaaagctcagattggcacgacgaagcagaggccccccccctggagcggcgcggagcaatggcggcgggataccgggcggaggacgactacgactacctcttcaaggtggtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacactgccggccaggaacgatatccngctattactagtgcatattatcngagtgctgttggggcgttgcttgtatatgacgtcactcgtcactcaccttttgagaacgttgagcgtgggctgaaggagttgagggacacacagatccccaatatagttggttatggtgggtgggcaacaaatctgatctccgccatcttggaagccgtttcaaactggatgaaggaaaagctttccccaagaagggaagtctttgtattttcatgggagacctctggccttcaggttcacttaacgttgaaaaatggctttccccgaggggcttaacttccgattttacccgtatttggggccaaaaaaagccttttgaagcccggccaaaaatgcccccattctggggcctgggaagggggcgaaaaaaaattacctttaagggggtgggttttttccgccggggaaaaaaaaggggtggcctgccgcgccccccc

SEQ ID NO: 77549 - protein, 176 aa, Zea mays
  misc_feature: Ceres CLONE 1562528
  misc_feature (16)..(143): Pfam Name: Ras Pfam Description: Ras family
  misc_feature (16)..(121): Pfam Name: Miro Pfam Description: Miro-like protein
  misc_feature (85)..(85): Xaa is any aa, unknown, or other
MAAGYRAEDDYDYLFKVVLIGDSGVGKSNLLSRFTRNEFSLESKSTIGVEFATRSLQVDGKVVKAQIWDTAGQERYPAITSAYYXSAVGALLVYDVTRHSPFENVERGLKELRDTQIPNIVGYGGWATNLISAILEAVSNWMKEKLSPRREVFVFSWETSGLQVHLTLKNGFPRGA

SEQ ID NO: 77550 - DNA, 935 bp, Zea mays
  misc_feature: Ceres CLONE 1562536
  misc_feature: Encodes the peptide sequence at SEQ ID NO. 77551
  misc_feature (477)..(477): n is a, c, t, g, unknown, or other
ctccccgcggtggcggccgctctagaactagtggatcccccgggctgcaggaattcgtctcacccctagaaaaactcgcgttccatttgcttcggctcatctcagatcaagctagcgcacctgacacccaccacctccctcccagatccaccaccccagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgcccactcccacggcgacctccacgacgaccctttcgccgcaactgctgacttcaacggtgggcccattctttcgccccccatccgagatgggccccgaggagggattcctgctcccccgagtgggggcccacaaaatgcctattcccctttggggaaaaaagaaanaaagggaaaggggccttaggagccccaatcctcctttgatgctcgaaaaagttttaagaaaaactttttgttgagaaaaaaaaaagcctaatggctttaaacaaaacaagggggcccaaaacccggggaccagggggaaaaagtttttttcctttcccaaaacccgggaaaaaagttccccctggcctggggggccaaataaaaccaaaactggggaaaagggggaaatctcggaacctttttccccccctgggagaattggcttaacaaacccaagaaaaaaaaaagggggccagggaaaaacacaagggagagaaaaaaaccccgggggaaacctggggggatacccagggggaacgaaaaaccctgggagaacccaaccggaaacttgggccccggaatgtccggccaaaaatttgtgtgaagactgaaaaacaccttctccccccccacacaaa

SEQ ID NO: 77551 - protein, 129 aa, Zea mays
  misc_feature: Ceres CLONE 1562536
  misc_feature (106)..(106): Xaa is any aa, unknown, or other
MATAFDSPTSSPAAAPFHDDPFLHFDGSAPAAADGFPASPDAYAPSPFGMPTPTATSTTTLSPQLLTSTVGPFFRPPSEMGPEEGFLLPRVGAHKMPIPLWGKKKXRERGLRSPNPPLMLEKVLRKTFC

SEQ ID NO: 77552 - DNA, 848 bp, Zea mays
  misc_feature: Ceres CLONE 1562537
  misc_feature: Encodes the peptide sequence at SEQ ID NO. 77553
aaatgctggagctccccgcggtggcggccgctctagaactagtggatcccccgggctgcaggaattcgtctcacccctagaaaaaatcagaggaagcacaaagcaccaccatcgccatgagatgagagccaagcagagtagtagagagagaagaacaggggttagccgcgtcgtcgtgcgaactctggtcgtgcatgcagaagatgtccatggccttttcgtgagcaaacagagacgagagggccgaagattccttgccggtcactgacctcagcaaagctcgtagccataagccgctatgaccagctcatcgaaattcgagttccctctcgaactctaccgataacttcgacaacgaggttacaagtcacctaaagagcaagttggtacgtggaatctcaagtcccaggcaagttgtgcccttgatcacttctttttatccaatcatgctcttattaatcataatgatctgcataggttaattttgatgggacccaataggttaccctagtttgactatctttataccttgtttaccactgaattttttggtagtacctctagaaaaagctattgctatatgtggttttggggtatagaggtacacattattcatgatcctacttacattatcaatttgatatttactatgcatgataagatcattatgttaattggaacatggagaaccacccgggaaaacagtgctaccacgatgggtggttatgggacgcccttggctgactaattatgaaagctagtggaagactaccttacccaaaaggacaagggcagtaggggagtggtccagtttagggagttcccttgggggttgattttgctgcgaa

SEQ ID NO: 77553 - protein, 48 aa, Zea mays
  misc_feature: Ceres CLONE 1562537
MRAKQSSRERRTGVSRVVVRTLVVHAEDVHGLFVSKQRREGRRFLAGH

SEQ ID NO: 77554 - DNA, 865 bp, Zea mays
  misc_feature: Ceres CLONE 1562541
  misc_feature: Encodes the peptide sequence at SEQ ID NO. 77555
ctggagctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaggcggtgtggttcaaggccggcgcgcagatcttctcggagggcgggctggactacctggggaaccccaacctggtgcacgcacagagcatcctggccatctgggcgtgccaggtggtgctcatgggcttcgtcgagggctaccgcgtcggcggcggcccgcctcggggaaggcttcgaccaaggtgtaccccggcggcgcctttcgacccgctgggcctcggcgacgacccgggacaccgccgccgagcctaagggtgaaggagctcaagaacggccgccttgccatggttcttccttgttcgggcttcttcgtggcagggcatcctcacccggcaagggct

SEQ ID NO: 77555 - protein, 205 aa, Zea mays
  misc_feature: Ceres CLONE 1562541
  misc_feature (59)..(206): Pfam Name: Chloroa_b-bind Pfam Description: Chlorophyll A-B binding protein
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPPRGRLRPRCTPAAPFDPLGLGDDPGHRRRA

SEQ ID NO: 77556 - DNA, 815 bp, Zea mays
  misc_feature: Ceres CLONE 1562542
  misc_feature: Translation starting site: 561
  misc_feature (391)..(391): n is a, c, t, g, unknown, or other
  misc_feature (393)..(393): n is a, c, t, g, unknown, or other
  misc_feature (718)..(718): n is a, c, t, g, unknown, or other
ctcaccgcggtggcggccgctctagaactagtggatcccccgggctgcaggaattcgtctcacccctagaaaaagtaccagaacaccaaaagccatctgatctccactcctgcgaagagatctagcacatcgccacatccacacacacttccagctcctccaaatatttcgcgccacttgcgggctctgacggtttagctccactccagccatgagctcccgaatggccggagcagcgctcctgcgccacctaggcccccgcctcttcgcggccgagccggtgaccgggctcgcggcgaggggcgtcatgcccgcggccgcgaggattctccccgcacggatgtccagcacggccgcggaggccgccaaagaagctgccgcgccacaacancnccaaaagcccgaggccgcggccgcggcgccggaggggcaggacaagaaggccgtcgtcagctactggggcatcgagccgcgaaagctcgtgaaggaggacggcacgggagtggaggtggttctgcttcaggccatgggacacgtacagagcggacacgtcgatcgacatgaagaagcaccacgagccgaaggcgctgccggacaagctggcctactggctggtcaagtcgctggtcgtgcccaagcagctcttcttccagcgccggcacgccagccacgcgctgctgctggagacggtggcggccgtgccggggcatggtgggcngcatgctgctccacctgcgctcgctgcgccgcttcgagcacgcggcggctggatccgcgcgctgcttgaggaggccgagaacagcggatgcacctca

SEQ ID NO: 77557 - DNA, 891 bp, Zea mays
  misc_feature: Ceres CLONE 1562543
  misc_feature: Encodes the peptide sequence at SEQ ID NO. 77558
ctggagctccccgcggtggcggccgctctagaactagtggatcccccgggctgcaggaattcgtctcacccctagaaaaaaccccctactcgccagtccacaggacctcgaccccgctaagcaagctccaagagcgatcgccgcagaagatcccgcgatgcaggccccgccggcgccctcctccgtcgacctgccgctggcggtggcgccgccgccggtgaaggcgccgaccccgcggcccccgctgccggcctcgctgcagcccgagtccccgggggtcttcttctccgccgccgccgccgccgcgcccctgggcaccgcccaccgccgcatcgccatcgccgtcgacctctccgacgagtccgcctacgccgtgcgctgggccgtcgccaactacctccgccccggggacgccgtcatcctgctccacgtgcgccccacctccgtgctctacggcgccgactggggcgccgtcgacgtctccctccccaaccctagcgccgccgcctccgaggtacgcgacggcgactgcgagaccgccgccgccgccgcctgatggaggacgacttcaacgccttcacgggcaccaaggccgaccactccgccagcccgctcaaggacgcgggctccccttaagattccctcctccgggaacccaactggaagaggcccccgcctcggggcaagggccccttctaaggccgtttttaggggaacaagggctttcgcccccccgggggaccaaaaggggaggcctcggagggttcacaatttgggggggccccctttttttgcccccgtggggggggggcccccccttaaaacgccccccccaagggggggggcccccgttgtttccccccccttgtggtttataaatttgcccccccc

SEQ ID NO: 77558 - protein, 132 aa, Zea mays
  misc_feature: Ceres CLONE 1562543
MQAPPAPSSVDLPLAVAPPPVKAPTPRPPLPASLQPESPGVFFSAAAAAAPLGTAHRRIAIAVDLSDESAYAVRWAVANYLRPGDAVILLHVRPTSVLYGADWGAVDVSLPNPSAAASEVRDGDCETAAAAA

SEQ ID NO: 77559 - DNA, 860 bp, Zea mays
  misc_feature: Ceres CLONE 1562546
  misc_feature: Encodes the peptide sequence at SEQ ID NO. 77560
  misc_feature (398)..(398): n is a, c, t, g, unknown, or other
ctccccgcggtggcggccgctctagaactagtggatcccccgggctgcaggaattcgtctcacccctagaaaaaaactcccatccccgcacttcaccggcctcctcctccttcccgtccatcgccgtcgccggggcgccctacaacttcaaaatggcggctaccgccaccgccatggctatagcaactatctcccccgccgctccgatcccatccgcgcccttcccatccctccccctcggcctccgcctccgccctcaacccctccttttcgctgcttcccgccgccgcctcctccatgttcccaaagccgcctcctgggacgaatccgtccccgaggatggtggagatgcggaggaatccgttgccgctggggacgacgaggacgaggacgaaaancctcggcccgagccggtgtcctcctccgagttccagttcgcggcgccacccgaaggctacgtcgagcccgcggagtttgacgagctaccgacgggagtcaccagaagacgtgggcggcggcgtactaatctctctacgggccggccttcagcggaggagacatttgctgggcgacaaatgtcttcaatgtcaatggtgggcgaccccatcgacatgggacgggaagcaaccctcccaaacaacgatttcacccgatcgcgtcaagcaggttaaacgccataccaaaggtcatccaagggaggggaggtaggttttctaccggcaaaaaaggtggtcgtatgggaaaatgaagggccccccttggtgtccggcccttgggaaaggccaaaggaggtcccccgaaggcattccccaaaggtccccccttaaaggggccgggtcaaccctggacaaagggcccct

SEQ ID NO: 77560 - protein, 172 aa, Zea mays
  misc_feature: Ceres CLONE 1562546
  misc_feature (82)..(82): Xaa is any aa, unknown, or other
MAATATAMAIATISPAAPIPSAPFPSLPLGLRLRPQPLLFAASRRRLLHVPKAASWDESVPEDGGDAEESVAAGDDEDEDEXPRPEPVSSSEFQFAAPPEGYVEPAEFDELPTGVTRRRGRRRTNLSTGRPSAEETFAGRQMSSMSMVGDPIDMGREATLPNNDFTRSRQAG

SEQ ID NO: 77561 - DNA, 777 bp, Zea mays
  misc_feature: Ceres CLONE 1562548
  misc_feature: Encodes the peptide sequence at SEQ ID NO. 77562
  misc_feature (767)..(767): n is a, c, t, g, unknown, or other
tcaccgcggtggcggccgctctagaactagtggatcccccgggctgcaggaattcgtctcacccctagaaaaagtttttcgccgccttttacttatcccatcttccctcgactgcgctctctctcccccttctctcgcgcggcaactgggccatcgccgccacccctacccaggtcttcgtcggtcgcttcgccagccgccaggtcttcgtcggcccatcccccggtcttcgtccttcaatcctccggcgacgagcacccaccagaggctgggaactccaaagaggaacagggtccatggctggaggcgcaggaaatggttcgaacgaggcggtgcaggcaaaggggaagtgggggtgatagctccgccgccaagccgctgcccccttgctgcgtcaaggcgagagcggcggcgcccgagtctgaggccaagtgccatgccaccgtggtttcgggatggttcaccgagccacgatcacactgcggtaaagccagcaaagttcagtattacaataacccaatgtggccagaagaggcccattcccttgaaagtggagaacatattgtaccaagggaaaaatcacatacccaggaagtcctgggtctttggagtcgtcaaccctatggggaaagtcccttgtgccttgatgggaattgttcaaattgactgaataaggattgattgtgcgttaccaaggaaatgattacttcaccttcccaactctggtcaatttccatccccctaaaaaaggtttgggttatggtgtngggggaaaaa

SEQ ID NO: 77562 - protein, 116 aa, Zea mays
  misc_feature: Ceres CLONE 1562548
  misc_feature: SWISSPROT Homolog: EC 2.5.1.16 Spermidine synthase
MVRTRRCRQRGSGGDSSAAKPLPPCCVKARAAAPESEAKCHATVVSGWFTEPRSHCGKASKVQYYNNPMWPEEAHSLESGEHIVPREKSHTQEVLGLWSRQPYGESPLCLDGNCSN

SEQ ID NO: 77563 - DNA, 930 bp, Zea mays
  misc_feature: Ceres CLONE 1562549
  misc_feature: Encodes the peptide sequence at SEQ ID NO. 77564
  misc_feature (883)..(883): n is a, c, t, g, unknown, or other
  misc_feature (884)..(884): n is a, c, t, g, unknown, or other
  misc_feature (904)..(904): n is a, c, t, g, unknown, or other
ctccccgcggtggcggccgctctagaactagtggatcccccgggctgcaggaattcgtctcacccctagaaaaactcacacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgccagtggtggagaccccgccgccggccgtcgtgcccgaggagtctgcccccgccgaggccgaggctgaggctgaggctgaggctgctgctcctgctgatcccgaggagcttcccgcggccgagcagcaggcagccgccgagcccgaggccgctgctcctgctggtgccgaggagcccgcggcggccgaaccggccgctgaggcggaggctgctgctcctgctggtcccgaggagactcctgcggtcgagcaggaggcagccgccgaggaggaggctgctgctgctcctcctgctggtgccgaggagcccgccgcggccgagcctgtcgccgaggcagaggctgctgctcccgaggagctcgccgcggacgagccggatgctcctgctcctgctcctgctggtcccaggaagctgccgccgaggcggaggctgctgctcctgaggagcccgagaaagccagcgagtgaggccgtgcgcacgcagcggcgggcggcagggccatggcccaagggatctgcgtgcgccccttggcggggtagtctctcgcgcgcgtacatgcagtatgacaacggattttgctgtccagtacgctacggtacgggcggccccnnccccgggggggggggggtgncgaacggacccggtacgtactagcag

SEQ ID NO: 77564 - protein, 234 aa, Zea mays
  misc_feature: Ceres CLONE 1562549
  misc_feature (221)..(221): Xaa is any aa, unknown, or other
  misc_feature (228)..(228): Xaa is any aa, unknown, or other
MATAEVQTPTVVAAEEAPVVETPPPAVVPEESAPAEAEAEAEAEAAAPADPEELPAAEQQAAAEPEAAAPAGAEEPAAAEPAAEAEAAAPAGPEETPAVEQEAAAEEEAAAAPPAGAEEPAAAEPVAEAEAAAPEELAADEPDAPAPAPAGPRKLPPRRRLLLLRSPRKPASEAVRTQRRAAGPWPKGSACAPWRGSLSRAYMQYDNGFCCPVRYGTGGPXPGGGGVXNGPGTY

SEQ ID NO: 77565 - DNA, 977 bp, Zea mays
  misc_feature: Ceres CLONE 1562550
  misc_feature (834)..(834): n is a, c, t, g, unknown, or other
  misc_feature (977)..(977): n is a, c, t, g, unknown, or other
tggagctccccgcggtggcggccgctctagaactagtggatcccccgggctgcaggaattcgtctcacccctagaaaaagtatctataccaccgaaggcgaggaaagggggccaaggacgagcgctttttcgtgcccgctggccattgccgctgctcaagagcctcccgccccgcgctgccctggcctctgcgggtctgcccccaacgaggccccagaagagccggtaaaagagcccgtcaaaaacccccgcccaagaaaacacccaaggggcaaaaagggggtaaacgttaaccttcacctaattaacaaccaaacggggttgatccctaaacccagggaacctgggggcacaaagtgttggtccccccccaagggggcccaaacttttggttttgaatccccccccccccccaaagaaaaaaaaaaccccttcgggggggtgtgtatataaaaggaatttgtgcccccagggcaaaaagttggagattcctaaaaatttgccccccgttgattttttttggggggcgctccccccccggcgcaatcgggggggggaacaggaaataacacctctggggcccctttgagaaaaaaaaaaaattatcccccccgggggggggggggggcggcacccgggggggaaaaaaaatgttaaaaatttccccggtgggggagccccttggagaatttttataccaccccgcggagataaacccccccccccccaggggggattgggagatgtcccccgggggcccccccccaaaaaaaaaacaacaacttttttctttaaaaagggggggggagggtggtggggggatatatttttttncccggaggccaccgcgggagaaaccaagagaagagcaggcgccccacaacaggaggtaataaccctctttttatataataacgcgggggggtcccccccacaaaagttatgttttgttgggggggggccccccaaaaaaatan

SEQ ID NO: 77566 - DNA, 859 bp, Zea mays
  misc_feature: Ceres CLONE 1562551
  misc_feature: Encodes the peptide sequence at SEQ ID NO. 77567
  misc_feature (620)..(620): n is a, c, t, g, unknown, or other
  misc_feature (785)..(785): n is a, c, t, g, unknown, or other
  misc_feature (836)..(836): n is a, c, t, g, unknown, or other
  misc_feature (851)..(851): n is a, c, t, g, unknown, or other
ctggagctccccgcggtggcggccgctctagaactagtggatcccccgggctgcaggaattcgtctcacccctagaaaaagccagaggcgacaggccaatgggtttccgcggtggtttgaggccgcccgtgacgcgcgtctgcttcgtcctcctgtgcctgtgcgcctcgttgtccgaagccaagaggacgccgcagcctgcgcctactacgggcaagaagcagcagccaccggcagcgtcgtcgtcccagcagagcccagcggtctcgtatccggctctccccgtccgggcggtgtgcctcggcggttggctcgtcaccgagggctggattctgccctccctcttcgacggcatccccaacaaagacctcctggatggcacgcagctgcagttcaagtcggcgctgcggaagacgtacctgaccgcggacaacggcggcggcggcgccgtcgtggccaaccgcacgcaggcctccgactgggagacgttcaagctgtggaggctgaacgacacgacgttcaacttccgcacgtccggcaaccagttcgtgggcatcggcgccagcgacggcatcatcgtcgcgacggccaccacgccgggcctggccggagacgttccnagatagtggcggtgccccttcgacaagaacaagggtccggatcaaggcggcgaacgggctacttcgtccaggcgatagcgaccggcgaagtgatagcggactacggcgagccccacgcggtggtccgacttcgacgccgtcagtgttccctgatgaccaccgtcnggcagcacttgcaaagggagtacagctcttgcacgggctacggcgccgacnaggccgcgccgctgnctgaggaa

SEQ ID NO: 77567 - protein, 175 aa, Zea mays
  misc_feature: Ceres CLONE 1562551
MGFRGGLRPPVTRVCFVLLCLCASLSEAKRTPQPAPTTGKKQQPPAASSSQQSPAVSYPALPVRAVCLGGWLVTEGWILPSLFDGIPNKDLLDGTQLQFKSALRKTYLTADNGGGGAVVANRTQASDWETFKLWRLNDTTFNFRTSGNQFVGIGASDGIIVATATTPGLAGDVPR

SEQ ID NO: 77568 - DNA, 769 bp, Zea mays
  misc_feature: Ceres CLONE 1562552
  misc_feature: Encodes the peptide sequence at SEQ ID NO. 77569
ctggagctcaccgcggtggcggccgctctagaactagtggatcccccgggctgcaggaattcgtctcacccctagaaaaaaaaacaaggcaacaagggagaagtagatctgcatctgcgagagaaggcagcgggggtggtgatgatggagagccagccgctgcaggccccgacggccacggctccggcccccggatctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccctccaagacaatcccctatgtatggaccgtctttaccgctggttacatcgagcaagtcctcccaggggccattggcagttctcttggtcttctcttttgtggaaaggacattgaaccagcatggggccgcaaggaattcttgaagttcattattttgatcaactccatctgtggcattcttgcattttgctttgctattggactctactacgtcactggaaaggagagcttccttgtcacacccactttctggtttccacggttgccttgctgggctttcttggggcccctgaagcaactccttaccaaacctttgaagcttcctatggggcttttttctgggaaaataaaaggcaaaaggggatgcccattccctttgtttgtaaggtttcccccaaagtatacaggggcctttcaattcgtggcct

SEQ ID NO: 77569 - protein, 209 aa, Zea mays
  misc_feature: Ceres CLONE 1562552
  misc_feature (67)..(166): Pfam Name: DUF1751 Pfam Description: Eukaryotic integral membrane protein (DUF1751)
MMESQPLQAPTATAPAPGSAEPAGAPPAVTPGKEFTRTCKGLVVVLIGGYVLLQLLPSSLNYLAIIPSKTIPYVWTVFTAGYIEQVLPGAIGSSLGLLFCGKDIEPAWGRKEFLKFIILINSICGILAFCFAIGLYYVTGKESFLVTPTFWFPRLPCWAFLGPLKQLLTKPLKLPMGLFSGKIKGKRGCPFPLFVRFPPKYTGAFQFVA

SEQ ID NO: 77570 - DNA, 850 bp, Zea mays
  misc_feature: Ceres CLONE 1562554
  misc_feature: Encodes the peptide sequence at SEQ ID NO. 77571
  misc_feature (450)..(450): n is a, c, t, g, unknown, or other
  misc_feature (479)..(479): n is a, c, t, g, unknown, or other
  misc_feature (488)..(488): n is a, c, t, g, unknown, or other
  misc_feature (516)..(516): n is a, c, t, g, unknown, or other
  misc_feature (517)..(517): n is a, c, t, g, unknown, or other
ctccccgcggtggcggccgctctagaactagtggatcccccgggctgcaggaattcgtctcacccctagaaaaagaccaagagaggaaggtcagccagccaaacgccaccgccgccgtgctcgcgccgcacgcaactctcagctctctgacgcctcctcctccgtcgattccgacgagagagacgcaaaccaacgaggtaggaaggagcgcgaagatgggagcgggggacggtgaggtcgctgcgagcaaagacaaggccagcggcggcggcgccgagcggacgtcgctggacggcgtgcgggataagaacgtgatgcagcttaagaagcttaatacggcgctattccctgtccgctacaatgaaaaatactaccaggacgccatcgcctccaaggatttctccaaactagcatactttagcgatattttgtgttggtgcgatagcttgntcgccctgggagaagaaggaaggaggagncagtccgangtttatatcatggacctttgggtgtacnntggcaccgtatcgggggtcttgggtattggggacaaagctgctggaatcaatggtggttcgaatctctcagcaaagcaaaaacatctcccgagaatataccttgcaatggttcagacccaaccacgatgattggcaattgcttttctacaagaaagttttggggttcgaggattaccccgaccattccctaacttcctaatggaacatacggccccgggaattgctacgtttcttaggaaaattcattggcccgggctgctccaagaaattaaaaagcaccccggccacttttaagagaccctggcccctcagttatgggggaaaaaagatgg

SEQ ID NO: 77571 - protein, 143 aa, Zea mays
  misc_feature: Ceres CLONE 1562554
  misc_feature (79)..(79): Xaa is any aa, unknown, or other
  misc_feature (88)..(88): Xaa is any aa, unknown, or other
  misc_feature (91)..(91): Xaa is any aa, unknown, or other
  misc_feature (101)..(101): Xaa is any aa, unknown, or other
MGAGDGEVAASKDKASGGGAERTSLDGVRDKNVMQLKKLNTALFPVRYNEKYYQDAIASKDFSKLAYFSDILCWCDSLXALGEEGRRXQSXVYIMDLWVYXGTVSGVLGIGDKAAGINGGSNLSAKQKHLPRIYLAMVQTQPR

SEQ ID NO: 77572 - DNA, 801 bp, Zea mays
  misc_feature: Ceres CLONE 1562555
  misc_feature: Encodes the peptide sequence at SEQ ID NO. 77573
ctggagctccccgcggtggcggccgctctagaactagtggatcccccgggctgcaggaattcgtctcacccctagaaaaaaccgagaggaggaagcctgcccagtaccgcgtatctctctcctccctggttctcgtcccccccacggagtcgtcgccccctcgctttcaccgcacgcggaagcaagaattcgacgtcaaattcccagcttgcgcgtgtttctgtggatttcttaccgcttcgctgctcctgcctcctatgggcctttgatccgggcttcgtggatcttggaaagaggaggtgtggtgggcgcctcggcggcgatctagcggggaggagatggccagcgggaaggagccgatcgaggtcaggtttcggctctgcaaccgcacagatatcgggcctacgaagtacgatccctgcaccacagtgatcctcgactcaaggagataatcctcagctcggtggccgcagagataaggatatggctgcaagaactgtggatgacttgaagcttatcaatggtggaaggatattggagaataaccagacacttgcagaggacgcggtgccagtaggagagatcccaggtggtgtaattgcgatgaatgtggtagtgcgacctccactagctgagaaaacaagaagcagcttgccaattacccctagcagaacagatgtggatgcaccattctctgataaggcgtctgcttggagctgtagcatctgagtgtacacaccagattgtcgatggcgctttgctgagttcaacaagcatggattcgttctgacatcgattctt

SEQ ID NO: 77573 - protein, 81 aa, Zea mays
  misc_feature: Ceres CLONE 1562555
MAARTVDDLKLINGGRILENNQTLAEDAVPVGEIPGGVIAMNVVVRPPLAEKTRSSLPITPSRTDVDAPFSDKASAWSCSI

SEQ ID NO: 77574 - DNA, 816 bp, Zea mays
  misc_feature: Ceres CLONE 1562557
  misc_feature: Encodes the peptide sequence at SEQ ID NO. 77575
  misc_feature (356)..(356): n is a, c, t, g, unknown, or other
ggagctccccgcggtggcggccgctctagaactagtggatcccccgggctgcaggaattcgtctcacccctagaaaaagtatcttcctcctcaatagcacgtatgggtgtccccggatccaagccggcagacggggcgtagcagcggagaccacgagaacaaagatggacgccctcgtcgccgcgtctacggccgccttcgccgggaagccgcgcgcgagcctctccgtggcctgctccgccgccaccggcgacagcggcaacgtgtcgctcgcgtcctccgtggagaggttctgggacgcgctggcgctgtcgtcggtggtgatgtgctcgggcgggacctccgctccgggcgcnggcgccgacatcgcggggctgatcccgtgcaggtaggcaacgagttcgcttaatcacgagaagaactcgatcagtattctcagcgcctccctgagcaagtactcgcacgacagcgccgacgggctagcgatcaacggcagcatcgagaacaccatacgccagttagagaactacccaagttcgggcctggtgtggcgccccccatggtctgcagcacatcatcgggatctgctgacaggggggctggggacgagttcgtcatcgcgggccctgatcttcatgtacagtctcgggcgggatggagcggggtggacaggagccactttgtgatccatgaactgaaaagaaaaaaccccgccttgaagggagaataaaagtctaacttggaagttggccatccggcactcatatcccagggggggtggttcttggaccatttccccttggaacagggaaaccc

SEQ ID NO: 77575 - protein, 75 aa, Zea mays
  misc_feature: Ceres CLONE 1562557
MDALVAASTAAFAGKPRASLSVACSAATGDSGNVSLASSVERFWDALALSSVVMCSGGTSAPGAGADIAGLIPCR

SEQ ID NO: 77576 - DNA, 815 bp, Zea mays
  misc_feature: Ceres CLONE 1562559
  misc_feature: Encodes the peptide sequence at SEQ ID NO. 77577
ctccccgcggtggcggccgctctagaactagtggatcccccgggctgcaggaattcgtctcacccctagaaaaacgatcccgccgccggaggcgccatggtccccgctgccggatgcggcagcgtgtgggcgaacggcgccccccgcttcagcgacatggtctgggccaaggtgaagtctcacccgtggtggccgggccacatctacagcgtcagcctcaacgaccacgaggatgtgcactgcggctaccgctacaggctggtcctggtcgccttcttcggcgacaaaagctacgggtggttcgagcccagcgagctcgtccccttcgaggagcacttcaccgagaaggcggaccacggcggcatcacccgcagtagtttcgactgcaccgtggcggaggccatcgacgatgtagcccgtcacagcacgctagcgctgctctgcccgtgctagagccccgacgccttccgccccctccccagcgacggcgacttcctcctggtccatgtcccggcattcgacactgacgcgtgactaccgccccgaccagatccatgccacacgtgcagcggttcctgccacgtgaaggtgctcgactacctgctgggacacctccgtgactcagcaggacacagcggaaaaagcggcgcgcaccgtgcccggggatggagatggcctcactcgttctcgtgactacgatcgcgcagtgttctcacccatagataacagctacgcccagtcgttcgtgggtggatcactagctggcgcatgcctgcttagcagaatgcgcggcagatcgagctttacgagggatc

SEQ ID NO: 77577 - protein, 118 aa, Zea mays
  misc_feature: Ceres CLONE 1562559
  misc_feature (15)..(89): Pfam Name: PWWP Pfam Description: PWWP domain
  misc_feature: SWISSPROT Homolog: EC 2.1.1.43 Histone-lysine N-methyltransferase
MVPAAGCGSVWANGAPRFSDMVWAKVKSHPWWPGHIYSVSLNDHEDVHCGYRYRLVLVAFFGDKSYGWFEPSELVPFEEHFTEKADHGGITRSSFDCTVAEAIDDVARHSTLALLCPC

SEQ ID NO: 77578 - DNA, 826 bp, Zea mays
  misc_feature: Ceres CLONE 1562560
  misc_feature: Encodes the peptide sequence at SEQ ID NO. 77579
ctccccgcggtggcggccgctctagaactagtggatcccccgggctgcaggaattcgtctcacccctagaaaaaagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctccccgcacggcgtcaagttcggcgaggccgtctggttcaaggccggcctccagatcttcagcgaaggccgggctggactaccttggcaaccccagccctgatccaccgccaaaagcatcctccccatctggggcctgccacggtccgggcccatgggccccccgccaagggctacccttattttccgggggcccccctcgggcaagtctctccaaccccctttttaccctggggggaaaattttaaaccccccttgggcctggggcaaaaaaaaccccaaagggcctttccccaaaaactcaagggggagaaggaacccccaaaaaaaagccccccccccccccctttt

SEQ ID NO: 77579 - protein, 148 aa, Zea mays
  misc_feature: Ceres CLONE 1562560
  misc_feature (61)..(147): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSPHGVKFGEAVWFKAGLQIFSEGRAGLPWQPQP

SEQ ID NO: 77580 - DNA, 864 bp, Zea mays
  misc_feature: Ceres CLONE 1562562
  misc_feature: Pfam Name: Biotin_carb_C Pfam Description: Biotin carboxylase C-terminal domain
  misc_feature: SWISSPROT Homolog: EC 6.4.1.4 Methylcrotonoyl-CoA carboxylase
  misc_feature (323)..(323): n is a, c, t, g, unknown, or other
  misc_feature (633)..(633): n is a, c, t, g, unknown, or other
  misc_feature (745)..(745): n is a, c, t, g, unknown, or other
  misc_feature (783)..(783): n is a, c, t, g, unknown, or other
ctccccgcggtggcggccgctctagaactagtggatcccccgggctgcaggaattcgtctcacccctagaaaacttgtggagtggcaaatacgtgttgcgaatggagaacgactaccattatctcaggagcaggttccattaaatggacatgcatttgaagcacggatatatgctgaaaatgttccaagagggtttctccctgcaacaggaaccttacatcactaccgaccagtcccttctgacccaactgtaagagttgaaactggagtcgaagaaggagataccgtcagcatgcattatgatccaatgatagccaaacttngtagtatggggtgaaagtcgcacggctgcactagtcaagctaaagaagtgtttatcaacctttcagattgcaggtttgccaaccaatgttgatttcctccaagaactcgcaagccacagtgcctttgaaaaaggcctagttgacactcacttcattgaacgttataaagaattaccttttgagtatttctacaaagtcctcaaaagaatctcatggtgtagctgagcttggtgcaattttggctgctgcatgcatttgcaagaaggaacacattacatctaaagaatcactacgagccaacaagtcactnatctgtatggtacaataatccacctttcaggatgcatcactttgctaggcatcccctgggatcttgagttggaagagaatgatggattcagtgagaaaacttcttaaactgntcattactccataagtttgatggaagctacttcatcgnagacagaagatgggcacttcctggtttagatgtccaagttgatcacaagggtgacccacgatttttccgggtggaaatgtt

SEQ ID NO: 77581 - DNA, 1138 bp, Zea mays
  misc_feature: Ceres CLONE 1562564
  misc_feature (1123)..(1123): n is a, c, t, g, unknown, or other
cccgcggtggcggccgctctagactagtggatcccccgggctgcatgaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgcccccagcgtctatgtcgggggcccgtttacaatggggccccaccctcaagagcgttccccaaagcatatgggacgggccttatctccccaagttttttggcccgtttcccgaagaagaacccctcttaccagaccggccgagttccctggcgacttacgggggggacacccgggggcctcccccccccccctcgaaaaattcgggcgcccaccggggagctgggaggggattcactcccccctggggatataaccgggcccgccccgaggtggacgatgttcctgaaatacctccggcttcaaaaaagggcacttgaatttctcgggtagggcggggggttgttttcaagggccgtgggggccaaaaatctttcttccagaggggggcgggtggggaaattccctcttggggaaaccccccactccctgtggggcaggacaacatataaaccatcctagggcaccatttgggaccgccacactccgccggggtgggtccaattgggggcgttattctacgttaaaggagaaatatactcacgctctcgtggggagtcgctctactcgccctggaagaataagggttctgttatatacgaggggttctagtctctcgggaggggaggtctttatgacactccggtgcgtggggttcgttgaccgctgacaacatagatggatgatcgcgcccacgtcgactatttctctcggggtgtagtaggagacgctaagaagaggagcgcgtgcgcgctctgtgcgtgagatgtctatacacatttgtccgggtctgttgttactggtgagagaagagagactcaccccacgcgcgagagagagggctcgttatctagcatatatccgtatattgagaaactaggcctgtccacacatacgatctgtgcgaataagtgcncagctgggcgctgtg

SEQ ID NO: 77582 - DNA, 837 bp, Zea mays
  misc_feature: Ceres CLONE 1562565
  misc_feature: Encodes the peptide sequence at SEQ ID NO. 77583
  misc_feature (647)..(647): n is a, c, t, g, unknown, or other
  misc_feature (707)..(707): n is a, c, t, g, unknown, or other
  misc_feature (771)..(771): n is a, c, t, g, unknown, or other
ctcaccgcggtggcggccgctctagaactagtggatcccccgggctgcaggaattcgtctcacccctagaaaaaattcccattcccacccgtccatccatcctccgaagctcctcggcagacaagcagcagcgagagaaagcaagcaaggcagaggcagttgtgttgctggtcggtccgtccatggcgcccaagagaccagtgtcggcggcggcggcggcggagcagccgaggctgcgcggcgtgcggaagcggccgtggggccggtacgcggcggagatccgcgacccggtgcggaaggcgcgcgtgtggctgggcaccttcgacacgccggagcaggcggcgcgggcgtacgacgccgccgcgcgcaagctccgcgggcccggcgcccccaccaactaccccgccccggagccgacggcggaggcgttggcggaagctcccagcgcgagcgggagcgggagcgccgtggtgtacgagtcgtcgtcggcgtcggcgtcggcgtcgtcgtgctccctgccgctggcggccccgtcgctggaactcagcctggcgctgccggctgcggcggcggccgcagagccgtaccagctgttcgcggaaccggcggcggcgggcgccgtgacgccggcgctgctgcacttcttngcgccccagagcgaggagcagcagagctactctgggtcatcgtcgctgtcctcgtcgtcnccgtctgtaaggtcgacgcggcgccgcccctggggcctgcgctgggactcaactggcgctgcgnccgcccaaaatgtgaatgtgatgctgccgtcaggaggctaatccaatgctcagttaattagtcccc

SEQ ID NO: 77583 - protein, 209 aa, Zea mays
  misc_feature: Ceres CLONE 1562565
  misc_feature (16)..(67): Pfam Name: AP2 Pfam Description: AP2 domain
  misc_feature (155)..(155): Xaa is any aa, unknown, or other
  misc_feature (197)..(197): Xaa is any aa, unknown, or other
MAPKRPVSAAAAAEQPRLRGVRKRPWGRYAAEIRDPVRKARVWLGTFDTPEQAARAYDAAARKLRGPGAPTNYPAPEPTAEALAEAPSASGSGSAVVYESSSASASASSCSLPLAAPSLELSLALPAAAAAAEPYQLFAEPAAAGAVTPALLHFXAPQSEEQQSYSGSSSLSSSSPSVRSTRRRPWGLRWDSTGAAXAQNVNVMLPSGG

SEQ ID NO: 77584 - DNA, 1025 bp, Zea mays
  misc_feature: Ceres CLONE 1562574
  misc_feature: Encodes the peptide sequence at SEQ ID NO. 77585
  misc_feature (399)..(399): n is a, c, t, g, unknown, or other
  misc_feature (778)..(778): n is a, c, t, g, unknown, or other
tccccgcggtggcggccgctctagaactagtggatcccccgggctgcaggaattcgtctcacccctagaaaaaaccatcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtcggccgaccccgagaccttcgncaagaaccgcgagctggaggtgatccactcccgctgggccatgctcggcgcgctcgggttgctcttccccgagctgctctcccgcaaacgggtcaagttcggcaaaggccctctagtttcaagccgggctcccaatatttcacaaagggggggcgggaattacctgggcaacccccagccttgtcccccccccaaaaaatccctccccccatttgggcccttccaaggtttggctcttaggggccccccccaagaggcaccccttatttcgggggggggccccccctcggggaaggttctccaacccctcttttaccccgggggggggttttttaaccaccccttggggtggggaaaaaaaaccaagggtttccccccntttctgggggggagaggcttcaaaagcccccccccccccatttttttcagagggggtcttctcccccgacaccctccccccggggggggcgcccccaaaaatttttttaaacctcttgtgaaaaaaaaaaaagaggggggggtgccacatattttttcccgaaaaaaaaaaaggggggtggtgatatttttttttttttaaagaaggaggcccccccataattttatcaaccaaaagtttttttttt

SEQ ID NO: 77585 - protein, 281 aa, Zea mays
  misc_feature: Ceres CLONE 1562574
  misc_feature (61)..(221): Pfam Name: Chloroa_b-bind Pfam Description: Chlorophyll A-B binding protein
  misc_feature (89)..(89): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFXKNRELEVIHSRWAMLGALGLLFPELLSRKRVKFGKGPLVSSRAPNISQRGGGNYLGNPQPCPPPKKSLPPFGPFQGLALRGPPQEAPLISGGGPPSGKVLQPLFYPGGGFFNHPLGWGKKTKGFPPFLGGRGFKSPPPPIFFRGGLLPRHPPPGGGAPKNFFKPLVKKKKEGGVPHIFSRKKKRGVVIFFFF

SEQ ID NO: 77586 - DNA, 867 bp, Zea mays
  misc_feature: Ceres CLONE 1562576
  misc_feature: Encodes the peptide sequence at SEQ ID NO. 77587
tcaccgcggtggcggccgctctagaactagtggatcccccgggctgcaggaattcgtctcacccctagaaaaaacctcccaactccagaagtcctccctagacgccgccagccgcgcgcacacccaccgagagctcctcgggctttctttctccgttcctccctcgcgcgctcagggtttcacgatggaggccgaggcggcggccaagagggcgcgggagggcggggaggacgccaccgcgccggtggcgggggccgaggcggtggtcgccggtgctggcgagcaggcgggaatctccgccgtcatcccaggatgggttctccgagatcagcccccatgtggccccggtgaggcgcactccttgaaggtggagaaggttctgttcccgggcaagtcaaacccccacaatgtgatggtttttccgtcctcccccaacgggaaagggccttggtctccaagggattatttccggtggaaaaaaggggattaaggggcccctacccaagagaaggaatatcccccccgggccccttttgctcccttccaaaaaaccccccaaaaaggggggtttggtttttttggaagggggggggggaaattgttcttctccctctaatcctctcatcaatgatctcgcggtaattacttctccggttgtggttccaatcttggtcttttttttgctacagcgggccatataggctggttaaacgggtggtacgggtggttaactttcccccggggggggctccaggagagagtgtatgttgtgccgccggcccagtgcgtttcgcggttgttttggccgcgctcgtggtgttgtattctccccactactctttatgggtgaaggggtggtggattttt

SEQ ID NO: 77587 - protein, 101 aa, Zea mays
  misc_feature: Ceres CLONE 1562576
  misc_feature: SWISSPROT Homolog: EC 2.5.1.16 Spermidine synthase
MEAEAAAKRAREGGEDATAPVAGAEAVVAGAGEQAGISAVIPGWVLRDQPPCGPGEAHSLKVEKVLFPGKSNPHNVMVFPSSPNGKGPWSPRDYFRWKKGD

SEQ ID NO: 77588 - DNA, 868 bp, Zea mays
  misc_feature: Ceres CLONE 1562580
  misc_feature: Encodes the peptide sequence at SEQ ID NO. 77589
agctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggccccccgcggacccggagacgttcgccaagaaccgggagctggaggtgatccactcccgctgggccatgctgggcgcgctcggctgcgtcttcccggagctgctcgcccgcaacggcgtcaagttcggcgagggcgtgtggttcaagggccgctcccagatcttcagcggagggtggactggactaacctcgggaaaccgaagcctatcccccgcgccaagcaaccctcgccatcttgggcctgccaggtccgtgctcatggggccccgttaaggggctacccacttccccggggggcccgctttggggaagggcgttcaaccccgctttattcccgggggggggcttttaaaccggctgggcctttgcccaaaaaaccccaagggtttttttttaaggtctcagggggaaggagagctcaaaaaaggggccccccccccccagggttctcaatggtttccggaatcctcc

SEQ ID NO: 77589 - protein, 174 aa, Zea mays
  misc_feature: Ceres CLONE 1562580
  misc_feature (65)..(166): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGPPADPETFAKNRELEVIHSRWAMLGALGCVFPELLARNGVKFGEGVWFKGRSQIFSGGWTGLTSGNRSLSPAPSNPRHLGPARSVLMGPR

SEQ ID NO: 77590 - DNA, 1085 bp, Zea mays
  misc_feature: Ceres CLONE 1562581
ccccgcggtgccggccgctctagaactagtggatcccccgggctgcaggaattcgtctcacccctagacaaaacacaagtcacacgcactcccgctagcccccttcccccgtcccgcccgtaccttcctccgtcgcctccgtcctctttcctaccgtgggcagcaggcaggcccaactatctgcagtagattggtggagaggaagaagacggcaggcaccctcgcagatcaaacgtgctccgccacccttggtttcggcgaatcggcgccgtacgccgtatatcgaaccgtctccgagcagatcgacgcgctgtcttgcaattttgacccttttcgggctaatcgacgtccagagctgccagttgacccatcttcgacgttgacttcggcttgcccttgccgcggaggggcccaagttccgccctttctcgtggaaacctccttggataaacctgatggcctattcccggaaagcttttgtttgattccgggggtcctgggaaaatggggggctgttctttctgggggggggctccttttgccccccaatacccaaaactttgcttgcccgcccccttttgaggggcctccgggctttttccgggttgggggcccccgccctctctctggaaaaagatatccccctgggggggggcgccccccaatatttttggggggttccctttcttggaaggacaatctccaatttttttttctgtcccaaagaacatttctctgggtgtcagagatgtgttttctcttaaaaaactgattttgtgctctttcttggaaacaacaaattcttggggggggggccccctgtggtccctcctaaaaataaacccgtgtttcttgggggggtttctcccgggttcttcttttgcccctctttgcggggaaacagaatttttccccttgaaaaatttttctccccccttgtgggtggataaagccctccaaaaacccccacgtgtttttgtttttcccccgggggtttaaaaaaggggcctctgattcataaagaaattccgggttgtttcttgcgcaaaaacaacccccccctttttttgtgggggacaaaaatg

SEQ ID NO: 77591 - DNA, 820 bp, Zea mays
  misc_feature: Ceres CLONE 1562584
  misc_feature: Encodes the peptide sequence at SEQ ID NO. 77592
  misc_feature (588)..(588): n is a, c, t, g, unknown, or other
  misc_feature (742)..(742): n is a, c, t, g, unknown, or other
ctccccgcggtggcggccgctctagaactagtggatcccccgggctgcaggaattcgtctcacccctagaaaaaatgtggtcggggagacggggactcggggtagcgactagcgagccgaggagcgcgcgcgcgcgatggcggccgctgccgtggcgaccgtggcctccccaccccccgctgcctccaggcgtatgctcccctccgccgcaccgtctttcctccggctcccgaggccgaccagccggctccggcgcgccacgcaggtcgccgcggcggggggagaggcggacgtgctgcctggtccgggggccgagggtgaggcggcggttccggggaggctggaggagcagcgggacgagccgctggcgggaagccagctcgacatcggagggctcgccttccagggcgacgtcgtgcgggggtttcaccggcggcggagcgggctccggggcctccggcggtggcggcgacggcaacaagatgctggaccggggcatcaatacggccatcgttcttgcggccagcacctacgcgctcaccaagctgctcaccgtcgaccaggactactggcatggggtggacgatnctttgagatcctgcgctatatgccggagcacatctggtccgcgtacgaggaggccctcaaagctaacccggttctagcaagatgatggatcagtggtgtcgtctactcccttgggtgactgggattgcacagtgctacgaaggcaaaccaatcntttgatttcgaccgtgcctcggatgttccgggtctggtccttggtgggttcaccgctttcatggggtcacttgtcact

SEQ ID NO: 77592 - protein, 178 aa, Zea mays
  misc_feature: Ceres CLONE 1562584
  misc_feature (151)..(151): Xaa is any aa, unknown, or other
MAAAAVATVASPPPAASRRMLPSAAPSFLRLPRPTSRLRRATQVAAAGGEADVLPGPGAEGEAAVPGRLEEQRDEPLAGSQLDIGGLAFQGDVVRGFHRRRSGLRGLRRWRRRQQDAGPGHQYGHRSCGQHLRAHQAAHRRPGLLAWGGRXFEILRYMPEHIWSAYEEALKANPVLAR

SEQ ID NO: 77593 - DNA, 844 bp, Zea mays
  misc_feature: Ceres CLONE 1562585
  misc_feature: Encodes the peptide sequence at SEQ ID NO. 77594
ctccccgcggtggcggccgctctagaactagtggatcccccgggctgcaggaattcgtctcacccctagaaaaagaaaaacccacctcgcgaacgaggacgaactgctacccccctcgcctcgccctcgccgcctcctctcccgttcccccaccaaccgcagcagcgagagcgagactgagaatggccgcggcgccgtcgtccctcgtgtcctcccatctctctcgcctcgccgacctccgccgcgcggcggcgccggccactcccaccgtcccacagcagcttcgcgtcggctgctcgcgccgccgcgcccagcgcgtcgtcgccatggctggatccggcaagttcttcgtcggaggcaactggaagtgcaacggaacaaagtactccgttagcaagcttgtctctgaactgaatgctgctaccctcgaaactgatgtagatgttgtggtggctcctccattcatctatatcgatcaggtcaagaattcactaacgggtcgcattgaggtttctgctcagaatgtgtggattggaaaaggaggagcctacaccggagagatcagtgcagaacaactggtggacatcggttgtcaatgggttattcttggacactcagagcgtagacatattattggtgaaaatgacgagtttattgggaagaaagctgcatatgcattgagccaaaatgttaaggttattgcctgcataggagagcttctggaagagagggaagcaggcaaaacttttggaaggatgttttgagcagatgaaagcttttggcaataggatttcaacttgggccgaatgtgggattgcataccagccctgtttggggctatgga

SEQ ID NO: 77594 - protein, 193 aa, Zea mays
  misc_feature: Ceres CLONE 1562585
  misc_feature (55)..(193): Pfam Name: TIM Pfam Description: Triosephosphate isomerase
  misc_feature: SWISSPROT Homolog: EC 5.3.1.1 Triose-phosphate isomerase
MAAAPSSLVSSHLSRLADLRRAAAPATPTVPQQLRVGCSRRRAQRVVAMAGSGKFFVGGNWKCNGTKYSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFGRMF

SEQ ID NO: 77595 - DNA, 918 bp, Zea mays
  misc_feature: Ceres CLONE 1562586
  misc_feature: Encodes the peptide sequence at SEQ ID NO. 77596
ctccccgcggtggcggccgctctagaactagtggatcccccgggctgcaggaattcgtctcacccctagaaaaaagtgcagacgcagcgcatgcaggtagcaatggcgggggagacgaagaagggcctggtgctgctggacttctgggtgagcccgttcgggcagcgctgccgcatcgcgctggcggagaagggcatcgcctacgagtactcggagcaggagctgctgggcggcgccaagagcgacatcctcctccgctccaacccggtgcacaagaagatccccgtgctcctccacgacggccgccccgtctgcgagtccctcgtcatcctcgagtacctcgaggaggccttcccggaggcctcccccaggctgctccccgacgccgcctacgcgcgcgcgcaggcccgcttctgggcggcctactccgacaaggtctacgaggccggcacgcggctgtgggagctcaggggcgacacgcgggcgcaagcgcgcgccgagatcttggcagtgggtcggaacctcgacggcgagcttaggggacaagccttcttccgcggcgagggcgttcgggttccgtgacctggcgctcgtgccccttctggccctgggctccccagcttcgagcggtaccggggacttcagcgtggggggaaatcccgcccagccttggccgcttggggcccccccgtgccccgcaccggggaaacggggccgggacccttcaccccccgaaaagggggaccaattcctcaaccggctcaaaaaaccttcgggctctcagtgtaaaacggacctctctttccaaagagatgtgtccggccgtacttactgggcttgcctgcatttttgtgttcggtttgtttaccgggaccccggagggggggaacccttcttggggcccgggggtaatacact

SEQ ID NO: 77596 - protein, 159 aa, Zea mays
  misc_feature: Ceres CLONE 1562586
  misc_feature (7)..(82): Pfam Name: GST_N Pfam Description: Glutathione S-transferase, N-terminal domain
  misc_feature: SWISSPROT Homolog: EC 4.4.1.5 Lactoylglutathione lyase
MAGETKKGLVLLDFWVSPFGQRCRIALAEKGIAYEYSEQELLGGAKSDILLRSNPVHKKIPVLLHDGRPVCESLVILEYLEEAFPEASPRLLPDAAYARAQARFWAAYSDKVYEAGTRLWELRGDTRAQARAEILAVGRNLDGELRGQAFFRGEGVRVP

SEQ ID NO: 77597 - DNA, 826 bp, Zea mays
  misc_feature: Ceres CLONE 1562588
  misc_feature: Encodes the peptide sequence at SEQ ID NO. 77598
ctccccgcggtggcggccgctctagaactagtggatcccccgggctgcaggaattcgtctcacccctagaaaaaattcacgccccgtggcagcgggcagcggctcggacagcgctcattcagttcgtcacggacttgcagatctgaggatttgggccgtaagggtactagagccggcgccggcggttacctggggcggccgccccacctcgctgttacggtaggtgcgtccctaacctcgaagcttcgacgcaagaggcggtgaatccaatggcgggcgaggaagagctcactgtaggcggcggcgtgcccatccggccgccgcggctggaagacgcggggctcgaggactgcgcgctcccgccggagtctatcgctgaggcattctccctcgctgccgcggccgtctcctcccgcctcgcccggctgcccttctccgaagactccgacgaggaggactgcgtctcggcaccacgcggaggaggctgcgtggatgacgccggactcgactgcggggccgcccccgtcgccctcgtcggcggcggcgttgcgggcgtcggcagcgtcgacgaagtcgtggtcgtccggcggaggacgcggaggcggatacgaggacgcggttagtggtcggtgggcgcgcagaagaagaggatacaggtcgtggtggtcggggaacagcccagggacagggagaaaagctggggaaggatgatggatgtggtccagggggtgccaaaaaaggggtcagtgaacccagacgggcgcaaggcgatgtatgagggcgaagaggcggcattatattgcgatcttggtgccagatttcgact

SEQ ID NO: 77598 - protein, 117 aa, Zea mays
  misc_feature: Ceres CLONE 1562588
MAGEEELTVGGGVPIRPPRLEDAGLEDCALPPESIAEAFSLAAAAVSSRLARLPFSEDSDEEDCVSAPRGGGCVDDAGLDCGAAPVALVGGGVAGVGSVDEVVVVRRRTRRRIRGRG

SEQ ID NO: 77599 - DNA, 1302 bp, Zea mays
  misc_feature: Ceres CLONE 1562591
  misc_feature: Encodes the peptide sequence at SEQ ID NO. 77600
  misc_feature (31)..(31): n is a, c, t, g, unknown, or other
  misc_feature (36)..(36): n is a, c, t, g, unknown, or other
  misc_feature (759)..(759): n is a, c, t, g, unknown, or other
  misc_feature (841)..(841): n is a, c, t, g, unknown, or other
ggcgttgtgccgttgtttggtagctctcttncttcncctctcctttttctttttttttttcaaaactggaactcaccgcggtggcggccgctctagaactagtggatcccccgggctgcaggaattcgtctcacccctagaaaaagccgcggggctccagcttcaaccacaccgtacttctactccatggtcggccgcagctccaacttcgccgccggggacgcgttcggcctgcgcacgggcgccacgcccaggccgtccaaagacgaggaggacccgcagggcaaggcgaacaagtacggccagtacccggcgcccaacccggccatggcggcgcagcccgccaagggcctcaagaaggcggccaatgggcaggccaagggcgaggacggcaaggacctacacatgttcatgtggagctccagcgcgtcacccatgtccgacctgttcggcaatggcgccgccgagtacaacaacgcggccgccgtctaagaagtccgcatggccgtcagcctccccgcgcaaaagttgcggcggaccggtaggaatgaacctgggccaaggaacttcgcgggagcggggaacgacttcaagcttccgggaaacagggggctccggccagaaaaagggaactcgtgaaagccgggcgaacccataaaagccagtcgtgccggccagctttgccggctctccccaagggggtaaattcaaaggccgcccgttgggcctggccgcccccgccgtggcggatgtgaccancccgcaacccaagcccggggtaatgataaccctcgggccctggaatcccgctcccaattcacatgggcggtgtgtggcgccntatctaaaaactgctcatgtcccggcgttgagaccacgcccaatatatacacgtataaattcgccagagggcctgtcaatatacgggtcgccttaaagtcatgggggtgtacacccatcccgtctccgtgggtgtataacggaggtggcgaaacaccctcgacagtaaatcgcctgtggcgacattacctcctctttaaaagtggcagccttctattccggtaccactcctctctgaacacgatcgggtggatctcgctgcatatgtctctaagagattctctatccccccgtggcgtgtgttatattgggggctccttcctgacgccccgagataaacactccgcggggcgggagaaaaacaaggtgtggtgaccgtgtattctcgagaggagacgtcgtggcggccttaaaccagcctcgcgacctctttggtcgcgccaccccttccttgtttgtctc

SEQ ID NO: 77600 - protein, 101 aa, Zea mays
  misc_feature: Ceres CLONE 1562591
MVGRSSNFAAGDAFGLRTGATPRPSKDEEDPQGKANKYGQYPAPNPAMAAQPAKGLKKAANGQAKGEDGKDLHMFMWSSSASPMSDLFGNGAAEYNNAAAV

SEQ ID NO: 77601 - DNA, 1219 bp, Zea mays
  misc_feature: Ceres CLONE 1562593
  misc_feature: Encodes the peptide sequence at SEQ ID NO. 77602
  misc_feature (743)..(743): n is a, c, t, g, unknown, or other
  misc_feature (1006)..(1006): n is a, c, t, g, unknown, or other
  misc_feature (1021)..(1021): n is a, c, t, g, unknown, or other
  misc_feature (1078)..(1078): n is a, c, t, g, unknown, or other
gtgattgcgggctagatttatttgaaaaagaaaagcccactcttttttgattgtatttttttttttttttttttacaaactggagctcaccgcggtggcggccgctctagaatagtggatcccccgggctgcaggaattcgtctcacccctagaaaaagctgcgccgcctcactattgactgtcggattccccactcgccggcgacaaccgccgcgcccgatccgtctgctaggtcttgcacctccgggctctggccatggctgccgaagctggcccaatctccaaggtcctcatcgtcgtatcgatgcagacggaggcgatgccgctcgtccacaagttcaagctcgtcgaggtgcccggccaggaatccacatttcctaaaagtgccccatggggttaggtaccatgggtaactacaaaggcctccacattcaaccccgcattgcctgggaaaggatgctggttttagaagttgcacccacccccaacgggattctgcgagctccttttgactaggtttttccctttccaaacctttgaagcccagcaccgtgaccccttaaatgcctggcccctgtctggggggggctttccaaggctcaaaagggggcaaagcccattcggaagaaatttattttcctggggcatttcagaaggggtttcctattccccctgggaaacggtgagtgaaagaccaagaatcgcgcgggtctttttcggacaccttcttatggaagaaatntttgcgggggtactcctagaaaaaaacagttttctagcccacgtttctctctatagcaagaacgatctacgtcatgcgggagagcgctagcaagtattttaggtaatcgattatgggacgcaaatattgtgtgaatgcagaacctgcaggggagacgtgctgttgtggtggatctatcggtcgtgccgctccgagacttacgtctgacgaagagggtcagtcatagtgtatgagaaaaatagtgatagtggataatgctcganataatctctacaaanagcagaaggagtgacacgttccgccctccaactacgatctgtgatcgcgctactctncagcgcgatagtttactgcccgccgccaccagctcaactctgaagtcgggataagagtgagaactcccgttaacaataacggcctgtgctggtagggacaaaactaccgtcaccacctcgtcggaagaatgtccgtcacag

SEQ ID NO: 77602 - protein, 47 aa, Zea mays
  misc_feature: Ceres CLONE 1562593
MAAEAGPISKVLIVVSMQTEAMPLVHKFKLVEVPGQESTFPKSAPWG

SEQ ID NO: 77603 - DNA, 884 bp, Zea mays
  misc_feature: Ceres CLONE 1562594
  misc_feature (494)..(494): n is a, c, t, g, unknown, or other
tggagctccccgcggtggcggccgctctagaactagtggatcccccgggctgcaggaattcgtctcacccctagaaaaaatccacttcgcccgcccgcccgctgcctgactgccattattgcctcccggtcttcgctgtccatccgaccgtccgtggtttctccctccggtccccgctacccgccccgccccgccgagaagcttcggactagctagcaagctagctagctacctacccgtgctttggttcggttggttggcgccatagccattgccgaggagcgagggagcagccgggcgggcagtcaggaggcggcgagtaagcatgctgggagcgagccccagggcaggaaggccgccgcgccgccggtgaagctggggtcggcgaaggaggcgccggcggccggtggaggagggagcggctgcaaggtgccggcggaaagaggttgtgggaggtgcggccccggcgggatgctggtgcagaagaaggggcnggcggcgaacgacgaagcgtcgcccaacgtggaagcccgtgccccaccatcccgggtcaagggtcaagcaccgccgggcgtcaccgcacgaagatgtacatccagttcccaaggccttcccttcgggggaactaaaaaaaacctgggtggccccccaaaaaagggggctggccccccgaagaaacaaaaagggggctggtaaaagggccaggggaaccggtgactcccaagggggttcccggggaaccgggctgtggggtcaaaaaaccgttccccaaagggggtgggggtccctggaaaaaaccccaaagggccccggggggggccgaattatttttgggggagggcccccaaagggcccctcccttcaaaaaggggcggcgggggggc

SEQ ID NO: 77604 - DNA, 786 bp, Zea mays
  misc_feature: Ceres CLONE 1562595
  misc_feature: Encodes the peptide sequence at SEQ ID NO. 77605
ctccccgcggtggcggccgctctagaactagtggatcccccgggctgcaggaattcgtctcacccctagaaaaagcgtgcccagtgtctgacaacgcgccccaaccccaaccccaacccagcggtcccagtcccccctccgttctctctgcactctgcagctgccggtgccggccatggcgcgcgccccgagctcgtggacgccgtccctcgccatggtgctcctcgtcgtggccgccgcggccgtggtcgcgtcgtcggaggcggccagggtgcccgccgccgtcggcaactggacgggggaggagctgcgcggggccgcggcgaggcggggcggccggcgctcccggcgccgcgcgttcgagaacggcctcggccggacgccgcagatggggtggaatagctggaaccacttcggctgcgggatcaacgagaacctcatcaagcagacagctgatgcgctggtcaacaccggtctggcgaagctgggctacgagtatgtcaacatagatgattgctgggcggagtctgacagggactaccagggaagcttcgttgcaaacagacaaaactttccctctggcatcaaggcgctcgcggactacgtgcacgcccaggggctcaagcttggcatctacagcgatgctggggacacggacgtgcagccagaaaatgcccagggtcacttgaccaccagggagcaggacgtgaagaccttctcggtcctggggggatccgattatctgaaataccaaaaactggcaacgacgcccgggaggaagcgtct

SEQ ID NO: 77605 - protein, 203 aa, Zea mays
  misc_feature: Ceres CLONE 1562595
  misc_feature: SWISSPROT Homolog: EC 3.2.1.22 Alpha-galactosidase
MARAPSSWTPSLAMVLLVVAAAAVVASSEAARVPAAVGNWTGEELRGAAARRGGRRSRRRAFENGLGRTPQMGWNSWNHFGCGINENLIKQTADALVNTGLAKLGYEYVNIDDCWAESDRDYQGSFVANRQNFPSGIKALADYVHAQGLKLGIYSDAGDTDVQPENAQGHLTTREQDVKTFSVLGGSDYLKYQKLATTPGRKR

SEQ ID NO: 77606 - DNA, 895 bp, Zea mays
  misc_feature: Ceres CLONE 1562596
  misc_feature: Encodes the peptide sequence at SEQ ID NO. 77607
  misc_feature (862)..(862): n is a, c, t, g, unknown, or other
  misc_feature (863)..(863): n is a, c, t, g, unknown, or other
  misc_feature (865)..(865): n is a, c, t, g, unknown, or other
  misc_feature (867)..(867): n is a, c, t, g, unknown, or other
ctccccgcggtggcggccgctctagaactagtggatcccccgggctgcaggaattcgtctcacccctagaaaaaacacgctcgcgattcaacaaagacgtacgtacatgcacaaaactagagcgagctgtgtgtgtgtgtgttcgtcatttcctcgatcatggcgaaggcgcaggcgcaggtggcggcgaggttcatgatggaggcgccgccgccgcaggtggtgtcggtcatgcggcggaggaaggcgccgaggagcctgagcaccatcgccgaggacgacagggagatgctggcgccgtgcgggtcaccgtcggaccacggccacgtacatacacataactagagcgagtagagataccgtctcttactgtgtgtgtgtgtgtgtgtttatcaactcctcgatgcatggcgaaggcgcaggcgcaggtggcggcgaggttcacgacggaggtggcgccgccgcaggtggtgtcggtcatgcgacgaaggaaggggccgaggagcctggacaccatcgccgaggacgacagggagcagcagctggcgtgcgggtcgccatcggaccacggcctcgcgacggcgtggtcgtcgctccagaggataccgacgccaccgcagccgccgcgtgagcgcgcaagtgggtcccttgaccagggaaccccacaaaaaaatctttggaacccccccgggtcccaaagacacagttggggggggggggaaaaacttttgtccccccccacaggtgtcggcgggggggggggttttatttatatttttgtttttttattgaaaaaaaaaaaaaaaaaaaaaacaccccccccccccggcgggggggggggaagaaaatatttttataattnnangnccgccctgcgttcttctcttttcttttt

SEQ ID NO: 77607 - protein, 61 aa, Zea mays
  misc_feature: Ceres CLONE 1562596
MAKAQAQVAARFMMEAPPPQVVSVMRRRKAPRSLSTIAEDDREMLAPCGSPSDHGHVHTHN

SEQ ID NO: 77608 - DNA, 825 bp, Zea mays
  misc_feature: Ceres CLONE 1562600
  misc_feature: Encodes the peptide sequence at SEQ ID NO. 77609
  misc_feature (552)..(552): n is a, c, t, g, unknown, or other
  misc_feature (636)..(636): n is a, c, t, g, unknown, or other
  misc_feature (637)..(637): n is a, c, t, g, unknown, or other
ctccccgcggtggcggccgctctagaactagtggatcccccgggctgcaggaattcgtctcacccctagaaaaacaaagctctggagcccttcttcagcgcagctgctactcagtttatccttggacagcaagttcccttctctctgtggctttctcttgcccctgttgtcatcggtgtttcaatggcatcccttactgagctctcattcaactggactggcttcatcaatgccatgatatcaaacatctcattcacctacaggagcatttattccaagaaagccatgactgacatggatagcaccaacgtgtatgcttacatttcaataattgctctcattgtttgcattccgcctgcagtgatctttgaagggccccggctaatgcagcatggattcagtgatgccattgcaaaagtaggcttgacaaagtttgttagtgacctattcttggttggactgttctaccatctgtacaaccagattgctacgaacaccttggagcgagtggctcctctgacacatgctgtgggcaatgtgtttgagcgtgtngttgtcattggctctcaatcgtttgtttttggcaacaaaatagcacaccaactgggattggcacgtcccatgccaatagctggnngttgctatgtacctcttacataaagcctttaaattggaaggggaaaaaaaggaaaaagagccccatggatgaccctaactggcctgaaaaaatttttaccttccggcgtcggggaaacaaaaaaaaaattgttgaaaaaataaaaaattagcccttgtttttggaaaaaattccccttgaggccccct

SEQ ID NO: 77609 - protein, 158 aa, Zea mays
  misc_feature: Ceres CLONE 1562600
  misc_feature (13)..(157): Pfam Name: TPT Pfam Description: Triose-phosphate Transporter family
  misc_feature (152)..(152): Xaa is any aa, unknown, or other
MASLTELSFNWTGFINAMISNISFTYRSIYSKKAMTDMDSTNVYAYISIIALIVCIPPAVIFEGPRLMQHGFSDAIAKVGLTKFVSDLFLVGLFYHLYNQIATNTLERVAPLTHAVGNVFERVVVIGSQSFVFGNKIAHQLGLARPMPIAGXCYVPLT

SEQ ID NO: 77610 - DNA, 810 bp, Zea mays
  misc_feature: Ceres CLONE 1562601
  misc_feature: Encodes the peptide sequence at SEQ ID NO. 77611
  misc_feature (445)..(445): n is a, c, t, g, unknown, or other
ctggagctccccgcggtggcggccgctctagaactagtggatcccccgggctgcaggaattcgtctcacccctagaaaaaaccacagtatcagagtagcagcatctttgaggacgccactccggaggaagtgagggacttcttcggggacgacgagttccgtgtgtccaacaagtgggacgacatgcttgtttaccataagacgctggaggagtgccagaccaccgggacgatgaaagtgcattgggtccggaagttccccttcttctgcagtgacagagagtacataattgctcgccggatatggaaactggggggcgcctattattgtgtcacaaagggtataccatgctcgtccattccacggcgcaacaaacctcgaagagttgatctgtattattcaagctggtgcatccgtgcagtggaatccaggagagggaacgganggtcgacagcttgtgaggtgctctttgtccacccacgagacatgggcatcccgtacgagatcgcaaagctcggtatcgggcaagggatgttggggatgcctggagaagatcgagccctgggctcggggcctatcaacaaaccagggctgcaaggggacccgtgtccacggattgccctgatggcccagatccaacccaaaatcggcaacagcttttgtcgggcccctggatcccaaaaccaacgggtcccaaaccctgaaaccgaaaaaaaacccggccaaggacccggggggggaaggttcctttgcttttggggggggatttttctttggcccctttctcttgaaaaaagggtccttgaaaaa

SEQ ID NO: 77611 - protein, 209 aa, Zea mays
  misc_feature: Ceres CLONE 1562601
  misc_feature (88)..(88): Xaa is any aa, unknown, or other
MLVYHKTLEECQTTGTMKVHWVRKFPFFCSDREYIIARRIWKLGGAYYCVTKGIPCSSIPRRNKPRRVDLYYSSWCIRAVESRRGNGXSTACEVLFVHPRDMGIPYEIAKLGIGQGMLGMPGEDRALGSGPINKPGLQGDPCPRIALMAQIQPKIGNSFCRAPGSQNQRVPNPETEKKPGQGPGGGRFLCFWGGIFLWPLSLEKRVLEK

SEQ ID NO: 77612 - DNA, 936 bp, Zea mays
  misc_feature: Ceres CLONE 1562606
  misc_feature: Encodes the peptide sequence at SEQ ID NO. 77613
ctccccgcggtggcggccgctctagaactagtggatcccccgggctgcaggaattcgtctcacccctagaaaaaatcttcctcctcctcacctaactctgacctctcgtcgtcaaaaaaagaaggccttcgccgaccatccgaaagataggggtctcggtactgccttacctcgggggctcaaacctttcccccttcaccacaattccctcggctggccgccgctccatccggtacgacgacaccatgagggagggcatttcgatccacatcggccaggccggtatccaggtcggaaacgcgtgctgggagctgtactgccttgagcatggcattcaggctgacggtcaaatgcccggtgacaagaccattgggggaggtgatgatgctttcaacaccttcttcagtgaaactggggctgggaagcacgtgccccgtgctgtttttgttgaccttgaacccactgtcatcaatgaggtgaggactggcacctaccgccagctcttccaccctgagcagctcatcagtgggaaggaggatgcagccaacaactttgcccgtggtcactacaccattggcaaggagattgttgacctatgccttgatcgcatcaggaagcttgccgacaactgcactggtctccagggcttcctcgtcttcaacgctgttggtggaggaacgggctctggccttggttccctcctcctagagcgcctgtctgttgactacggcaagaagtccagcttggggtcctgtgtacccttccccccagtttctacttcggtagtggagccatacacagtgtactgtccaccactcccctctcgagcaactgatgtggctatctgctggaaaatgagccttctagaaatttgcggcgatcccttgatttgagggcaacttaaccaccttaaaagctttggtccaagtatccacc

SEQ ID NO: 77613 - protein, 215 aa, Zea mays
  misc_feature: Ceres CLONE 1562606
  misc_feature (49)..(211): Pfam Name: Tubulin Pfam Description: Tubulin/FtsZ family, GTPase domain
MREGISIHIGQAGIQVGNACWELYCLEHGIQADGQMPGDKTIGGGDDAFNTFFSETGAGKHVPRAVFVDLEPTVINEVRTGTYRQLFHPEQLISGKEDAANNFARGHYTIGKEIVDLCLDRIRKLADNCTGLQGFLVFNAVGGGTGSGLGSLLLERLSVDYGKKSSLGSCVPFPPVSTSVVEPYTVYCPPLPSRATDVAICWKMSLLEICGDPLI

SEQ ID NO: 77614 - DNA, 791 bp, Zea mays
  misc_feature: Ceres CLONE 1562607
  misc_feature: Translation starting site: 100
ggagctccccgcggtggcggccgctctagaactagtggatcccccgggctgcaggaattcgtctcacccctagaaaaagttctacgagcaggcgtgctcatggagcccacgccagcggcgccgcgcttcctcctgctgtgcccggacactgccgtgcctacgcgggcggtcgagcctgggcggacgcgccgcatcaccgtggccgcgcccgcgctcccaccggccgcgctgcagcgtggcgctggcgtggtgctcttctaccgcgaggacgccgctggcgcggacgggcgggcctcggtgcagctgtgggaggaggcgatgtgggcgaaggagtcgctgagcgaggccgtggccgaccacccggagatgggcggccagctccagcgccacgtcgacaggtcctgcgaggtaaagctgaactacgccgagcgtgtgattctcagaggccacggctgatgcgactctcgacgagttcctggcaaccgcccatgacaaggaccgggcgcctagctgggaggccgccctggcgccgtgtgccgacgtgaacgcggatgaccccgacgtgagcgcgctcgtctacttgcagctgacacggttgccgggagactgaagcttcgccgtgggcgtaagctgcagcctgatgctgtccgacccgctgtccctggcgagggtccttggcctctgtggcacgcacgcaccccagagatgatggctcagtaagatgccggccgcacatgggatgatgcagtacgcgtgctacattcggctgccttgaccccaggggcgcacgc

SEQ ID NO: 77615 - DNA, 844 bp, Zea mays
  misc_feature: Ceres CLONE 1562608
  misc_feature: Encodes the peptide sequence at SEQ ID NO. 77616
ctccccgcggtggcggccgctctagaactagtggatcccccgggctgcaggaattcgtctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagatgtcaacgtcgacaatttcttcgctgttctgcttggcaacaaaactgctctcaggggtgggagcggcaaggttgtggacagtggccccaatgatcatatatttgttttctacagtgaccatgaggggcctcctgcgaatgacataaatgtgtatgcgaccaccgcgtcaaatgcagaggagagtagctgggggacgtactgccctggcgagttcccgagcccttcaccggagtatgacactttgctgggagaactgtatagtgttgcttgggatggaagacagtgattcccacaatctgcg

SEQ ID NO: 77616 - protein, 221 aa, Zea mays
  misc_feature: Ceres CLONE 1562608
  misc_feature (49)..(220): Pfam Name: Peptidase_C13 Pfam Description: Peptidase C13 family
  misc_feature: SWISSPROT Homolog: EC 3.4.22.34 Legumain
MVADRLRLALLLSACLCSAWARPRLEPTIRLPSERAAADETDDDAVGTRWAVLIAGSNGYYNYRHQADICHAYQIMKKGGLKDENIVVFMYDDIAHSPENPRPGVIINHPQGGDVYAGVPKDYTGRDVNVDNFFAVLLGNKTALRGGSGKVVDSGPNDHIFVFYSDHEGPPANDINVYATTASNAEESSWGTYCPGEFPSPSPEYDTLLGELYSVAWDGRQ

SEQ ID NO: 77617 - DNA, 742 bp, Zea mays
  misc_feature: Ceres CLONE 1562614
  misc_feature: Translation starting site: 148
  misc_feature: SWISSPROT Homolog: EC 6.3.1.2 Glutamate--ammonia ligase
  misc_feature (290)..(290): n is a, c, t, g, unknown, or other
  misc_feature (384)..(384): n is a, c, t, g, unknown, or other
ctccccgcggtggcggccgctctagaactagtggatcccccgggctgcaggaattcgtctcacccctagaaaaagtcctcaatctcaatcccacaccaccaccacctcctccggtccccaacccctgtcgcaccgcagccgccggccatggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccangcaagctgcccaagtggaactacgacggctccagcacgggccaggcccccggcgaagacagcgaggtcatcctgtacccgcaggccatcttcanggacccattcaggaggggggcacacatcccttgtgatgtgcgattgctacacccccagcggcgagccaatccccaccaacagaggtacaacgccgccaaaaatcttcagcagcccttaagtccccgcccaaggagccgtgttaatggtatttgagcaggagttccccctttccctcaaaaagaaccccaaacgggcccccttgggggggccccaacgggggggttcccccgggcccctaggggttcctttataaatgggggaaaatccggccccaaaaaaatcttttggggcccccaaaatcgtggggaaccccccctaaaagggccttttttttttatgcggggaaaaaaaaaaaaa

SEQ ID NO: 77618 - DNA, 864 bp, Zea mays
  misc_feature: Ceres CLONE 1562616
  misc_feature: Encodes the peptide sequence at SEQ ID NO. 77619
  misc_feature (374)..(374): n is a, c, t, g, unknown, or other
  misc_feature (512)..(512): n is a, c, t, g, unknown, or other
  misc_feature (513)..(513): n is a, c, t, g, unknown, or other
  misc_feature (569)..(569): n is a, c, t, g, unknown, or other
  misc_feature (605)..(605): n is a, c, t, g, unknown, or other
  misc_feature (628)..(628): n is a, c, t, g, unknown, or other
  misc_feature (668)..(668): n is a, c, t, g, unknown, or other
ctggagctccccgcggtggcggccgctctagaactagtggatcccccgggctgcaggaattcgtctcacccctagaaaaaacggagccgcggagggaaccgagtggccccggcgacacgagggccaagccaactaatctgacggcggcagtgacgactcctacgaccacgcgcgcgaaggctgcactgctccagcgaaagcaccatgtcattcatgtctccattccccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatancttattaattgtggctgatggctccactatacgcccttctcttcccttcgctggggcttcttggatatccagggtgagcaagacactttttcacatttcttagatgcctgttaaaagaatgctatgagggcactggtnngattgctaagtttatgggggcattgatggtaccagctaccttgaaatatatctttntcagccaagaacattagtcccctgatgaaatccaanaagggggagggtgcttcaatcanttcccttccccctgttttctcctttttccaggccccggcnatgtcccgatgggagcacaagacattgaaagccttctgaaagtatggaccctggcaattttgttattgttaaggccaagtatgtttccattctgattatttgcactcagccttccttggctgtaccccagctggtttcagcctggacgttttagtattataccggaacttttcagtctccctggcctttatatgcc

SEQ ID NO: 77619 - protein, 49 aa, Zea mays
  misc_feature: Ceres CLONE 1562616
  misc_feature (48)..(48): Xaa is any aa, unknown, or other
MDLSKMDPGTLTLLGAAGCVMLTMHFTVQLVSQHLFYWKNPKEQKAIXY

SEQ ID NO: 77620 - DNA, 779 bp, Zea mays
  misc_feature: Ceres CLONE 1562617
  misc_feature: Encodes the peptide sequence at SEQ ID NO. 77621
tccccgcggtggcggccgctctagaactagtggatcccccgggctgcaggaattcgtctcacccctagaaaaaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcgggcagcgcgtcctcaacactggctccccccatcacgtgcctgttggcagggctacccttggacgtatcattaatgttatccgtgagccgattgatgaagaagggtgatataacgacaaaccacttccctccctatccatcggggaagcccctgccttccgtttgaacaggccactgaagcagcaaaattcttgttactggaatcaaaggtcggggaatctttctttggacccctaccaaaagagggtggaaaaatt

SEQ ID NO: 77621 - protein, 178 aa, Zea mays
  misc_feature: Ceres CLONE 1562617
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPHHVPVGRATLGRIINVIREPIDEEG

SEQ ID NO: 77622 - DNA, 838 bp, Zea mays
  misc_feature: Ceres CLONE 1562618
  misc_feature: Encodes the peptide sequence at SEQ ID NO. 77623
  misc_feature (791)..(791): n is a, c, t, g, unknown, or other
ctccccgcggtggcggccgctctagaactagtggatcccccgggctgcaggaattcgtctcacccctagaaaaagttgttgctgctgctaggtgctagctcccgagtcacggccgccttccactcccacagaattcagctagctttcttactcccgccgtcgcccccgatccgagagcgagcatggcgcactctctcgccgcttccttctcgccagccgccgcccggcgccaggtcacaaatgtgattccaagctggacctcggtttccttccagagccacaggatgacttctgtatccatccgctcaagacaaaggtctcttgggtttaagatttgctgttcggctaagaaagagacagtggacaaggtttgcagtatagtgaaggagcagctggctcttcccgatgggaccgccatcactgccgaatcaaaattcgctgaacttggcgctgattcgctggatacggtcgagattgtgatgggcctcgaggaggcgttcaacataacagtcgacgaaacaagcgcacaggacatcgcaacagtgcaggacgctgcggaccttatcgagaagctcatgctggaggcacctccaaaggtcgtctagatccaacaaccttgcgatcgacgaccttgtgtttgatctatgttgtgtgttaatttgttcgtgttgccccatttgttctttcttgatgattcaagatgaagttttgtattggtgttgctgaggtgaattagatagccccaaaggtcacatgaagcagatgaggacagttcattccactttgaattngtatgttgtaacttgtagtgctgctatagagaaatccatggactgtt

SEQ ID NO: 77623 - protein, 140 aa, Zea mays; identical to SEQ ID NO: 77279
  misc_feature: Ceres CLONE 1562618
  misc_feature (61)..(128): Pfam Name: PP-binding Pfam Description: Phosphopantetheine attachment site

SEQ ID NO: 77624 - DNA, 850 bp, Zea mays
  misc_feature: Ceres CLONE 1562620
  misc_feature: Encodes the peptide sequence at SEQ ID NO. 77625
  misc_feature (693)..(693): n is a, c, t, g, unknown, or other
  misc_feature (820)..(820): n is a, c, t, g, unknown, or other
ctccccgcggtggcggccgctctagaactagtggatcccccgggctgcaggaattcgtctcacccctagaaaaatcaagcagagatcataagcacaaataaggacctgttcccaggtagcataacatttgatgatttcctatgggcatttggaatgctcagatcaagggtgtttccagagctccgcggagataagcttgctctcataccatttgctgatttggttaatcacagtcctaatatcacctcagaagggtcaagttgggagatcaaaggaaagggtctttttggtagggaactcatgttctccttgcgaacaccagtgaatgttaaatctggacagcagatatatatccagtacgatctggacaagagtaatgctgaactggcactagactatgggtttgtggaatcaaatccatcaagggattcgtttactgtgaccctggaaatctctgaatctgatccattttatggagacaagcttgacattgcagaggcaaacggactgggggaaaccgcatactttgatgtaatcctcaacgaaccccttccccctcaaatgctcccttacctgcgattactttgcattggtggaacagatgcatttctcttggaagcactctttaggaattcagtttggggccaccttgaactgccattgagtcctgacaatgaggaatcaatatgtcanggccatgcgagatgcctgcaaatcagcccttggctgactatcataccacaatagaagaagatgaagaactatcggggaagagagaatttgcagccaagactttgcatttgcatgggaagtagggccnggtgaaaagaagtactccagccacattgat

SEQ ID NO: 77625 - protein, 197 aa, Zea mays
  misc_feature: Ceres CLONE 1562620
  misc_feature (100)..(195): Pfam Name: Rubis-subs-bind Pfam Description: Rubisco LSMT substrate-binding
  misc_feature: SWISSPROT Homolog: EC 2.1.1.127 [Ribulose-bisphosphate carboxylase]-lysine N-methyltransferase
  misc_feature (180)..(180): Xaa is any aa, unknown, or other
MLRSRVFPELRGDKLALIPFADLVNHSPNITSEGSSWEIKGKGLFGRELMFSLRTPVNVKSGQQIYIQYDLDKSNAELALDYGFVESNPSRDSFTVTLEISESDPFYGDKLDIAEANGLGETAYFDVILNEPLPPQMLPYLRLLCIGGTDAFLLEALFRNSVWGHLELPLSPDNEESICXGHARCLQISPWLTIIPQ

SEQ ID NO: 77626 - DNA, 909 bp, Zea mays
  misc_feature: Ceres CLONE 1562621
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (521)..(521): n is a, c, t, g, unknown, or other
  misc_feature (532)..(532): n is a, c, t, g, unknown, or other
  misc_feature (533)..(533): n is a, c, t, g, unknown, or other
  misc_feature (557)..(557): n is a, c, t, g, unknown, or other
  misc_feature (558)..(558): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (576)..(576): n is a, c, t, g, unknown, or other
  misc_feature (578)..(578): n is a, c, t, g, unknown, or other
  misc_feature (593)..(593): n is a, c, t, g, unknown, or other
  misc_feature (598)..(598): n is a, c, t, g, unknown, or other
  misc_feature (637)..(637): n is a, c, t, g, unknown, or other
  misc_feature (698)..(698): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
ctccccgcggtggcggccgctctagaactagtggatcccccgggctgcaggaattcgtctcacccctagaaaaaacaacacaagagctactactacagctcctcatctcaagtgtgtagacgagacagagagacactgagagagcgccatggccagcctccaagtcactcctacttcggcgttcactgagtggaacgagctgaagtttcaaaaggctgtatctgtttccacccacccctggggtcatgcgcccacccaactctggtgttataacacaaagcggcgattggcattctgtggcaccccattttaaaaactttaacaagttttaaagggggccgggccaaaccccaaaccctgtttcccccttgccaggggtttggctcttttcaacccgcactggttcactcctttctcacccccatgtttttggtgggtatcaaacagtctatgggtcgcccccctgagtgacccgggatatagnnnnatgtaaaaaaacatcgggggaggggggggggcanaattttttttnnggggggggggcggggcggtgtgcnnagggggtcgnnnnnnnananaaaagagggggtttnttttnctcacaattcttgccaaaaaccaggggaaatcttaaacnttccccctccgtgggtttttttttttccgggtccgaaccagagcgctcggccgaaaagtgnagaacccnnnngggggggtggggaaaacccgcccgggtttcccggggggaactcccgggaaaaaacccccccgttaaaaaaaagatacccctttcatatgggggtatcccccgggacccccaattggcttttttcccctaaagggaattcccccggcaaaccccatattttggggttttttgtgggggggggttccccgtggaaaaaaaaa

SEQ ID NO: 77627 - DNA, 791 bp, Zea mays
  misc_feature: Ceres CLONE 1562623
  misc_feature: Encodes the peptide sequence at SEQ ID NO. 77628
ggagctccccgcggtggcggccgctctagaactagtggatcccccgggctgcaggaattcgtctcacccctagaaaaatggatatgttggacaaaaaaataggatctctgatagccgaatcagatgatttaagggttacagttcaaagcaaagattctttactacaggttgagagggccaaaattgaggagttgatgcgtaaatcagatggtctagaagcttcattgagccaaaaggattcccagatagggttacttcgccgggacagagcatccaatcagcagagcagatctataaatttgcctggcacttcagagattgagcaaatgaatgacaaagtaagcccagctgcagttgtcactcagattcgaggcgcacgaaaagtcatcaatgaccaagttgctattgatgtagagatggagaaggacaagccttttgatgatgaagatgatgacaaagcccatggtttcaagtcattgactatgtcacgctttgttcctaaatcactcgaccggtatcagacagaatgatgggatgtgggtctcaagcgataaattgctcatgaagcaaccgacctttaaaactcggcgtcttgaatatattgggatgcacctgcatgcttttgcttggccaagtttttattttgaacctcggtaaaaaatgaacgcattctcccggggcgaggggaccggtacaagacccctggggtctttttgcaaggttttttttcaaaacaaaaaaccagttttcaccagaaataccggggattcccttttccaaaaaagagttaa

SEQ ID NO: 77628 - protein, 150 aa, Zea mays
  misc_feature: Ceres CLONE 1562623
MDMLDKKIGSLIAESDDLRVTVQSKDSLLQVERAKIEELMRKSDGLEASLSQKDSQIGLLRRDRASNQQSRSINLPGTSEIEQMNDKVSPAAVVTQIRGARKVINDQVAIDVEMEKDKPFDDEDDDKAHGFKSLTMSRFVPKSLDRYQTE

SEQ ID NO: 77629 - DNA, 727 bp, Zea mays
  misc_feature: Ceres CLONE 1562626
  misc_feature: SWISSPROT Homolog: EC 2.7.2.4 Aspartate kinase
ctccccgcggtggcggccgctctagaactagtggatcccccgggctgcaggaattcgtctcacccctagaaaaaagtaaaagctcggcagtatgatgcatttgatcttggctttataactaccgatgatttcacaaatgcggatattctggaagcaacttatcctgctgttgcaaggaggctacatgtggaatggattaatgatcctgctatacctatagtcactggctttcttggcaagggatggagatctggtgcaataactaccttgggcaggggtggaagcgacttgacagctacaaccattggcaaagccttgggattaagagaaattcaggtttggaaagatgttgatggtgttttaacatgtgacccaaatatccatcctaaggcaaaacctgtgccatacttgacatttgatgaggcagctgaaacttgcctattttggaagcgcaggttttttgcattccccaaattcaaatggcggccccgcctataaaaaaaaggggcaaaattttccccttggggagggggtttaaaaaaattttttttaaaaccgcgggaaacccccccgggggcccccttttttcccccaaaaggccgagaaaaaaattttttggtttaaaaaacccgttttttttaacaaacaaaacacaatttttttttttttttaaaaaacaacaaaaaatttttttcccccaagggggtggctaaaaataaaaaaacca

SEQ ID NO: 77630 - DNA, 828 bp, Zea mays
  misc_feature: Ceres CLONE 1562627
ctggagctcaccgcggtggcggccgctctagaactagtggatcccccgggctgcaggaattcgtctcacccctagaaaaaataaataatggctagtccgaatgtggaaccttcatatacctggtcacctccttactctgaatatccgtgttgttatcgtctccatggctatgcacggatgcctgtcagctggtcaggaaggtcttggtcaccgccatctccaaggactcgtccacctacgtatacaccgcaccgatcaaggacggccactcgctcatcttctacctcacaaggcgggggatctatgtgggcacgaactgctcctactactagaacaagaacggcactctgaacgtcaagctatacggcaaagacacctactgacagaacattatgttcccggactacttatcaggagagtgcacgtgcacaacctgctgctagttgccctgcggctccaggaccatgggtgatgcgtggatcatgcactcctacgctatccaagattgtctcaacagccatgtgagccacacgaacaagtgcgactactacgtagagatgctgaagcactgccaccgtaggtctatgtctggctacactgtctgcgtggccatcttcggattttgccccctggacgtcatctcactgaaaagatacgagttaactcttatctcgccgggtaaaagtcacttactgcggatcagaaatctgtgcccccgaggacgttggacccacatctggcatcccgatgaaaaagtttaatgaaacgggccatgtggggaaaaatatagtggcctaaattccaggattcgaaaaagagattcgggac

SEQ ID NO: 77631 - DNA, 752 bp, Zea mays
  misc_feature: Ceres CLONE 1562628
  misc_feature: Encodes the peptide sequence at SEQ ID NO. 77632
  misc_feature (502)..(502): n is a, c, t, g, unknown, or other
  misc_feature (505)..(505): n is a, c, t, g, unknown, or other
  misc_feature (630)..(630): n is a, c, t, g, unknown, or other
ggagctccccgcggtggcggccgctctagaactagtggatcccccgggctgcaggaattcgtctcacccctagaaaaaagtgagccgccccgccgctcctcagccatcctctccatctcggtgtcacacactccgcatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctctcctacgacttcggcgcgctggagccggccatctcgggggagatcatgcgcctgcaccaccagaagcaccacgccacctacgtcgccaactacaacaaggcgctggagcagctcgacgctgccgtcgccaagggcgacgcctccgctgtcgtccagctcccaggcgccatcaagttcaacggcggcggtcatgtgaaccanttncatctttggaagaccctcagctattagcgaaggtggtggggagcccgcacatgggaaaactggctgggcatcgatgaaggattttgggttcatttgaggccactggtaaagaagatgaaatgccnaaaggcgctgcttttcaaaggatcctggaaaggggggtgggggtttaaccttttgggaataaaagaggggcaaaaaaaaaccctttcccagttttgaaaaaccccccgccttaatatccggg

SEQ ID NO: 77632 - protein, 114 aa, Zea mays
  misc_feature: Ceres CLONE 1562628
  misc_feature (32)..(113): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
  misc_feature (105)..(105): Xaa is any aa, unknown, or other
  misc_feature (106)..(106): Xaa is any aa, unknown, or other
MALRTLASKNALSFALGGAARPSAASARGVTTVALPDLSYDFGALEPAISGEIMRLHHQKHHATYVANYNKALEQLDAAVAKGDASAVVQLPGAIKFNGGGHVNXXHLWKTLSY

SEQ ID NO: 77633 - DNA, 804 bp, Zea mays
  misc_feature: Ceres CLONE 1562631
  misc_feature: Encodes the peptide sequence at SEQ ID NO. 77634
agctccccgcggtggcggccgctctagaactagtggatcccccgggctgcaggaattcgtctcacccctagaaaaaactcacgcgttctccacctactgctggcgctcctgtgaggcgacgccggaccggccaccccgcatgcgaacagcgcacggaccggccaccggtgtgacccctccatccaaggcttcagctccagaccgagccgccccgccaatcgccgtccgccgaaccgcctaggaatttgttttcctcatctaaagttactgcattgtattccatagaaatggctatggggttgattaatgctaatcctataatccatgagaaaaaagaaagacgcatccgacaggcaccagagaccacagatgaaaatgcggtagagtccatagaccagctggaaatatttgatcacattagagatataaaggatccagagcacccatactcactggaacagcttaatgtggtgactgaagactcaattgaactcaatgatgaaagcaatcatgtcagggttattttcaccccaacagtggagcactgcagtatggcaactattattggccttttgcatacgtgtgaaacttgtacggagtctccctccttattacaaggtgggacataaaggttgccccctggatcacacgcaactggaagctgctgtgtataagcaactgaatgacaaaagaacgtggttgcggctgcattggaaaacccaaacctactggacttgggtttgaagagtgcttatcacccaacattcgattggaggtctcaagttattgcacgtctggggaagc

SEQ ID NO: 77634 - protein, 113 aa, Zea mays
  misc_feature: Ceres CLONE 1562631
  misc_feature (36)..(108): Pfam Name: DUF59 Pfam Description: Domain of unknown function DUF59
MAMGLINANPIIHEKKERRIRQAPETTDENAVESIDQLEIFDHIRDIKDPEHPYSLEQLNVVTEDSIELNDESNHVRVIFTPTVEHCSMATIIGLLHTCETCTESPSLLQGGT

SEQ ID NO: 77635 - DNA, 852 bp, Zea mays
  misc_feature: Ceres CLONE 1562632
  misc_feature: Translation starting site: 195
  misc_feature: SWISSPROT Homolog: EC 1.14.17.4 Aminocyclopropanecarboxylate oxidase
  misc_feature: SWISSPROT Homolog: EC 1.14.11.9 Flavanone 3-dioxygenase
  misc_feature (449)..(449): n is a, c, t, g, unknown, or other
  misc_feature (752)..(752): n is a, c, t, g, unknown, or other
  misc_feature (786)..(786): n is a, c, t, g, unknown, or other
  misc_feature (814)..(814): n is a, c, t, g, unknown, or other
ctggagctccccgcggtggcggccgctctagaacagtggatcccccgggctgcaggaattcgtctcacccctagaaaaaatcctcaagacatcagctagctagccttccctacagcaactgcttacatacaacacttccatcttcccgagctcgtattcgatcaattcccaattcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgctggaggcgctcgtcgacgcggaacggcgctggcgaggttgntggcgccggtggacgacctggactgggaggacatcttctacatccacgacggatgccagtggccgtccgacccgccggcgttcaaggagaccatgcgcgagtaccgcgccgagctgaggaagctcgccgagcgcgtcatggaggccatggacgagaacctcggcctcgccaggggcaccatcaagggcgccttctccagcggcggccggcacgagcccttcttcggcaccaaggtcaccaactacccgccgtgcccgcgcccggacctcatcacgggcctgcgcgcgcacaccgacagccggncgcgtcatcctgctgttcaagaagacaaagtcgnccggcctggaggtgctcaagaccgccanttgacccgactgcagccgctcgcggggcgcattctcgt

SEQ ID NO: 77636 - DNA, 1760 bp, Zea mays
  misc_feature: Ceres CLONE 1562633
  misc_feature: Encodes the peptide sequence at SEQ ID NO. 77637
agtcctccgttctcctcttcctctctctctcttctctctctctctacggattgcctcacacgcatctcgcgtgcaattcaagcgaaactttctgaatatcaaagtggcatagagctccacttttatggccatccctatgaaggcctctccgggttcctgatatagatgtttccttgttctgaacatgaaaagttctcaggtactccgccgttgatgaactgcctccacacctgcggcgacaagaagacgctgaagaagtggtttttcatcgacaagacagtaggctaaatccagtcccagagaacaaattgaagcaccactccccaccgcacagcagcacagctcttctcttcaccgatcccgatggatatgggcagcggctcgtcacctgtcatcaccgatccgatatcgataagcccaccgctgctgggaggcttgacgtcgaacctgatgccgttctcggtcatgtccggaggctgctcctccagtcctagcatgagcgccagcagcaggcgtaaaatcgaggaggtccttgtcaatggcctgctagacgcgatgaaatcgtcgtcgcctcgcaagaagcacaacctcgccttcggacaggataattcgcccgacgaagatcctgcttacactgcatggctgtcaaaatgcccttctgcgctggcctccttcaagcagatagtagccaacgcacagggcaggaggatcgctgtgttcttggattacgacggcaccctgtcgccgatcgtcgacgatcccgacaaagcgttcatgtcccctgtgatgagagctgctgttagaaatgtcgcgaagtacttccctaccgcgattgtcagcggaaggtcccgtaagaaggtgtttgaatttgtaaaactgacggaactgtactacgctggtagtcacgggatggacatagtgacatctgcagcagcacatgctactgaaaagtgcaaagaagccaatctcttccaacctgcttgcgagtttctccctatgattaatgaggtttccaagtgcctcgtggaggtcacgagttcaattgaaggtgcaagagttgagaacaacaagttctgtgtatctgtacattaccgcaacgtagcagagaaggactggaaagtggtcgcaggactcgtgaaacaagtcttggaggccttccctcgtctcaaagtaaccaacgggcgaatggttttagaggttcgcccggtgatcgactgggacaagggaaaggctgtcgagttcctgcttcggtcgctcggcctaagcgactccgaagatgtggttcctatctacatcggagacgatcgaacagacgaagacgccttcaaggtactgcgagagcgaagctgtggatacggaatcctagtctcgcaggtgcccaaggacactgaagccttctactcgctgagagacccgtctgaagtgatggggttcctcaattccttggtgagatggaagaagcacccgctgtgacgcaactgaaaacacaacgactgattcagaagccgtaaagcgactgtacttcgtgcggcggcaattttgtagagtttttggctcaccgggtggctcattctttcatgcgtttttattttttatttttttaactgtcacagtccttcgtcactgagaaataacaagtggttgtcccacaccctcttgcaactgtaatctgtaagcaagaggccctccctgttcggtctatatatatatattgaataaaaccgggacgcttttgccttgccctaaaaaaaaaaaaaaaa

SEQ ID NO: 77637 - protein, 369 aa, Zea mays
  misc_feature: Ceres CLONE 1562633
  misc_feature (119)..(352): Pfam Name: Trehalose_PPase Pfam Description: Trehalose-phosphatase
  misc_feature: SWISSPROT Homolog: EC 3.1.3.12 Trehalose-phosphatase
MDMGSGSSPVITDPISISPPLLGGLTSNLMPFSVMSGGCSSSPSMSASSRRKIEEVLVNGLLDAMKSSSPRKKHNLAFGQDNSPDEDPAYTAWLSKCPSALASFKQIVANAQGRRIAVFLDYDGTLSPIVDDPDKAFMSPVMRAAVRNVAKYFPTAIVSGRSRKKVFEFVKLTELYYAGSHGMDIVTSAAAHATEKCKEANLFQPACEFLPMINEVSKCLVEVTSSIEGARVENNKFCVSVHYRNVAEKDWKVVAGLVKQVLEAFPRLKVTNGRMVLEVRPVIDWDKGKAVEFLLRSLGLSDSEDVVPIYIGDDRTDEDAFKVLRERSCGYGILVSQVPKDTEAFYSLRDPSEVMGFLNSLVRWKKHPL

SEQ ID NO: 77638 - DNA, 794 bp, Zea mays
  misc_feature: Ceres CLONE 1562637
  misc_feature: Encodes the peptide sequence at SEQ ID NO. 77639
  misc_feature (544)..(544): n is a, c, t, g, unknown, or other
gagctcaccgcggtggcggccgctctagaactagtggatcccccgggctgcaggaattcgtctcacccctagaaaaactcccgcagagccgccgacaactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttgggggatgaattttaccactgataaactgagatccctagtgaagaagtggcagacattaatcgaagcccatgttgatgtcaagacaaccgacaactnacatgttgcgttttgttctgcatcggctttcacgaagaggcgcccaaaacaaggtcaagaagaacctgctatgctcaagcatccccagatcccgtcagatcccgcgtaagatgggtggaagattatgatcaaccagggcttctacatgtggaccctgaaagaactttgttttcgaaagtccatcccagaagagttttggggtaaggagaatttgaagaaagtctacccttccaggaattctttcccaatt

SEQ ID NO: 77639 - protein, 168 aa, Zea mays
  misc_feature: Ceres CLONE 1562637
  misc_feature (11)..(162): Pfam Name: Ribosomal_S3Ae Pfam Description: Ribosomal S3Ae family
  misc_feature (133)..(133): Xaa is any aa, unknown, or other
MAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGMNFTTDKLRSLVKKWQTLIEAHVDVKTTDNXHVAFCSASAFTKRRPKQGQEEPAMLKHPQIPSDPA

SEQ ID NO: 77640 - DNA, 840 bp, Zea mays
  misc_feature: Ceres CLONE 1562638
  misc_feature: Encodes the peptide sequence at SEQ ID NO. 77641
  misc_feature (600)..(600): n is a, c, t, g, unknown, or other
  misc_feature (643)..(643): n is a, c, t, g, unknown, or other
  misc_feature (652)..(652): n is a, c, t, g, unknown, or other
  misc_feature (719)..(719): n is a, c, t, g, unknown, or other
  misc_feature (723)..(723): n is a, c, t, g, unknown, or other
  misc_feature (770)..(770): n is a, c, t, g, unknown, or other
  misc_feature (811)..(811): n is a, c, t, g, unknown, or other
  misc_feature (828)..(828): n is a, c, t, g, unknown, or other
ctggagctccccgcggtggcggccgctctagaactagtggatcccccgggctgcaggaattcgtctcacccctagaaaaaacctccacagctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagtaggacctggggaaaaagagcgagctgctcctccgcgccaacccggtgcacaagaagatccccgtgctgctgcacgacggccgccccgtctgcgagtccctcgtcatcgtgcagtacctcgacgaggcgttcccggcggcggcgccggcgctgctccccgccgacccctacgcgcgcgcgcaggcccgcttctgggcggactacgtcgacaagaagctgtacgactgcggcacccggctgtggaagctcaagggggacggccaggcgcaggcgcgcgccgagatggtcgagatccntccgcacgctggagggcgcgctcggcgacggggcccttcttcngcggcgacngccctcggcttcgtcgacgtcgcgctcgtgccctttcaccgtcgtgggttcctcgcctacgaccgcnttcngcggcgtcagcgtggggaagaaggattggcccgagggctggccgccntgggcccaagcgctgcgccgaagcgcccccagcggtcgccnaagaacctctaccccgncccgagaaagct

SEQ ID NO: 77641 - protein, 38 aa, Zea mays; identical to SEQ ID NO: 77269
  misc_feature: Ceres CLONE 1562638
  misc_feature (11)..(38): SWISSPROT Homolog: EC 4.4.1.5 Lactoylglutathione lyase
  misc_feature (1)..(38): SWISSPROT Homolog: EC 2.5.1.18 Glutathione transferase

SEQ ID NO: 77642 - DNA, 788 bp, Zea mays
  misc_feature: Ceres CLONE 1562640
  misc_feature: SWISSPROT Homolog: EC 3.2.1.21 Beta-glucosidase
  misc_feature (545)..(545): n is a, c, t, g, unknown, or other
  misc_feature (608)..(608): n is a, c, t, g, unknown, or other
  misc_feature (610)..(610): n is a, c, t, g, unknown, or other
ctccccgcggtggcggccgctctagaactagtggatcccccgggctgcaggaattcgtctcacccctagaaaaaatcctacgacaaaagcaaagcaaagcagctcaaaaaagtttagccagctagcaagacatggctccacttgttgctgctgccacgaatcacactgcccatagaagccacatatagtaggacccaacaatgagaattttccaaggcaccaaccttgttcatcacaaaacagaaacaaaagactcaggcttaggtcacgagcacaaaggataagcagtcagctgcttgcaagccaaaagctgatgccatggcaaatccctaaaagggactggtttcctcctagcttcatctttggtgccgccaccgcagcataccaaattgagggcgcctggaatgaagatgggaaggggccaagcaattgggatcacttctgccacaattatccggattggatactggacggaagcaatggggacactggagccaattcctatcatatgtaccctgcggatgtcagattgctaaaggaaatangcatggaacgcgtacagaatctccatcttcttggtccagaatactgccgaagggaacgctccnanggaagcattaaatcaggcccgcctttcaagtactacaaaaaagctctttcactttttttgtttgggaaacgaaccttgaggccctttttgtaacaaatttttttccattgggggaaggtcccctcaaaaacccctgggaaaaaaacaaaaaacccgcgggggcgtttttttttagggc

SEQ ID NO: 77643 - DNA, 737 bp, Zea mays
  misc_feature: Ceres CLONE 1562641
  misc_feature: Encodes the peptide sequence at SEQ ID NO. 77644
  misc_feature (427)..(427): n is a, c, t, g, unknown, or other
  misc_feature (435)..(435): n is a, c, t, g, unknown, or other
  misc_feature (693)..(693): n is a, c, t, g, unknown, or other
  misc_feature (697)..(697): n is a, c, t, g, unknown, or other
ctccccgcggtggcggccgctctagaactagtggatcccccgggctgcaggaattcgtctcacccctagaaaaactgacgaccgattcccagaaagctcgatctagcgcgcgcggctgcagagtgcagacgacgacgtacaccatggcgcggcggtccctggccctgctgctcgcgtcgtcgctcgccctgatggcggccgccgtcgcatcggcggactcgtggctctacgacaagttcaacacggacggcaccgtccgcacccagtacgacgcgtcggggcaggaggtggcgatgctcagcctggaccgcagctccggcgccggcttcaactccaagaagcagtacctgtacggcgagttcagcgtccagatgaagctcatccccggcaactcccgcggcaccgtctcgtgcttctacctctcgtncggcgacngcgacgggcacgacgagatcggacatgggagttcatgggcaaacgcgagcgggcaagcccggttggtgctggaaccacggaaaccggtgtggggcccagccgggcaaagggaaaaaaaagggaccccccccgtttccaacccctccgggggtttgaaaccccccctcccccccgggaaaaaatatcccccaaaacccccttaaaaacccccctttttttttttttggggggaaaaaaccccccccccccaaaaaaaanaaancccccccccccctttttttttaaaaaagaagaaaaagaag

SEQ ID NO: 77644 - protein, 164 aa, Zea mays
  misc_feature: Ceres CLONE 1562641
  misc_feature (28)..(158): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature (95)..(95): Xaa is any aa, unknown, or other
  misc_feature (98)..(98): Xaa is any aa, unknown, or other
MARRSLALLLASSLALMAAAVASADSWLYDKFNTDGTVRTQYDASGQEVAMLSLDRSSGAGFNSKKQYLYGEFSVQMKLIPGNSRGTVSCFYLSXGDXDGHDEIGHGSSWANASGQARLVLEPRKPVWGPAGQREKKGTPPVSNPSGGLKPPLPPGKKYPPKPP

SEQ ID NO: 77645 - DNA, 824 bp, Zea mays
  misc_feature: Ceres CLONE 1562642
  misc_feature: Translation starting site: 407
  misc_feature: Pfam Name: DUF59 Pfam Description: Domain of unknown function DUF59
ctggagctccccgcggtggcggccgctctagaactagtggatcccccgggctgcaggaattcgtctcacccctagaaaaagtccgccgtctccgctccggttttcgctgtctcgctgccgtcctaggtttggagccaggtcaccggcgctaggagggcgtgaaatcgagtcgacggtcggcactcggcactcacgcgttctccacctactgctggcgctcctgtgaggcgacgccggaccgcccaccccgcatgcgaacagcgcacggaccggccaccggtgtgacccctccattcaaggcttcagctccagaccgagccgccccgccaatcgccgtccgccgaaccgcctaggaatttgttttcctcatctaaagttactgcattgtattccatagaaatgggctatggggttgattaatgctaatcctataatccatgagaaaaaagaaagacgcatccgacaggcaccagagaccacagatgaaaatgcggtagagtccatagaccagctggaaatatttgatcacattagagatataaaggatccagagcacccatactcactggaacagcttaatgtggtgactgaagactcaattgaactcaatgatgaaagaatcatgtcagggttattttcaccccaacagtggagcactgcagtatggcaactattattggccttttgctacgtgtgaaacttgtacggagtctccctcctttatacagggggacataaaggttgcccctggatacacgcactggagctgctgtgattagcactgatggacaaaaacgtgttgcgctgcatgggaaaccaaactc

SEQ ID NO: 77646 - DNA, 832 bp, Zea mays
  misc_feature: Ceres CLONE 1562643
  misc_feature: Encodes the peptide sequence at SEQ ID NO. 77647
  misc_feature (675)..(675): n is a, c, t, g, unknown, or other
  misc_feature (761)..(761): n is a, c, t, g, unknown, or other
ctccccgcggtggcggccgctctagaactagtggatcccccgggctgcaggaattcgtctcacccctagaaaaaaccgcagctcccctctccctatccatccaggccatccgctgtacatcacgcacgttggtcggtgctcccctcggcgagcgagatgcgtgggccggcgtcggtgaaggcggggagccggccgccgtggctgggactgggggcggccgcatgggtgcaggtcgcgggcggcgccggctccacgttcgcgctctactcgcacgcgctcaaggtcgccctcggcgccgaccagagccggcttgcgctgctcggggtcgcctgtgacgtcggcgagaacctcggcctgctcccgggggtgctctgcaaccgcctccaccccgcgctgctcctcatcatcggcgctggcgcgtgcctgctcgggtacggcaccgcgtggctcctcgtctctggcgtcgcgcccgcgctgccttactggctgatatggtttgggttatgtcttgctaccaatggtggcgcgtggttggcgactgctgttctagtgacaaacatgaggaacttcccagtcagcagaggtgctgttgctggcattctgaaagggtactcgggtttaagtgctgctgtttacaccgaaatatacactggagtgctccgtgattcacccatncaccttttgctctttcttactctcggaattcctgctgtgtgccttctggcaatgtactttgttcagccttgtgaaccctctctggntgagacgaaatgcagagcagtccatttttatgttgcgcaagtggcaagtgtttttcttgggggttatctgg

SEQ ID NO: 77647 - protein, 225 aa, Zea mays
  misc_feature: Ceres CLONE 1562643
  misc_feature (14)..(225): Pfam Name: Nodulin-like Pfam Description: Nodulin-like
  misc_feature (173)..(173): Xaa is any aa, unknown, or other
  misc_feature (202)..(202): Xaa is any aa, unknown, or other
MRGPASVKAGSRPPWLGLGAAAWVQVAGGAGSTFALYSHALKVALGADQSRLALLGVACDVGENLGLLPGVLCNRLHPALLLIIGAGACLLGYGTAWLLVSGVAPALPYWLIWFGLCLATNGGAWLATAVLVTNMRNFPVSRGAVAGILKGYSGLSAAVYTEIYTGVLRDSPXHLLLFLTLGIPAVCLLAMYFVQPCEPSLXETKCRAVHFYVAQVASVFLGGYL

SEQ ID NO: 77648 - DNA, 789 bp, Zea mays
  misc_feature: Ceres CLONE 1562645
  misc_feature: Encodes the peptide sequence at SEQ ID NO. 77649
  misc_feature (238)..(238): n is a, c, t, g, unknown, or other
  misc_feature (253)..(253): n is a, c, t, g, unknown, or other
  misc_feature (309)..(309): n is a, c, t, g, unknown, or other
  misc_feature (444)..(444): n is a, c, t, g, unknown, or other
  misc_feature (446)..(446): n is a, c, t, g, unknown, or other
  misc_feature (448)..(448): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (498)..(498): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (513)..(513): n is a, c, t, g, unknown, or other
  misc_feature (515)..(515): n is a, c, t, g, unknown, or other
  misc_feature (524)..(524): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (575)..(575): n is a, c, t, g, unknown, or other
  misc_feature (576)..(576): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (621)..(621): n is a, c, t, g, unknown, or other
  misc_feature (623)..(623): n is a, c, t, g, unknown, or other
  misc_feature (636)..(636): n is a, c, t, g, unknown, or other
  misc_feature (639)..(639): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (673)..(673): n is a, c, t, g, unknown, or other
  misc_feature (674)..(674): n is a, c, t, g, unknown, or other
  misc_feature (680)..(680): n is a, c, t, g, unknown, or other
  misc_feature (691)..(691): n is a, c, t, g, unknown, or other
  misc_feature (692)..(692): n is a, c, t, g, unknown, or other
  misc_feature (695)..(695): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (707)..(707): n is a, c, t, g, unknown, or other
  misc_feature (714)..(714): n is a, c, t, g, unknown, or other
  misc_feature (715)..(715): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
ctcaccgcggtggcggccgctctagaactagtggatcccccgggctgcaggaattcgtctcacccctagaaaaagtgtcttccttccacctgaaaacccaacccacacgctcgcgcctccgcgaagaaaaacaccgaggcccatggcgccgagaacgtcagagagagcgatgacatcggcggccgcggggctcgcgcgtggcgccggcccgcactacagaggcgtcaggaagcggccngtggggccggtacgnccgcggagatccgcgacccggccaagaaagagccgcgtgtgggctcgggcacgttncgacaacgccccgaaggacgcccgccggcgggggccctaacaaaaaaccccccccccgggggggggccgaaagtatcccgcggggggggcgccccaaaagggggccccccaacaaaaaaaaacccccccccaccncncnctttttttttttcccccccccccccctnnncctcctccccccccccccgncgcgggnnncggggngnggggccccnccgccccccnnnccgttcggcgggccccggccccgcgcacccccctttttnntttcccgcccccccgcccccccccccccccgnnnnnnnccccccncncccgccccccgcngcnccgccggcccnnnnnccgcgcccgccccccccgnncgcgcnccgccggccgnncgngnnncgcgcagncgaacgnncagaaagagagcaagggcgcgnnnnagnnnnnnnnnnnnnannnnccagggcgggcgggcgggccgcgcgnnnt

SEQ ID NO: 77649 - protein, 68 aa, Zea mays
  misc_feature: Ceres CLONE 1562645
  misc_feature (56)..(56): Xaa is any aa, unknown, or other
MAPRTSERAMTSAAAGLARGAGPHYRGVRKRPVGPVRPRRSATRPRKSRVWARARXDNAPKDARRRGP

SEQ ID NO: 77650 - DNA, 730 bp, Zea mays
  misc_feature: Ceres CLONE 1562646
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (658)..(658): n is a, c, t, g, unknown, or other
  misc_feature (659)..(659): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttccaagctggagctcccctcggtggcggccgctctagaactagtggatcccccgggctgcaggaattcgtctcacccctagaaaaaagtcgtcccccccggccccgacccccctccgtttgccaacgactccgggctccactgtcgctcgctctcgctcccttccctcccacgcaatggtggccgatcgcctccgcctcgcgctgctgctctccgcgtgcctctgctccgcgtgggcgcgcccacgcctcgagccgaaccaattnnnnccgccctgccgttccgagcgcgccgctgccgaactacgccctcggggaccccggtggggcccgtggctcattcgcccgggttcccaaacggggtttactaaaaaaacttaccggcccccccccaagggggggggaaaaattttttgggcccatgggcgttttttcccccccaaaattcttttggtaaaaaaaaaaaagggggggggggggaacctcttttggggggggccccaacaaaaaaacacccccccccccccttgtgttnntttcgccnnnnnctcccccccccccccccgggggggtgcccccaaaaaaaaaaaaaaaaaacccccccccc

SEQ ID NO: 77651 - DNA, 865 bp, Zea mays
  misc_feature: Ceres CLONE 1562647
  misc_feature (530)..(530): n is a, c, t, g, unknown, or other
acccgcggtggcggccgctctagaactagtggatcccccgggctgcaggaattcgtctcacccctagaaaaagacggcccacggcagagccaccaccagcagcagccccagaaatcgagcaaacacaagctgctccatggcctcaccaacccgaacaccatcgcctccgccggcggtcgagcccatcgcgccttctctctcttcagaacatccgcctgtcaacccctcctgtgacggatccttctcgccggagaacccagcgccagctccacctcctccccctgctactccgcatcctcatactcccggcgatagctctccttcctcaattccgcatccctcggcgccacagcctcttccatctccgcctcctcatactcccgacgaaagctctccttcctcaactccgcatccctcggcgccacagcccccaccatctccgcctccggcgagcgctgatgtttctccctccctctcgcgacggggcgaacgtcaccgcggcgcccattgcccccttccttcacccgttncagtattcccgcctactccaagggccggcgtcttcggaagccaaatccgaacaggaagaaggggaatcggctaacgaatcggggagcatgacgcctaagcattcgttttagcaaaactgaagatgcaaccccgccctaggccttctcgggccgaggcgtccccaaccaaaatcccccacaaaggaaatcggccgttaccattcgcgaaacgtccttttccccccaaagacttctccgggggaagggaagcttaaaggccaccccccgaacaaaggttaacaccttcccaaggcgaacgctgtgggtgccctttcccggcggcccggttatcatcc

SEQ ID NO: 77652 - DNA, 866 bp, Zea mays
  misc_feature: Ceres CLONE 1562652
  misc_feature: Encodes the peptide sequence at SEQ ID NO. 77653
  misc_feature (521)..(521): n is a, c, t, g, unknown, or other
aaagctggagctcaccgcggtggcggccgctctagaactagtggatcccccgggctgcaggaattcgtctcacccctagaaaaagcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctggggcgcggtgggcgccatcgcccccggagatcttcngcaagatgggcatcatccccccggagaccgcgctgccgtggttcaagacgggcgtcatcccgccccgcgggcacctacaactactgggccgactcctacacgctcttcgtcttcaaaatggcgctcatgggctttcgccaagaccgccgccctccagaacgggtcaacccgggctccttgggcaagcagtactttcctcggcctccaaaagtttctcgccgggttcggggaacctgtcttaccccgggggggcccttttttaacccctcgggtttgggaaaaccccaaagggaataaatggcccacccccgggaattcaaaaaaggggggggcccccagccccct

SEQ ID NO: 77653 - protein, 213 aa, Zea mays
  misc_feature: Ceres CLONE 1562652
  misc_feature (55)..(209): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGRGGRHRPRRSSARWASSPRRPRCRGSRRASSRPAGTYNYWADSYTLFVFKMALMGFRQDRRPPERVNPGSLGKQYFPRPPKVSRRVRGTCLTPGGPFFNPSGLGKPQRE

SEQ ID NO: 77654 - DNA, 933 bp, Zea mays
  misc_feature: Ceres CLONE 1562653
  misc_feature: Encodes the peptide sequence at SEQ ID NO. 77655
tccccgcggtggcggccgctctagaactagtggatcccccgggctgcaggaattcgtctcacccctagaaaaaaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggtatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgttgggctgacatcatcaagcccggaagcgtcaacaccgatcccatcttccccagcaacaagctcaccggcaccgacgtcgggtaccctggtggcctgtggtttgaaccgctcggctggggctccggctcgccggagaagatcaggagctgcgcaccaaggagatcaagaacggacgcctcgccatgctccgcgtcatgggggcttggttccaggccgaagtacacgggcacgggcccatcgacaactctttcgccacctggccgaccctggcacggccacatctttcaaggcttccaccccaaattgagg

SEQ ID NO: 77655 - protein, 271 aa, Zea mays
  misc_feature: Ceres CLONE 1562653
  misc_feature (73)..(218): Pfam Name: Chloroa_b-bind Pfam Description: Chlorophyll A-B binding protein
MALVSASSSSTTAVAALPRNGQQRASSSLFSSSSSSSFLVGKTLLRQAEAARPSFAVRAAADSDRPIWFPGSTPPPWLDGSLPGDFGFDPWGLGSDPESLRWNVQAELVHCRWAMLGAAGIFIPEFLTKIGVLNTPFWYTAGEQQYFTDTTTLFIIELILIGWAEGRRWADIIKPGSVNTDPIFPSNKLTGTDVGYPGGLWFEPLGWGSGSPEKIRSCAPRRSRTDASPCSASWGLGSRPKYTGTGPSTTLSPPGRPWHGHIFQGFHPKLR

SEQ ID NO: 77656 - DNA, 755 bp, Zea mays
  misc_feature: Ceres CLONE 1562655
  misc_feature: SWISSPROT Homolog: EC 4.1.2.13 Fructose-bisphosphate aldolase
ctccccgcggtggcggccgctctagaactagtggatcccccgggctgcaggaattcgtctcacccctagaaaaacagaaagtatacgcttcttcaccgaacgaaaatgtcctgtcatcttattagccaccgcgtcgtcgagtatgcatgatgtaagacctatctgcattaaataataggatgagctcattgacaatgctgcctacattggaacctctggggagggaaatcttggtgctgattactccactggcatgattggaaagcgcatttccaccatcaaggtcgagaagcttgaacagaatggccgcgccctacgtgagctcctatactgatgcgatgatgctctgcactacatcaccggtatgatcgtgggcgaggacaccctatagcagaaggacaaagatcgaaagtcttctgtatgagtcctcaaggatggaggcctattagctggcatcgaagtgacgaggctactagttgatgtagaaggtactgaatacgagacaccactgcatgctaggacgatcgtcgtatagcactagtgcaaaggactgatggggcaagtcgcccaatttttttccaaaaaagtcaaggtttgttaaaaaatttgggccaaaacaaccaggggctgctgggaattaaaccttaatcaaaaaggggttggggcccctaaagaattttcctttccaaaaaaaagggggccgtggaaccttaatggaaaaccttgaaaaacaagggggaggggggctcccctgg

SEQ ID NO: 77657 - DNA, 604 bp, Zea mays
  misc_feature: Ceres CLONE 1562656
  misc_feature: Pfam Name: DJ-1_PfpI Pfam Description: DJ-1/PfpI family
  misc_feature (299)..(299): n is a, c, t, g, unknown, or other
ctggagctccccgcggtggcggccgctctagaactagtggatcccccgggctgcaggaattcgtctcacccctagaaaaaaccggggattagggatggcggcgaagaaggtgctcatgctctgcggcgactacatggaggactacgaggtcatggtcccgttccaagcgctgcaagcgtatggggtgtccgtggacgccgtctgccctagcaagaaggccggcgacatctgccgcaccgccgtccatcagctgaccggtcaccagacatactctgagacaaaaggccataatttcacanctgaatggcttcattttgatgagatttactggctagtgaataatgaagggattggggaattccccggggaggggggtgggccccaaaaaaatacctttggccagggggagaaaaaaaaggggtgtttgaccccctttttcaaaaaaaagtggttctccccggggggggggcggaaaaaaaaaaccccctttttgggggcccccccttttttttttttctctcggggggaaaaaaaacccttttttttttttttttttcgtgccgggccgccccccccccaaaaaaaaaaaaaatattttttttct

SEQ ID NO: 77658 - DNA, 1152 bp, Zea mays
  misc_feature: Ceres CLONE 1562657
  misc_feature: Encodes the peptide sequence at SEQ ID NO. 77659
ctccccgcggtggcggccgctctagaactagtggatcccccgggctgcaggaattcgtctcacccctagaaaaaacctcacagactcctcacacttagtactgttagccaggaacaagccccagcagcagcagcagcaatggccgtggagaacggcagcgccgacgaggcggcagcggtgaccgtgaccgtgaccggcgcccgcaccgtggcgccggccaagaaccgctgcactctcggcaccttcgacctcccctacatcaccttctactacaaccagaagctgctcctgtaccgcgccgcccccgactttccggacgccgtggggcgcatgacagccgcgctcgccgaggcgcctcgggtttttttaccgctcgcccggcccattccccacggaacaacggggggcgcgctggcagttctagggcgaacaagggcgcccaaggtctttttaggcctaagacccatggggctttccctttcaaactaccttccccgggaaggggaacctgccctctccccaagggcggaataaaggtgtcttgtcaaacaacctccgtggggcctctttaaacgcgggggtgtatgtaaaaccctcggaggggggctttccgcccggccccgcgggtttttttcgcgccggtctatattttgtcacaataattcctcaacttaaacacgctccttttaccgagattgggtggatgagaccaccctttttctaaatacacacccttagtgttctccttggagacagaaacacctcctccccccagtgggggagccccttccttttggtcccctcccgcggggggcgcagatatttcttgtgctcgcgggttgatgtatccccctggtttgtcctttcttgggtcccacttttatgaataacagggtgctcttgttttcccgcggtctccatgtagtctatttgtgggtattgagattatctccacgcgttcctcgcccgaaagtgctccctcccataataaatagagggcgcctccaaccggggtgctaataaaaagagggcgtgtgtggggtccgcccatttacctctccttttctccggagacctccccccgtgcgcgcgctcattagatgcgcggggcataataggcgttctgtttcctcaggggactaaattctctct

SEQ ID NO: 77659 - protein, 131 aa, Zea mays
  misc_feature: Ceres CLONE 1562657
MAVENGSADEAAAVTVTVTGARTVAPAKNRCTLGTFDLPYITFYYNQKLLLYRAAPDFPDAVGRMTAALAEAPRVFLPLARPIPHGTTGGALAVLGRTRAPKVFLGLRPMGLSLSNYLPREGEPALSPRAE

SEQ ID NO: 77660 - DNA, 764 bp, Zea mays
  misc_feature: Ceres CLONE 1562658
  misc_feature: Encodes the peptide sequence at SEQ ID NO. 77661
caaaagctggagctcaccgcggtggcggccgctctagaactagtggatcccccgggctgcaggaattcgtctcacccctagaaaaaaacggaactcatcccgctgtgcgcttcgtttcgtggcggcgaacggccggtcgagcgccgccgcccttggctgggtcttcactcagtccttcgccggcgacgagcgtccacctggtgtctactgaactgagcagacagtagcaagagccactatgctgttcttctcctacttcaaggagctcgtggggaaggaggtgacggtggaactcaagaatgacctggcgatccgcgggacgctccactcggtagaccagtacctcaacatcaagctggaaaacacccgcgttgtcgaccaggacaagtatccccacatgctgtcagtgcggaactgcttcatccggggctcggtggtgcggtacgtgctgctcccgcaggacggcgtggacgtggacatcctgcacgacgccaccaggagggaggcgcgcggaggctgatcggcatcggcatcggcccccctcacctgtgctgcttctccccggggaggagattgatctgccttgccctgatctcgtctggttgtacaaaacatatgctgattctgagtggccccaattcccccaggacaaaacttgatccaccaccccacccagctccctggcctgggaccttgcatgttcccttggctgtgtgggggggtggggttccagcacaccaccttgatccacccccccacccccg

SEQ ID NO: 77661 - protein, 93 aa, Zea mays
  misc_feature: Ceres CLONE 1562658
  misc_feature (5)..(72): Pfam Name: LSM Pfam Description: LSM domain
MLFFSYFKELVGKEVTVELKNDLAIRGTLHSVDQYLNIKLENTRVVDQDKYPHMLSVRNCFIRGSVVRYVLLPQDGVDVDILHDATRREARGG

SEQ ID NO: 77662 - DNA, 1191 bp, Zea mays
  misc_feature: Ceres CLONE 1562659
  misc_feature: Encodes the peptide sequence at SEQ ID NO. 77663
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (71)..(71): n is a, c, t, g, unknown, or other
  misc_feature (73)..(73): n is a, c, t, g, unknown, or other
  misc_feature (775)..(775): n is a, c, t, g, unknown, or other
  misc_feature (1018)..(1018): n is a, c, t, g, unknown, or other
gggtttttgtggatttatcaaatatttatttatacctatattaaactaagtgtgaagaannnnnccccccntntccaaagctggagctcccctcggtggcggccgctctagaactagtggatcccccgggctgcaggaattcgtctcacccctagaaaaaatccgagaccgggaggccttctctctctctctctctctctctggcgacggccatggtgcagcaacagcaacacagaatctacatcttgcagttcaggaagggcgagacggagcaggaggtggcatgcaaagtgtcgcagcccaagggcgtcgggcggcgggtcatgtactactaccaggactacggcagcggcggcggtggcaagagcggcaagacggtgcaacccagggcgctcggcgtgcggcgcttcttggccatgctcctgctctccttcctctgcgtggggacgctgttcgtggcgcccgtgtccttcctcccccacctgcattagctatgaaaggcggcgcggcggcggcggccacggctcgcgcgcggtggaggtggtccggggccgcagctcggctcgtgggggaacaaccagcctcttgctgacgaccgcaccgtccggagccccgccggaacatttcttctattcttagaggggggggggaactttggccttattggcaactccggccccagacagcgtgtacatttccacagtctttcggggtgtccaacccggggtgtaatctcgacaccaccccttgggggggaaaaccgcggaataaacanggtttccagtcatacaaccctccgcgccataatattggaggcaataggtccatcaaaacctgctggatatggggcgcgaacccaaattctggtacaaaaaagggttgagaaggctctatgggagctctggagacagagtgtgtctccctccagtgccgtacaccaccctctctacccgcgtgggttaaaaccgctggcgggcacctccaagacattataaccgggactctgctgggaggcgtnctccccccaacacatggcgggatggtataaaccccggagataacacggttttttaacaacccgaattttctacaattaaactgtgtgatccctttgtactcgcatttctattttggaaagagggggtgccccaccccattcactggaggggtcagttggggaggttgagaggg

SEQ ID NO: 77663 - protein, 92 aa, Zea mays
  misc_feature: Ceres CLONE 1562659
MVQQQQHRIYILQFRKGETEQEVACKVSQPKGVGRRVMYYYQDYGSGGGGKSGKTVQPRALGVRRFLAMLLLSFLCVGTLFVAPVSFLPHLH

SEQ ID NO: 77664 - DNA, 825 bp, Zea mays
  misc_feature: Ceres CLONE 1562660
  misc_feature: Encodes the peptide sequence at SEQ ID NO. 77665
  misc_feature (753)..(753): n is a, c, t, g, unknown, or other
  misc_feature (754)..(754): n is a, c, t, g, unknown, or other
  misc_feature (791)..(791): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (817)..(817): n is a, c, t, g, unknown, or other
ggagctccccgcggtggcggccgctctagaactagtggatcccccgggctgcaggaattcgtctcacccctagaaaaagcgagtacgccgcgtgcgacctcgaggctcgagcttgacgcccgcgtgccatggctcccacggcgccgacgcagcggccgacgatgcgccactcctccgcgttcctcctcccttcaaccgcaccgtcatcgcccgcgcctggtcccgatgacgccgccgtcgcgctcgtcgtcctcaaccagccgctgccccgcttcgcgcccctcctctggtccagagcggcggtgcgggtgtgcgcggacggtggcgccaaccgcgtcttcgacggcatgccggccctgctccccggccaggaccccgacgaggttcgcgcgagttacaagccagatgtaatcaaaggggatatggactcagtaagaccagaagtgaaggagcattattccaacttgggcaccagaattgttgacgagtcacatgaccaggacacgaccgatttacacaaatgcatagcttttatagctgagaattattctgccactaacaaatctaacctcagcatcttggtccttggagcacttggggggaaggtttgatcacgagatgggaaacatcaatgtgcttcatctcttcccaagcatcaatatcgtcctcctatcagatgattggtctgatctttctgctctcgaaaatgcatacccacggagattcacgttggaaaagtcgatcgagggaccnncactgtggattgatcccgaattggcatgccgtcgacngnnnccccccgaaccacccgggcttncgatggga

SEQ ID NO: 77665 - protein, 160 aa, Zea mays
  misc_feature: Ceres CLONE 1562660
  misc_feature (43)..(159): Pfam Name: TPK_catalytic Pfam Description: Thiamin pyrophosphokinase, catalytic domain
  misc_feature: SWISSPROT Homolog: EC 2.7.6.2 Thiamine diphosphokinase
MAPTAPTQRPTMRHSSAFLLPSTAPSSPAPGPDDAAVALVVLNQPLPRFAPLLWSRAAVRVCADGGANRVFDGMPALLPGQDPDEVRASYKPDVIKGDMDSVRPEVKEHYSNLGTRIVDESHDQDTTDLHKCIAFIAENYSATNKSNLSILVLGALGGKV

SEQ ID NO: 77666 - DNA, 927 bp, Zea mays
  misc_feature: Ceres CLONE 1562661
  misc_feature: Translation starting site: 194
  misc_feature (355)..(355): n is a, c, t, g, unknown, or other
  misc_feature (424)..(424): n is a, c, t, g, unknown, or other
  misc_feature (432)..(432): n is a, c, t, g, unknown, or other
  misc_feature (452)..(452): n is a, c, t, g, unknown, or other
  misc_feature (524)..(524): n is a, c, t, g, unknown, or other
  misc_feature (539)..(539): n is a, c, t, g, unknown, or other
  misc_feature (588)..(588): n is a, c, t, g, unknown, or other
  misc_feature (644)..(644): n is a, c, t, g, unknown, or other
  misc_feature (646)..(646): n is a, c, t, g, unknown, or other
  misc_feature (840)..(840): n is a, c, t, g, unknown, or other
ctccccgcggtggcggccgctctagaactagtggatcccccgggctgcaggaattcgtctcacccctagaaaaaatccttcccgagggaccgagaaagataagaaaggcggtggtcaacttgtgtcctgaggtgcccgtagaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatagttgtggttgacgggagcactgntcaacttgggtctgtgggatacagcaggacaagaagaattacaatagactgcgtccgttgagctatcgntggtgctngatgttttttctgctcgccnttttctcttatcagcaaagcaagctatgagaatgtctctaaagaagtgggttcctgaattaaggcactatgnctcctggcgtgcccnataatccttgttggagacaaaacttgatctgcgtgatgataagcagttntttgttgatcaccctggtgctgttccaattttcactgcccagggcgaagagctgangnagctaattggtgctgccgcctacatcgaatgcagttcaaaacccagcaaacataaaagcagtgttgaccagcaaataaggtggttctccagcaccaagcaaagagagggagaagaagtgcagaaggatgcaccatttgtactacaaaacgtagaggcacatctggctgcgcgctctgcatgatacatcgctccntgcttatatatatgctgatctgcacgctgccaaggaatggggggtttagatcctgccctacggtgggtaacacggtgtagtgacgtt

SEQ ID NO: 77667 - DNA, 838 bp, Zea mays
  misc_feature: Ceres CLONE 1562662
  misc_feature: Encodes the peptide sequence at SEQ ID NO. 77668
  misc_feature (632)..(632): n is a, c, t, g, unknown, or other
  misc_feature (725)..(725): n is a, c, t, g, unknown, or other
  misc_feature (781)..(781): n is a, c, t, g, unknown, or other
  misc_feature (806)..(806): n is a, c, t, g, unknown, or other
  misc_feature (807)..(807): n is a, c, t, g, unknown, or other
gctggagctcaccgcggtggcggccgctctagaactagtggatcccccgggctgcaggaattcgtctcacccctagaaaaagaaaacaatacctctcttcagaaattactgatgaatctattgatcgaaaatgcagggaagaattatcagaagaagactatgctgagatttccctcctacagaagagactaaaggaagagaagcagatcagaaatgagctgaaaaaaaagatggaactggagagaatggctgcatggaaaaatcggttagaggaatttgaaagtggccatcttcctttcatgtgcctgcaatacaaagataaggattcaattcagcacacgatccctgctgtatttattggaaacctcaactcatttgctgatcaaaagatcatgaacatggtggaagatgattcacttgtttctggcaagccgaaacgtgatagtggggaacaactttatcgcccatcttactatgtagctttaagttcagataattcatggtatctgttcacagaaaaatggattaaaactgtttacaagacaggtctacctgctgtcccttctgttgaagggggcacactcccctagagaaaccctgaaacagctccctcctgcgtgaagagttggtgntgggaataaagttgaaaaatcagaatacggctctttgttaagcatggaaggttctttagacacatgggtcgtggagtctcaatgttcctgtgncttaatagcctttcggaagacaatgaggtagaacgattctcccccagacatcaagnatgctgtagaatgctacagcacacnngaggaagaagggttcacatttaaagaaacaa

SEQ ID NO: 77668 - protein, 119 aa, Zea mays
  misc_feature: Ceres CLONE 1562662
MELERMAAWKNRLEEFESGHLPFMCLQYKDKDSIQHTIPAVFIGNLNSFADQKIMNMVEDDSLVSGKPKRDSGEQLYRPSYYVALSSDNSWYLFTEKWIKTVYKTGLPAVPSVEGGTLP

SEQ ID NO: 77669 - DNA, 863 bp, Zea mays
  misc_feature: Ceres CLONE 1562663
  misc_feature: Translation starting site: 116
  misc_feature (528)..(528): n is a, c, t, g, unknown, or other
  misc_feature (575)..(575): n is a, c, t, g, unknown, or other
  misc_feature (651)..(651): n is a, c, t, g, unknown, or other
  misc_feature (663)..(663): n is a, c, t, g, unknown, or other
tggagctccccgcggtggcggccgctctagaactagtggatcccccgggctgcaggaattcgtctcacccctagaaaaagggaaatccgcagattcccgtcgctacttcggccacatggctgcagcggcggcgtggaccggcgccgcatcccccaactcgctgctgctctcgcgctcgcctccccacgccgccgtgctcgcgccttcgtcggggagctccatgcggaggcggctcctgctcggcgtcggcaccccggccgtgggcggcgctggcggccgcggcgccgccagcggtgctgcaggacggggcagtcactgtgctcatcaccgccggcgcctactctcttgtgcgcgtcttcgacgagctcaccgagcggcggctcatcgaaaagagcttgagcaggaaggttgtgcacgtgcctgtccggcgtcctggttcatggtcatcttggcccctgttcagcattcgacagaagcacggtattttcgcccgcggttgtcccgttcctgaactccatgaggcttctngatatatggactccgtcctctacactgatgaagctctgggtaaaatncagtggacacttggagggaaaaccagaggaatttgctgagaggtccaactccatttattgtccctgtgcgcctgtncagcgttttagntcttccgggcgtgagccccccatcgggatccgtcttcttgtcaatgatgagccggggggcgatggttttgctacatgtttggggggaaagaggtatgcctccaacaagctgcatttcatccggagaagagctgggcgggaaactcctcgaggtttcaattccgggttcccggccggcccgcctagaatgatgcccactct

SEQ ID NO: 77670 - DNA, 808 bp, Zea mays
  misc_feature: Ceres CLONE 1562667
  misc_feature: Encodes the peptide sequence at SEQ ID NO. 77671
  misc_feature (538)..(538): n is a, c, t, g, unknown, or other
ctccccgcggtggcggccgctctagaactagtggatcccccgggctgcaggaattcgtctcacccctagaaaaactctttccaaaccggcaaatcctcagatccgccccctcctccgcctccgcctccgcctcctgtaccctcacgcggtgcttccacagccctcccacctccgaatccagatccgccgccaccaactcctgcttctcacctcctaggctgcttcgcgcgacaacctccgcgaggagcagcaggagcggcggcggcggcatggggcgggacggcggtggcggtgtcgccggcggaatgtctgaatcggtgctgcggaaggtgctcctctcctacttgtacgtcgcggtgtggatcttcctctccttctccgtcatcgtctacaacaagtacatcctcgaccccaagatgtacaactggcccttccccatctcgctcaccatggtgcacatgggtttctgctcatccctcgccgtcgcgctcgtccgcgtgctccgcgtcgtcgacctccccactctccctcatgacgncgcagctctacacctcctccgtcgtccccatcggcgcgctctacgcgatgtcgctctggttctccaactccgcatacatctacctgtctgggtcattttatccgatgctcagggggcttatgcccgtcgccgtctacttcattgggggtctaattaaataaggaaaccttcggggccctcccccatggggaaacagcctcccaattcccttgggggggggcattgcccccttaaggggaggcgccctccaaaagggccgggggccccccc

SEQ ID NO: 77671 - protein, 141 aa, Zea mays
  misc_feature: Ceres CLONE 1562667
  misc_feature (90)..(90): Xaa is any aa, unknown, or other
MGRDGGGGVAGGMSESVLRKVLLSYLYVAVWIFLSFSVIVYNKYILDPKMYNWPFPISLTMVHMGFCSSLAVALVRVLRVVDLPTLPHDXAALHLLRRPHRRALRDVALVLQLRIHLPVWVILSDAQGAYARRRLLHWGSN

SEQ ID NO: 77672 - DNA, 829 bp, Zea mays
  misc_feature: Ceres CLONE 1562669
  misc_feature: Translation starting site: 233
  misc_feature: SWISSPROT Homolog: EC 3.4.22.1 Cathepsin B
  misc_feature (699)..(699): n is a, c, t, g, unknown, or other
  misc_feature (719)..(719): n is a, c, t, g, unknown, or other
ctggagctccccgcggtggcggccgctctagaactagtggatcccccgggctgcaggaattcgtctcacccctagaaaaagagaatcatccaggaggacatcatcgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccgttgcagcacaattgggaacatacttgatcaaggtcactgtggctcttgttgggcttttggtgctgtggagtgcctccaggaccgtttttgcattcacctcaacatgagcattttactttcagtcaatgacctactggcatgctgcggttctatgtgcggcgatgggtgtgatggaggctatcctatagaggcatggcgctactttgttcaaaatggtgttgttacggatgagtgtgatccatacttcgacccggtcggttgcaagcatcctggatgcgaacctgcttatcctacaccaaagtgtgaaaagaaatgcaaggagcagaaccaagtttggcaggaaaagaagcatttcagcattgatgcgtacagaataaattcagatccacatgancataatggcagaagtctacnaaaatggttccctggtagaagtttgcttttccacaatttttaccaagggattttcccccaaccttcaaaaaatcttggagtgggcaaagcccattccccgggggggattt

SEQ ID NO: 77673 - DNA, 934 bp, Zea mays
  misc_feature: Ceres CLONE 1562672
  misc_feature: Encodes the peptide sequence at SEQ ID NO. 77674
  misc_feature (638)..(638): n is a, c, t, g, unknown, or other
  misc_feature (741)..(741): n is a, c, t, g, unknown, or other
ctccccgcggtggcggccgctctagaactagtggatcccccgggctgcaggaattcgtctcacccctagaaaaaaatagtggggtgctgtacgaggatccttacatccagattggcttgaaagcggagtggcgtgcccatcatggccgtcttgttcttttcctgggtaacaaaaatacttcagcccttacgtcagtgcgggcgctgattttgcctcctagtcatttgaaaatggaactttcgtcagttcctgatactattcctccaagagcgcaggtgcaagttccccttgaggttgcgaatctccttgcaagtagagatgttgcggttctagatttctcgtatgcttttgggacttcactggtggatgccaaacttcgactccctgttgtattgaataaatttttgcagactataactcttacccctgaagaatttttctcccagtggaaagcgcttactgttcattcgctgaaggttcaagaagtggttaaaggtgtgaaacccatgcctctttctgagatggctaatcttttcatgagccttcacttggcggtcgctcctggacttgataacaacccgaacaatctggttgcatgcacgacattcttttctgaagcaacacgtgccatgctttgntctgatacgagttgaaacagatccacaagacaggacccaacttgcggctaaacagtgcctcggggcgaccatattttgacattcgaagttgaaagagtcatcnaaagaacatctggttgatatcccaaaggactcaggtcgccccaacctcgcgcagcagtccagccacagttggcctactacagcacctgcaacataacattgaccctggtaccatgctttgctgaatttgctatgagaagtaaccccaaagaaattaatgttttgatgtacatgaacagttttttaatacgaag

SEQ ID NO: 77674 - protein, 216 aa, Zea mays
  misc_feature: Ceres CLONE 1562672
  misc_feature (19)..(128): Pfam Name: Alpha_adaptinC2 Pfam Description: Adaptin C-terminal domain
  misc_feature (212)..(212): Xaa is any aa, unknown, or other
PRGGGRSRTSGSPGLQEFVSPLEKNSGVLYEDPYIQIGLKAEWRAHHGRLVLFLGNKNTSALTSVRALILPPSHLKMELSSVPDTIPPRAQVQVPLEVANLLASRDVAVLDFSYAFGTSLVDAKLRLPVVLNKFLQTITLTPEEFFSQWKALTVHSLKVQEVVKGVKPMPLSEMANLFMSLHLAVAPGLDNNPNNLVACTTFFSEATRAMLXSDTS

SEQ ID NO: 77675 - DNA, 803 bp, Zea mays
  misc_feature: Ceres CLONE 1562673
  misc_feature: Encodes the peptide sequence at SEQ ID NO. 77676
  misc_feature (721)..(721): n is a, c, t, g, unknown, or other
ctacccgcggtggcggccgctctagaactagtggatcccccgggctgcaggaattcgtctcacccctagaaaaagccctaaactcacaagcccgtcacagaccgacaacgcctaggcaagcagcaagcgtacacgtaaacgtacacctacctcggcgagcaaaaggcaaaacgctgatcggagcaaccaacgaagcccgcagccatgccgacggccacggccacggcggctcctcgccacgccgcgctcttcctgctgctgctgctcggcctccacgccacgttcgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcgccggcgggtggggcggcggctacggcgggcccgccggcgggtacgcccgcggcggcgtggtggcgcccaccgtgacgtgctccgagaaggggccctgctacaggaagaaggtcacctgccccaagaagtgcttctcctcgtacagcggcgccggcaagggatacggcggcggcggcggcggcggcagctgcaccgtcgactgcaaggtcaagtgcacggcctactgttgattcgactcgtcccgctcttagcggtttgacagcntagtggctaggcggtggcggcctgctagctgctggttggggtgaatggccgtggtgcgtgtccggtgaactgaattaccgcg

SEQ ID NO: 77676 - protein, 160 aa, Zea mays; identical to SEQ ID NO: 77144
  misc_feature: Ceres CLONE 1562673
  misc_feature (13)..(148): Pfam Name: GRP Pfam Description: Glycine rich protein family

SEQ ID NO: 77677 - DNA, 755 bp, Zea mays
  misc_feature: Ceres CLONE 1562675
  misc_feature: Encodes the peptide sequence at SEQ ID NO. 77678
  misc_feature (266)..(266): n is a, c, t, g, unknown, or other
  misc_feature (276)..(276): n is a, c, t, g, unknown, or other
  misc_feature (287)..(287): n is a, c, t, g, unknown, or other
  misc_feature (289)..(289): n is a, c, t, g, unknown, or other
  misc_feature (290)..(290): n is a, c, t, g, unknown, or other
  misc_feature (298)..(298): n is a, c, t, g, unknown, or other
  misc_feature (299)..(299): n is a, c, t, g, unknown, or other
  misc_feature (352)..(352): n is a, c, t, g, unknown, or other
  misc_feature (353)..(353): n is a, c, t, g, unknown, or other
  misc_feature (435)..(435): n is a, c, t, g, unknown, or other
ctccccgcggtggcggccgctctagaactagtggatcccccgggctgcaggaattcgtctcacccctagaaaaaagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggnattgggggtnggcctgaccgntnncgacgtcnnaccccccaaaccgggggaaaaaaaggggccaaggggggcccaaaggggggcgnnataacaccccaattttttctccacaaaaaaaaaaaaaggggcggggcgaaaaacattctgtggggagagtaaaaaaaccccnctcccctcctcaaacgggagggagaagagtttcccccccccggggaaatttttttggggaaaaaaaacccccttttttttttggtgggcccccccccccctttggataaataagggggggggccccccccttttattaaaaaaaaaaaacacccccccccctagagagaagaaaaaaaaaaaaaaaccgcctttttcttttttttttttttataaaaaaaaaaaaggagggggggggggtgggtgttaaaaaaaaagagcggggggggggggggggggggccccctttctttttattaaaaaaaaaaaaaaaaaaaaaaa

SEQ ID NO: 77678 - protein, 49 aa, Zea mays
  misc_feature: Ceres CLONE 1562675
  misc_feature (45)..(45): Xaa is any aa, unknown, or other
  misc_feature (48)..(48): Xaa is any aa, unknown, or other
MAASMISSSALAVAPQGLPPLGRRASSFAVVCSKKKIKTDKPYGXWGXA

SEQ ID NO: 77679 - DNA, 783 bp, Zea mays
  misc_feature: Ceres CLONE 1562678
  misc_feature: Encodes the peptide sequence at SEQ ID NO. 77680
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (109)..(109): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccaccngggaaatgaaaataaaaagggcggccgctcaaaaatagtggacccccggctgcaagaatcgtctacccctaaaaaaatgaaacacgggtgttgttcacatttggtaccagagccaatactggatcctccacacgggtactggacgagatcgcaatcgaagttgggcggcatggcgccagcgaagaaggacgatcctttgtccagcttctggcgaatacgagaaggaaaaaagaaatcaccgactcaagagcgattcgggggcggtgggaaaaaggaggcggcggtcaaggtggtgatgaaggagcagggagatcttcagaagtggaaaacggaagtggaaagcgaaaagtgaagggaaaattttctggaaatgctctaaaaagcgaatcccagaatccaagatggggaaaagaatggaaagaaggaaagcccgcctccggggtttttccggggtcccaaaaaaaaagggaaagaaaaagaaaggggaaggaaaagaaaacgaaaattttccttgaaaaaaccccggccaaaacaaaaatcctgaaaatccctttccaaaaaaaatttttgggaaaattttttcccgtcccccgtggaaaaaaaaaaaaaagggccccggaaaaaccccaaaaaatttccttccccccaaaaaatggggaaaagtaaaaatttgg

SEQ ID NO: 77680 - protein, 60 aa, Zea mays
  misc_feature: Ceres CLONE 1562678
MAPAKKDDPLSSFWRIREGKKKSPTQERFGGGGKKEAAVKVVMKEQGDLQKWKTEVESEK

SEQ ID NO: 77681 - DNA, 898 bp, Zea mays
  misc_feature: Ceres CLONE 1562680
  misc_feature: Encodes the peptide sequence at SEQ ID NO. 77682
ctccccgcggtggcggccgctctagaactagtggatcccccgggctgcaggaattcgtctcacccctagaaaaaaaaatcagcggtggggccgagagcgaccgccttccctctttatcctccccgtctcccgccgtcgtcttcactgattcactccgacgcctcccctgccgctgccgcaactgggaggcggtccctgtcgcgcgcgacgacgagccttcatgacggggacacgctgctgattcatagcgcaccacccgccggttcgccctcgggctctctcgcgcccctccaacggattactggtgcccaacgcttgtgcttgctgtgtagcctggcgcgtctgctcgcggccgatacctccgcggccggcggcgatgggccaggacctcgtcgagatccatccgagcgagctccagttcacctttgaggtgaagaacaaagttcatgtgtcgtccacctaatcaacaagtccaacgactatgttgctttcaaggttaaaaacacatctcctaaaagatactgtgttcgaccaaatactggggttatccttcccaggaaaacatgtgaattcacagttaccatgcaagcgctccgaactgctccgccagacatgcaactaaaagacaagtttttggtacagaccacaattggtccttatggtacatctgacgaaggactcgttccctgcttttttctcaaagaaactggcagatacattgaggaaagcaattgagagttggtcttgttaggcctaccatccttgaagagcaccgactataaaattctgaccctggccagttgttgaagtcctgttctgaagagggccaattagagacgaatgcgatgctgcaaaaaatcctgccctcggacagcccacgattggctgaaacctccca

SEQ ID NO: 77682 - protein, 50 aa, Zea mays
  misc_feature: Ceres CLONE 1562680
MQALRTAPPDMQLKDKFLVQTTIGPYGTSDEGLVPCFFLKETGRYIEESN

SEQ ID NO: 77683 - DNA, 833 bp, Zea mays
  misc_feature: Ceres CLONE 1562681
  misc_feature: Translation starting site: 160
  misc_feature (673)..(673): n is a, c, t, g, unknown, or other
  misc_feature (779)..(779): n is a, c, t, g, unknown, or other
  misc_feature (805)..(805): n is a, c, t, g, unknown, or other
acccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgccnggtggcccgctcggggaggtggtcgacccgctgtaccccggcggcagcttcgacccgctcgggctcgccgacgaaccggagggcgtcgcggagctcaaggtcaggnagatcaagacggccggctccgcatgntctccatgtttcgctttctcgtgcaggc

SEQ ID NO: 77684 - DNA, 794 bp, Zea mays
  misc_feature: Ceres CLONE 1562682
  misc_feature: Encodes the peptide sequence at SEQ ID NO. 77685
  misc_feature (497)..(497): n is a, c, t, g, unknown, or other
  misc_feature (710)..(710): n is a, c, t, g, unknown, or other
  misc_feature (736)..(736): n is a, c, t, g, unknown, or other
ctcaccgcggtggcggccgctctagaactagtggatcccccgggctgcaggaattcgtctcacccctagaaaaaggcgtggagctaactacccccgcgctggctcgccaccaccgccgcagcaggcgtgggaatctgggcagcgccccgcggagaagaggaggcagcgcgctctccgtccgccatggcgggctcttccgaccccgacaagctcatgagcaaagccgacaaactaacaaaattgagttttacaagatggaatgctgattggaaaagcgctacctccttgtatgagcaagctgcaattgcgtataggttcagaaaggacaatgagaaagcaaaagatgcttttgagaaggcctcaaaaggacaggaaatgatctcctcaccatgggacgctgctaagcatatggaatctgctgctgctttagcaaaggagcttgggcgctggaatgaagtatctgatttctatcacagagcttcagaattataccgtgnaatgtggaaggccacaacctgcatctgatgctctagcaaagggtgccagtgcattggaggagaaatctccagaagaagctatcaaaatgtatgaatgaggcttgttcagttctagaagaagatgggaaggaacagatggctttttgacttgtaccgtgccgcagcagctttgtatatcaagatggagaaatattcagatgcccgctgctttgnttttttagacttgggtcagcctgctngataagtgcaatgcccatcatagcccatgcaaggcctattcctgagtgcgatcatcat

SEQ ID NO: 77685 - protein, 113 aa, Zea mays
  misc_feature: Ceres CLONE 1562682
  misc_feature (105)..(105): Xaa is any aa, unknown, or other
MAGSSDPDKLMSKADKLTKLSFTRWNADWKSATSLYEQAAIAYRFRKDNEKAKDAFEKASKGQEMISSPWDAAKHMESAAALAKELGRWNEVSDFYHRASELYRXMWKATTCI

SEQ ID NO: 77686 - DNA, 826 bp, Zea mays
  misc_feature: Ceres CLONE 1562684
  misc_feature: Encodes the peptide sequence at SEQ ID NO. 77687
  misc_feature (704)..(704): n is a, c, t, g, unknown, or other
  misc_feature (716)..(716): n is a, c, t, g, unknown, or other
ggagctccccgcggtggcggccgctctagaactagtggatcccccgggctgcaggaattcgtctcacccctagaaaaaggaggatagatggctcatggctgccatcgtctaggctcaacatccgaaagacgggccatggtcggtttccttcctcaccccagcggcggacatctatccgaaaataggccgcacctcgtccgctttgctccttgttcatccttcacctgctgatggcggcagcggcgcggccatccaacgccactcttctcgcgcgcctccgggacggcacggccaagttcgagctgctggatgactctgcgtttgcgcttgcgcacgcgcccccggcctggccccgacttcactgctttgccaggattgccccctcgttgaggaggtgggtggtcggcagcgttgaacaaggtggagcattacggggttcagagggttaccggcgatggccggtgcatgtttcgagcgctggctaaaggaatggcaaaaaacaaggggattcctttggccccaagggaggaggtagaagatgcagatgatttacggatggcagtgaaagaaattatatgtgacagcgagactgggcggcaggagtacgaagaagcagttatagcaattactgtggagcaatcattgaaacgctactgccaaaggataaggaggcctgatttctggggggtggagagtcagaattncctggttttgtnctagactgtgtcggcagccaataattatttatattcccagagcgtgagtaccatggtccgggggtaaaggggttcaaccctatagcctgaaaaatgggtttggaatttcc

SEQ ID NO: 77687 - protein, 83 aa, Zea mays
  misc_feature: Ceres CLONE 1562684
  misc_feature (80)..(80): Xaa is any aa, unknown, or other
MFRALAKGMAKNKGIPLAPREEVEDADDLRMAVKEIICDSETGRQEYEEAVIAITVEQSLKRYCQRIRRPDFWGVESQNXLVL

SEQ ID NO: 77688 - DNA, 811 bp, Zea mays
  misc_feature: Ceres CLONE 1562686
  misc_feature (613)..(613): n is a, c, t, g, unknown, or other
  misc_feature (736)..(736): n is a, c, t, g, unknown, or other
  misc_feature (744)..(744): n is a, c, t, g, unknown, or other
ctggagctcaccgcggtggcggccgctctagaactagtggatcccccgggctgcaggaattcgtctcacccctagaaaaaatttagacaaaactaattaagttcatatatttatatatgtaatatatttgtatattatcttaaatcatatgagagagagagttatatactacattcatgttataacgaagtaagtagaagagtgctataagttgtacatcggaaaaataacatgtaaatttatagaatcaattttcatctctcaccccatgaatttgagatagacttatatggtaactttggaaagtagtggaatgtcacattctaaaaaaaatagcatattccaatagtaagattccaattcctcaaaatgaaaggaaacaaacggggcctaagagaaatctgtttgagatgaattctaattataggtgcttatactttttggttcaacatgccttgaaaatttagatgtgctgttctatgagtttttggcattatagtcattattgctcgattgatgcatgtgtcacttcgattgcagcacaccataatacccatccaacacctttctgagcttttgcctgaaccttgtcagcagagcatttgaatttcanggctgatgcctttgcccagaacctttggatatgccccctcagcttcggaagcagcccttggttaaactaacaggaggaagaactttgtctggcgatgaaacaccggattccttgggtattccnggatattnattaactcccaacccaccaaatcgttcgaagaaggctgccaagcttcttggaagaattcagacagcc

SEQ ID NO: 77689 - DNA, 883 bp, Zea mays
  misc_feature: Ceres CLONE 1562687
  misc_feature: Encodes the peptide sequence at SEQ ID NO. 77690
  misc_feature (628)..(628): n is a, c, t, g, unknown, or other
  misc_feature (629)..(629): n is a, c, t, g, unknown, or other
  misc_feature (705)..(705): n is a, c, t, g, unknown, or other
ctggagctcaccgcggtggcggccgctctagaactagtggatcccccgggctgcaggaattcgtctcacccctagaaaaatggatatgttggacaaaaaaataggatctctgatagccgaatcagatgatttaagggttacagttcaaagcaaagattctttactacaggttgagagggccaaaattgaggagttgatgcgtaaatcagatggtctagaagcttcattgagccaaaaggattcccagatagggttacttcgccgggacagagcatccaatcagcagagcagatctataaatttgcctggcacttcagagattgagcaaatgaatgacaaagtaagcccagctgcagttgtcactcagattcgaggcgcacgaaaagcatcaatgaccaagttgctattgatgtagaggatggagaaggacaagccttttgatgatgaagatgatgacaaagcccatggtttcaagtcattgactatgtcacgctttgttcctaaattcactcgaccggtatcagacagaattgatggggatgtgggtctcagggcgatagattgctcatgaggcaaccgaccttaaagactcggcgtcttgaatatattggattgcactgcatgcttnntgcttgctagttttatttgaactcctgtaaagatgtagcctcctcctgggcgagtgactgtacagttactctgtgntctatagcaagttatatctaaaacagaagcagtttgcactgattacggtgatcccttttccgaaatgtttacgaaataccttgagcccgtattggcagctgcagaaatcctccatgaatgcatttcaccccttcatccctgggggcaatcctggctacaacctagtttggggttccat

SEQ ID NO: 77690 - protein, 111 aa, Zea mays
  misc_feature: Ceres CLONE 1562687
MDMLDKKIGSLIAESDDLRVTVQSKDSLLQVERAKIEELMRKSDGLEASLSQKDSQIGLLRRDRASNQQSRSINLPGTSEIEQMNDKVSPAAVVTQIRGARKASMTKLLLM

SEQ ID NO: 77691 - DNA, 792 bp, Zea mays
  misc_feature: Ceres CLONE 1562690
  misc_feature: Encodes the peptide sequence at SEQ ID NO. 77692
  misc_feature (576)..(576): n is a, c, t, g, unknown, or other
  misc_feature (577)..(577): n is a, c, t, g, unknown, or other
  misc_feature (632)..(632): n is a, c, t, g, unknown, or other
  misc_feature (633)..(633): n is a, c, t, g, unknown, or other
  misc_feature (640)..(640): n is a, c, t, g, unknown, or other
  misc_feature (641)..(641): n is a, c, t, g, unknown, or other
agctccccgcggtggcggccgctctagaactagtggatcccccgggctgcaggaattcgtctcacccctagaaaaagtccccttcctccccttccgtctcgcaacaggcgaggcgagagaactcgtcgtcgaagcgaaatatagccagcgcaccaatcccaattcccaacccgacgcaacgcaacgcaacgcaacgcacctcatcccggttgcttgcgccaacgtaggggatcgcctcgccccgccccgccccgccccgccccgcttcgcgctcctccttcctgcctgccgtaaccgcgccgtgcagctgtgcaaggttcagtaggttgttgagtctagataccagatgatggacctgtccacgacttcagtgctggcagctaaagcttacaaatacaaagcagaatcacttgttaaggagtaccttcttgcagattcgtatgtttcatacactgctgtacttggtgggatcctgatgtgcaagatggcttatgacataacaagcataatcagctcattgtactacaagggttatggttcacttacaaaaacccaaagcttgagtggaacacaggnngcatgtcactatccatgcgatatcatcacagtggtgtcagtgtacctggttttcnntctcaanncttatctctgatgagctggatggactagtaacttatcgggagtcaaatctattcaatttccactttgggggtttcctggtgggggatttcaatcattgaccttgcctaagaaattatggggctatccctccccctggggggaaagggaaat

SEQ ID NO: 77692 - protein, 101 aa, Zea mays
  misc_feature: Ceres CLONE 1562690
  misc_feature (77)..(77): Xaa is any aa, unknown, or other
  misc_feature (96)..(96): Xaa is any aa, unknown, or other
  misc_feature (98)..(98): Xaa is any aa, unknown, or other
  misc_feature (99)..(99): Xaa is any aa, unknown, or other
MMDLSTTSVLAAKAYKYKAESLVKEYLLADSYVSYTAVLGGILMCKMAYDITSIISSLYYKGYGSLTKTQSLSGTQXACHYPCDIITVVSVYLVFXLXXYL

SEQ ID NO: 77693 - DNA, 1102 bp, Zea mays
  misc_feature: Ceres CLONE 1562691
ctggagctccccgcggtggcggccgctctagaactagtggatcccccgggctgcaggaattcgtctcacccctagaaaaagctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatagacacaggtaacgctaccatggcgagccaggcgatgaacagcagactagtggcgcaatcaaagcaaaggagactgtcaagcgcagctgcatactctagacctctgagtcggtgcaacagagagccctcgagtagatatacgaaacgttactggaggttgatccgaacaattgcgacgcctgaggatcgcggcttgaagactgctggcacatacgtgccacgcatggagtgggtcatgtcctatgttccagatctaccgcaacgccaagagccgcgtttgaggaagattggtagagaagaagtgtccccaatatgccttcttaccgcgtggaggatgttccgcgcggaacgggtcaactgtggctagggtgtctcgttaaaacttgcaaggaccggtccccacttgtttttgccccagggttgcggaagcgtttcttatgatcttagtcttcccccaaaggataatgtgacgcctcgcccatcaccgggctccgagtatttctgtgccacgagggatacgcacggtagaaacctctttatacgtgtgatgcgacacatgagactattgttccctagccccccaaaaacttcccgtgcgttagtggtaccacaataagcctcggtgaagaaattcgggaactcgccactataagtcttaggccccctggttgttatgccccatatttgcaaacaggtgaggtatccttcgatctagcgatggttctcttagagatgactaatagcttctggtaacactcttctctggatgtttttccccaggcgcaaagcgagtacgtgcgcctgggctcttttattaccagcgcttgatcgcgagaatgaaaccatcgttaacgcctgtgtacttctcctttgcgaatgcctcgcgatcgtaatcgcttcc

SEQ ID NO: 77694 - DNA, 841 bp, Zea mays
  misc_feature: Ceres CLONE 1562692
  misc_feature: Encodes the peptide sequence at SEQ ID NO. 77695
  misc_feature (764)..(764): n is a, c, t, g, unknown, or other
  misc_feature (808)..(808): n is a, c, t, g, unknown, or other
ctggagctccccgcggtggcggccgctctagaactagtggatcccccgggctgcaggaattcgtctcacccctagaaaaacggtcctccccctcgaggcctacgcacaatagattcgatctcgagtcctcgaatcctgccttttcctctggtcaggaaagcatgagcttgatttccggcgcttctcgccgtcgagctcgaaccagaagataagaagaatccgctaggggcgagccccatagaagatggccccgcacccgcaggaggacaaatcagatcggcacagcagcggcgccggtgcgtcgagggagcaggaacggcggccgtccaaggcatggggaatcctcatcttcggcctcatcggcgtcaccaccgccagtttcgctattactcaagttcgcaaaagcatggactggttctacactcagttgaataaagtgcagtcaacatcatcttggacttggaggtatacaagtaataactcaagtcgtggaagcttcagtgaggaagctaagaaaagatattatcagcgaatgcagcaggaatatgaagaggaacaagagagagttcaaagaataaggcatatggcagagtgtcttcaacagagagaggaataaattttggacgaagttatgaaagctgggaggggagaatggcccctcctcgtggctacaattacatcccctcgggggatgattggtattggccagaaccgatactttctcactcagaacataaaaaatagggcggacgtacacaccggcnagggacctaggggttttatcctatgtcgcaatcaactatggcangttcctaaggtcttggacagatccacgagcgac

SEQ ID NO: 77695 - protein, 123 aa, Zea mays
  misc_feature: Ceres CLONE 1562692
MAPHPQEDKSDRHSSGAGASREQERRPSKAWGILIFGLIGVTTASFAITQVRKSMDWFYTQLNKVQSTSSWTWRYTSNNSSRGSFSEEAKKRYYQRMQQEYEEEQERVQRIRHMAECLQQREE

SEQ ID NO: 77696 - DNA, 1200 bp, Zea mays
  misc_feature: Ceres CLONE 1562693
  misc_feature: Encodes the peptide sequence at SEQ ID NO. 77697
  misc_feature (440)..(440): n is a, c, t, g, unknown, or other
  misc_feature (877)..(877): n is a, c, t, g, unknown, or other
  misc_feature (901)..(901): n is a, c, t, g, unknown, or other
  misc_feature (1014)..(1014): n is a, c, t, g, unknown, or other
  misc_feature (1015)..(1015): n is a, c, t, g, unknown, or other
  misc_feature (1086)..(1086): n is a, c, t, g, unknown, or other
ttatttttgtcaaacccctaaattaaaacaatatggaaatggatttaactggattatttttttatgttttttcccaagctggaactccccgcggtggcggccgctctagaactagtggatcccccgggctgtttgaattcgtctcacccctagaaaaaactccaactctcaagcgtctctactcctctaccgccactctcaactctccaagttctcttctccgtcgaccgctctacacgtctcttgtcgacctgcacaccaaggtggaagaaggaagcacacagcgcatggatccatggatactcagccagccttctcagagccttgacctgcgcgtcgggctgccgccgatcagcctccaccaccaggcgccggcggccgtcaccttgcccagggcccaagctactcgtcgaggagaaattactcctgccgcctcccangaaagaaccagaggtcgcggcgtcttgatactcacccccgggcgggatgggacgaggaaaaaccggccgcctgggcgaaggatcacttggcctaagttggccctccatggaacgaatggttactttctgggggttactaccaccgcaaaatgagtggaccctcaagcgggccaacaaaccctgcgttggaaacccacccccctttcaaacactaccattgggaaaggggcgggggcatacacatgaagcaacccggataccacgcgaaaaagctcgacaaagtaagacctaaggatagccaccagggaaacaccctcggacgacccctattccgccaatcgtttcggggagaagtgtttatacctggatgagcgcccagggagttgcctaaacccctctagagacaagagtagagcacaactctaagggaactccanataaaaccaaaagatgaggaagcnattccaggaggaggaaagtccagttaaacaaaaagcgtacgtttctctgatggaagatggtgcggaaagtatacaaataataccgcgaggggtggtccaaataaagaaagggnnagcataactattgagactgaacccacgagggacagtaccacgcatacccgagaggtagtgtttcaaggaanaaggtgctacccatgaatgcaaagcgaggttattcgtggccaacaaaagaaacacctaagagtaaaatgcgcctgtggcatgcagaaacacaatcatatcacagtgtctccccg

SEQ ID NO: 77697 - protein, 81 aa, Zea mays
  misc_feature: Ceres CLONE 1562693
MGRGKTGRLGEGSLGLSWPSMERMVTFWGLLPPQNEWTLKRANKPCVGNPPPFQTLPLGKGRGHTHEATRIPREKARQSKT

SEQ ID NO: 77698 - DNA, 822 bp, Zea mays
  misc_feature: Ceres CLONE 1562694
  misc_feature: Encodes the peptide sequence at SEQ ID NO. 77699
  misc_feature (782)..(782): n is a, c, t, g, unknown, or other
ctccccgcggtggcggccgctctagaactagtggatcccccgggctgcaggaattcgtctcacccctagaaaaaaggaggcaagtcgtgccgtgccgtctgctccttgcctgctctgctggtctcgccgttgccggcttgccccgtccgtgcgtccatctgtttcctccttggatcctcgacaagcaatggccatggaggaggagcagacaccacccgagctgcgctacctctcgggcctgggcaacaccttcacgtcggaggcggtgccggggtcgctccccgtggggcagaacaacccgctagtgtgcccgctgggactctacgccgagcagctctccggcacctccttcaccaccccgcgcgcccggaacctgcgcacgtggctgtaccggatcaagccgtcggtgacccacgaacccttctatccgcggaaccccaccaacgagcgcctcgtcggcgagttcgaccgcaccaccaccgtcgccacgcccacgcagctgcgctggaggcccgccgacgtgcccctccacccgggcctcgacttcatcgacggactctacaccgtctgcggcgccggcagctcatgcctccgacacggatacgccatccacatgtatgctgctaacagcccatggatggatgctccttgtgcaatgcggacggtgacttcctcgttgtccccagcaaggaaggttattattcacaaccgagtgcggaaagctgctggtttcacccggccgagatcgtcgtgatcccctcaagtctcccgatttgctgtcnactttgccgaaagggcccctcgccgtggtattttcctcga

SEQ ID NO: 77699 - protein, 188 aa, Zea mays
  misc_feature: Ceres CLONE 1562694
  misc_feature (11)..(186): Pfam Name: HgmA Pfam Description: homogentisate 1,2-dioxygenase
  misc_feature: SWISSPROT Homolog: EC 1.13.11.5 Homogentisate 1,2-dioxygenase
MAMEEEQTPPELRYLSGLGNTFTSEAVPGSLPVGQNNPLVCPLGLYAEQLSGTSFTTPRARNLRTWLYRIKPSVTHEPFYPRNPTNERLVGEFDRTTTVATPTQLRWRPADVPLHPGLDFIDGLYTVCGAGSSCLRHGYAIHMYAANSPWMDAPCAMRTVTSSLSPARKVIIHNRVRKAAGFTRPRSS

SEQ ID NO: 77700 - DNA, 938 bp, Zea mays
  misc_feature: Ceres CLONE 1562695
  misc_feature: Encodes the peptide sequence at SEQ ID NO. 77701
  misc_feature (766)..(766): n is a, c, t, g, unknown, or other
ggagctccccgcggtggcggccgctctagaactagtggatcccccgggctgcaggaattcgtctcacccctagaaaaagtgcgctgcggacgggtcggatctgagacgaggcgagacgaccccccctcccctcaaccggaacttgttttaccccatctcatcccactgactccacccacccgcccgctgcctccgccggatctcgtcggactcggatccgcccgaccaccccgcgccgccgccgcgcagcagcagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcgactgacgagacccctgagctgatgcccctcagccatgtccttgccaccaagcttggtgctcgtctcacagaggttcgcaagaatgggacctgcccntggctcatgcccgatggggagacccaggtgacagtggagtacggcaacgaggttgggcgcaagggttccattcgtgtggaaaaaagtcttcatctcctaccagcacgacgagacagtcaccaacgacgaaattgcctggctgactgaaggaaacccgtcatcaagccagtca

SEQ ID NO: 77701 - protein, 213 aa, Zea mays
  misc_feature: Ceres CLONE 1562695
  misc_feature (5)..(104): Pfam Name: S-AdoMet_synt_N Pfam Description: S-adenosylmethionine synthetase, N-terminal domain
  misc_feature (119)..(203): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MAGLDTFLFTSESVNEGHPDKLCDQVSDAVLDACLAEDPDSKVACETCTKTNMVMVFGEITTKANVDYEKIVRETCRNIGFVSNDVGLDADHCKVLVNIEQQSPDIAQGVHGHFTKRPEEIGAGDQGHMFGYATDETPELMPLSHVLATKLGARLTEVRKNGTCPWLMPDGETQVTVEYGNEVGRKGSIRVEKSLHLLPARRDSHQRRNCLAD

SEQ ID NO: 77702 - DNA, 878 bp, Zea mays
  misc_feature: Ceres CLONE 1562697
  misc_feature: Encodes the peptide sequence at SEQ ID NO. 77703
  misc_feature (321)..(321): n is a, c, t, g, unknown, or other
  misc_feature (569)..(569): n is a, c, t, g, unknown, or other
  misc_feature (572)..(572): n is a, c, t, g, unknown, or other
  misc_feature (573)..(573): n is a, c, t, g, unknown, or other
ctggagctccccgcggtggcggccgctctagaactagtggatcccccgggctgcaggaattcgtctcacccctagaaaaaattttatataaataaaacaaaaaacaaaaccgcagcagctcctccactggcacactccccctctggcctctaccctgcctgccgtttccatctccatccagttctccgcacccacccacccacccactcctttccccaacccatggccgccgccgccgccggcacccgggaggagatggtctacatggccaagctagcggagcaggcggagcggtacgaggagatggtggagttcatgagnaaggtcgcggccgccgccgagctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtaccgccgccgcgtggaggccgaagctctccaggatctgcgcgggggatcctgcgcctcctcgacgagcgcctcgtgccggcngcnngctgccgtgtacgccagggtcttctacctcaagatgaaaggggactaccaccgctacctcggcgaagttcaagaccggcgcccaacgccagggaccccgggggctccaagctttgccgcctaacagggccgcgcaagaaataccccgtcaaagaaactggccgcccaagcattcccataaaggctcggccctcaccccaaaatttccccgtcttttaaataaaaaaaattcttaagttccccgaaaccaggccccgttcctgggggcaaaaaaaggcctttaaaaaaaacttttttaaaaggggt

SEQ ID NO: 77703 - protein, 157 aa, Zea mays
  misc_feature: Ceres CLONE 1562697
  misc_feature (9)..(158): Pfam Name: 14-3-3 Pfam Description: 14-3-3 protein
  misc_feature (33)..(33): Xaa is any aa, unknown, or other
  misc_feature (116)..(116): Xaa is any aa, unknown, or other
  misc_feature (117)..(117): Xaa is any aa, unknown, or other
MAAAAAGTREEMVYMAKLAEQAERYEEMVEFMXKVAAAAELTVEERNLLSVAYKNVIGARRASWRIVSSIEHKEETRGAAGHAAAARGYRRRVEAEALQDLRGGSCASSTSASCRXXAAVYARVFYLKMKGDYHRYLGEVQDRRPTPGTPGAPSFAA

SEQ ID NO: 77704 - DNA, 976 bp, Zea mays
  misc_feature: Ceres CLONE 1562698
  misc_feature: Translation starting site: 157
ctccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaacttcgcgcgcaaccgggagctagaggtgatccactcccggtgggcgatgctgggggcgctgggctgcgtgtttcccggagatcctggctaagaacggcgtcaagttcggcgaggcggtgtggtttcaaggcccggctcgcagatccttctcggagggcggggctggactacctgggggaaccccaacctggtgcacccgcagagcatcctgggccatctgggccgttgccaagtgggtgctcagggggcttcgtccaagggctacccgcgtcagcggcggccccactcggggaagggctccgaacaggtggtaccccggcggcgccttttaaacccgctgggtctcgccgacgacccgggaaccgccgccctagcttaaggttgaagaacctaagaacggcggccttgccatggtctccctggtcgggttcttcctggaaggccatcgttcccggcaaagggccccatccagaaactttttgaacaagttggccaacccctgtccaaaaaggccggggaatagccacgaacttgttccccggtaataaatgaacggcaacgcccta

SEQ ID NO: 77705 - DNA, 802 bp, Zea mays
  misc_feature: Ceres CLONE 1562699
ctggagctccccgcggtggcggccgctcctagaactagtggatcccccgggctgcaggaattcgtctcacccctagaaaaaagagcgcggactatctctgcccgggagaataccttgaaaaccacctcgcaagacttgcgaaacagaaacgcctcatggtaactgccggcacaggagtctccactcgcaacatactggacagcggacccaccatgaccaccctcaacctattccacctcccgataggctaccacaccatgttcgggctcctactcgccgccgcgctctccgtcggcacactgattctccggcaacaactccgcctacctcgcgggctcggtccagtccgcggtcagcctcatcccggcccgcgccggggggctcccgctccagcgggccgcgctcgccaccggatgccagactcaccgcccgcgcgacgggcagctcgcgcacttcgagtgcgacgtgcaccgcgggcaccacgaggggacccgcgacagctgcatgcgcctctcctatgccgacggcgtgttcaccgactactacctgaagctcaagcccgacatcctaggaggtctccgtgctaaagcacgggacctacttcccctacgtcgagctcaacacgacggctaaccaatgcacgggggaagcccactccgaggccgaggaacatcatgttcggtcgcatcatacagatgctggcccaagactgtcgtcgacacccagcacatcttgggtcgtcgtcatgcactgcatcctcattgacccgaaaccgatcatgctccatcatgataatcaacaa

SEQ ID NO: 77706 - DNA, 842 bp, Zea mays
  misc_feature: Ceres CLONE 1562700
  misc_feature: Encodes the peptide sequence at SEQ ID NO. 77707
  misc_feature (651)..(651): n is a, c, t, g, unknown, or other
  misc_feature (652)..(652): n is a, c, t, g, unknown, or other
ctccccgcggtggcggccgctctagaactagtggatcccccgggctgcaggaattcgtctcacccctagaaaaactgctgatcaaggactacccctatgccgttgacgggctcgtcatctggtgggcgatcgagcggtgggtcaaggagtacctggacatctactaccctaacgacggcgagctccagcgtgacgtggagctgcaggcgtggtggaaggaggtgcgtgaggaggcgcacggcgacctcaaggaccgagactggtggcccaggatggacaccgtccagcagctggctaggacgtgcacgaccatcatctgggtggcatccgcgctgcacgcggctgtcaactttggccagtacccatacgccgggtacctcccgaaccggccgacggtcagccggcgcccgatgccggagccaggcagccacgactacaagaagctgggagcggggcagaaggaggcggacatggtgttcattcgcaccatcaccagccagttccagaacatcctgggcatctcgctcatcgagatcctctccaagcactcctccgacgaagtgtacctcggccagcgtgacgagcctgatcgctggacgtcagacgcaaggcgcttgatgcgttcaaagaatccgggagccgctggtgcannatgagaattcgatctagacgatgaacgaccgtcccgactttgaagaaccggaaggggcctgtggaaaatgccgtacatgctgctgtaccccaccacgtcggaatttaccgccaaaaaggccaagggcttacctgcattgggattcccaaagcatttcctattaacctgggcagatgggtctcgaagtaat

SEQ ID NO: 77707 - protein, 216 aa, Zea mays
  misc_feature: Ceres CLONE 1562700
  misc_feature (2)..(213): Pfam Name: Lipoxygenase Pfam Description: Lipoxygenase
  misc_feature: SWISSPROT Homolog: EC 1.13.11.12 Lipoxygenase
PRGGGRSRTSGSPGLQEFVSPLEKLLIKDYPYAVDGLVIWWAIERWVKEYLDIYYPNDGELQRDVELQAWWKEVREEAHGDLKDRDWWPRMDTVQQLARTCTTIIWVASALHAAVNFGQYPYAGYLPNRPTVSRRPMPEPGSHDYKKLGAGQKEADMVFIRTITSQFQNILGISLIEILSKHSSDEVYLGQRDEPDRWTSDARRLMRSKNPGAAGA

SEQ ID NO: 77708 - DNA, 932 bp, Zea mays
  misc_feature: Ceres CLONE 1562702
  misc_feature: Encodes the peptide sequence at SEQ ID NO. 77709
  misc_feature (715)..(715): n is a, c, t, g, unknown, or other
  misc_feature (739)..(739): n is a, c, t, g, unknown, or other
ctcaccgcggtggcggccgctctagaactagtggatcccccgggctgcaggaattcgtctcacccctagaaaaacgcgtctccagtgggctctgctcctcctcttcaatcccactcccgccccgatggccacctcttccgtgctcccgctccacctcctgtcctgcgcgcgccgggccagcaccgccgcgcgcgcctccgcggccccggcggtggcggcgacgaccgcgcagtccctggaggagtcgttcggacggaagggcctgcggttcgtggccgacccggccggcgggcccctcgccgcggagctcagcgtgcggaacggcagctcgctgcatctccgcctcggcgacggcctcgtcacgtcctaccggcccaaggtgtactggaaggacgacgggtgccgggaggtgctgcacaccgtggcgggcaagggcggcgtcggcctcgtcctcaacgacgcgacgtcctcgtccgcccagccgtcgctggtcgacggcgccgagtgggccgtcagggacgccgactccgactcctacgacgccgtgcaggtggagctcgggtgcaccatagggaagctggacatctcgtacgtggtgacgctgtactcgctgagcatggcgacggcggtgatcgtccggaacacgggcagcaagccggtggcgctgacaggcgcggtgctgagccacatcaagttcgacaagcgaggcggcacngccgtggaaggccttcgtggctgnccctactgctcctacccgccgcgggcgcaagcttcagcctcctgtcccgggccgaagccatgaagcgggaagaaccccgctggttccggcggcgcctaggactgcgccaaggcgtctgggacgtccaagaagactctacaccacctcaaaatgatgtgagccgggtgtactccgcgccccggaggaaaaaaaa

SEQ ID NO: 77709 - protein, 225 aa, Zea mays
  misc_feature: Ceres CLONE 1562702
  misc_feature (205)..(205): Xaa is any aa, unknown, or other
MATSSVLPLHLLSCARRASTAARASAAPAVAATTAQSLEESFGRKGLRFVADPAGGPLAAELSVRNGSSLHLRLGDGLVTSYRPKVYWKDDGCREVLHTVAGKGGVGLVLNDATSSSAQPSLVDGAEWAVRDADSDSYDAVQVELGCTIGKLDISYVVTLYSLSMATAVIVRNTGSKPVALTGAVLSHIKFDKRGGTAVEGLRGXPYCSYPPRAQASASCPGPKP

SEQ ID NO: 77710 - DNA, 876 bp, Zea mays
  misc_feature: Ceres CLONE 1562704
  misc_feature: Encodes the peptide sequence at SEQ ID NO. 77711
  misc_feature (688)..(688): n is a, c, t, g, unknown, or other
  misc_feature (756)..(756): n is a, c, t, g, unknown, or other
  misc_feature (774)..(774): n is a, c, t, g, unknown, or other
ctccccgcggtggcggccgctctagaactagtggatcccccgggctgcaggaattcgtctcacccctagaaaaaaaaggaaagcgagagccagatcgtaggcggcgagcgcaccgccaccggaggggatggcgcggagacggggcggccccgcgccggcgacagcggtcgcctcgccggccgtgctcggcactgtggccgtcatggtgttcgtgtactactccacggtgttcgtcttcctcgatcactgggtcggcctcgccacgccgatcggcgccgcccacgccgccgccgtctcgctcgccgtcgccgcgtgcttcctcgccttcgtctgcgccgcgggcgccgacccgggcgccgtcccacccgccttcgcccccgacgccgaagccgcgcagggacaggggttgaaatcaaggtattgtgataaatgttgcatgttcaagcctcctcgtacccaccactgcaaggtctgcagaaggtgtgttctgaaaatggatcatcactgtgtctggatcaacaactgtgtaggatacgcgaactacaaagccttcatcatttgtgtcctaaatgcaactattgggtctctttattcatttgtgatatttctatgcgacctacttctgaaagagcatgactttgatattctatatgtgaaaatactttatatcttggcaggtgtcctcttngtcttcttaagctttgacataggttctctactaggctggcacatctatctattgttgtcatacatgancaccatagagtacggggnaggcagtagagcgagatggctttgcaagaagagtgggcagaagtaccgccacccggtttgatcttgggatactgaagaacattcaaatgatccctgggtcaa

SEQ ID NO: 77711 - protein, 235 aa, Zea mays
  misc_feature: Ceres CLONE 1562704
  misc_feature (88)..(152): Pfam Name: zf-DHHC Pfam Description: DHHC zinc finger domain
  misc_feature (187)..(187): Xaa is any aa, unknown, or other
  misc_feature (210)..(210): Xaa is any aa, unknown, or other
  misc_feature (216)..(216): Xaa is any aa, unknown, or other
MARRRGGPAPATAVASPAVLGTVAVMVFVYYSTVFVFLDHWVGLATPIGAAHAAAVSLAVAACFLAFVCAAGADPGAVPPAFAPDAEAAQGQGLKSRYCDKCCMFKPPRTHHCKVCRRCVLKMDHHCVWINNCVGYANYKAFIICVLNATIGSLYSFVIFLCDLLLKEHDFDILYVKILYILAGVLXVFLSFDIGSLLGWHIYLLLSYMXTIEYGXGSRARWLCKKSGQKYRHPV

SEQ ID NO: 77712 - DNA, 788 bp, Zea mays
  misc_feature: Ceres CLONE 1562705
  misc_feature: Translation starting site: 137
  misc_feature: Pfam Name: TIP41 Pfam Description: TIP41-like family
  misc_feature (428)..(428): n is a, c, t, g, unknown, or other
  misc_feature (763)..(763): n is a, c, t, g, unknown, or other
ggctcaccgcggtggcggccgctcctagaactagtggatcccccgggctgcaggaattcgtctcacccctagaaaaaaactgcgaatttccgtcagcttggagcggtccaagcgccctgcgaagcaaactacgccgatggcttcggcggcggcgtgggagggtccgacggccgcggagctgaagacagcgggggcggaggtgattcccggcggcgtgcgagtgaaggggtgggtcatccagtcccacaaaggccctatcctcaacgccgcctctctgcaacgctttgaagatgaacttcaaacaacacatttacctgagatggtttttggagagagtttcttgtcacttcaacatacacaaactggcatcaaatttcattttaatgcgcttgatgcactcaaggcatggaagaaagaggcactgccancctgttgaggttcctgctgcagcaaaatggaagttcagaagtaagccttctgaccaggttatacttgactacgactatacatttacgacaccatattgtgggagtgatggctgtgtttgtgaactctggcactccacaaacaagtttagatggatgcggcactttgtggttgggaggatactaatgatcggattgacatttgttgccctttcagcaaaagaacccattcttttctacgacgaggttatcttgtattgaagatgagttagcttgacaatggtatctcaatttcttactgtggcgaagtgagggtaatgccccacctggttgggttnccggctttttgcgttttttggctta

SEQ ID NO: 77713 - DNA, 854 bp, Zea mays
  misc_feature: Ceres CLONE 1562706
  misc_feature: Translation starting site: 184
  misc_feature (381)..(381): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (589)..(589): n is a, c, t, g, unknown, or other
  misc_feature (608)..(608): n is a, c, t, g, unknown, or other
  misc_feature (616)..(616): n is a, c, t, g, unknown, or other
  misc_feature (623)..(623): n is a, c, t, g, unknown, or other
  misc_feature (628)..(628): n is a, c, t, g, unknown, or other
  misc_feature (635)..(635): n is a, c, t, g, unknown, or other
  misc_feature (636)..(636): n is a, c, t, g, unknown, or other
  misc_feature (655)..(655): n is a, c, t, g, unknown, or other
  misc_feature (660)..(660): n is a, c, t, g, unknown, or other
  misc_feature (669)..(669): n is a, c, t, g, unknown, or other
  misc_feature (670)..(670): n is a, c, t, g, unknown, or other
  misc_feature (681)..(681): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (701)..(701): n is a, c, t, g, unknown, or other
  misc_feature (711)..(711): n is a, c, t, g, unknown, or other
  misc_feature (713)..(713): n is a, c, t, g, unknown, or other
  misc_feature (733)..(733): n is a, c, t, g, unknown, or other
  misc_feature (736)..(736): n is a, c, t, g, unknown, or other
  misc_feature (738)..(738): n is a, c, t, g, unknown, or other
  misc_feature (744)..(744): n is a, c, t, g, unknown, or other
  misc_feature (745)..(745): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (772)..(772): n is a, c, t, g, unknown, or other
  misc_feature (795)..(795): n is a, c, t, g, unknown, or other
  misc_feature (796)..(796): n is a, c, t, g, unknown, or other
  misc_feature (798)..(798): n is a, c, t, g, unknown, or other
  misc_feature (799)..(799): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (828)..(828): n is a, c, t, g, unknown, or other
  misc_feature (829)..(829): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (837)..(837): n is a, c, t, g, unknown, or other
  misc_feature (838)..(838): n is a, c, t, g, unknown, or other
  misc_feature (840)..(840): n is a, c, t, g, unknown, or other
  misc_feature (841)..(841): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (851)..(851): n is a, c, t, g, unknown, or other
  misc_feature (852)..(852): n is a, c, t, g, unknown, or other
ctggagctccccgcggtggcggccgctctagaactagtggatcccccgggctgcaggaattcgtctcacccctagaaaaaacacttataagccacggcccacggacaagccgtcctccacccgcgctcgccaccacaccagcaggaggcagagcgcgctggcggctgggacaagtacacgttgatggcatctaccgccatcccgtccccgccgcctccggcagtgccggagcggagagtgccgctggtgccgcggctggcggacgatggcggcggggacggaaggggtgacgcgcgagggagtagcgcgggaggtggcgggagcgggagcggcagcgtggcgggcatctcgccgagcatcctcgtcatcgcagtcatcgtnggtggtgatgctgctcgcgtcgctgtgcatccactactttatccgccacctctgccgccacgtgggcccagcggggtcctcctcctcctcctcctctttgtcccggcaggctccgccgctcccgctcgtggcgcgccccgcggcgggggcgtccgtggcgcccccaccgggnnnnaaaaaaaaaaggaaaaaannnnnnnnncnnngngaaaggaaaaaggggaagnggaaaaanggggggnggggnaaaaggnnaaaggggggcaaaagaagnggggnggggggggnnaaagggggggngggaaagggaggnnnggggnaaaaaggggnangggggaaaaaaaaagggganggngnaaaggnngagnnnnagggggggggaannnnaaangggaaaggggaaagggggaaaannannggggagggggggggaaaannnggggaaannannngggnngnngnnnggaagnngg

SEQ ID NO: 77714 - DNA, 995 bp, Zea mays
  misc_feature: Ceres CLONE 1562707
  misc_feature: Encodes the peptide sequence at SEQ ID NO. 77715
tccccgcggtggcggccgctctagaactagtggatcccccgggctgcaggaattcgtctcacccctagaaaaaagaacctgccgaatgatcatttcaaacctggaaggaattggaagcgtgaacaaccagcaccacgcgtaccggcaccgaaatgggcagctaggccgacgtcccaggctactgctgtttccatcccagagagcgtcggcttccgcgtctgcgctcactgcctcaaggatcgcctcctcctcctcctcgccgctgccaacaacaataagatcgacgactacgcccgccgcaaaagcaggagcaggagcaggagcatctccctccccaaggtcttcgcgctcggctcctccttcctccagcgcctcgactcccgccaccaccggggacgaccgcgggacaacaactgctactccgacgacgacgacgccaccgcctccgtcgcaagcctcgatggtacaatcccatccatctgcagtttgcttgtttcttgtctgcttgccagatcaatgattcagtggcccggcggatgtgaaaaaaaaaaagatttcccttcatctccattaaattctaggaacaacggccaggcgacgtgggacagccatagccagcacaaggtggcatcttcccgcaaggtcgtcgtcgaacaacgaccatggtaagccgtggggagcaaattcaagcggtgttcggcgtcaccttttgggcgcatacaaggtgggtggggccctatgcctgtacactggcggttcttgaatgaggtctctccccccccttcggggtggccctggacggccaataaggcagctgtccgccgccttcttaacctgtcctagggccaaagggaaaaggctgggattccgagccctccctccataggccccccccccggggaccgggccatggtaagttcccccccctcacgtaatgtagccccggtccgttcggggggcggggcaccccctataaagcatgcatggggtctcca

SEQ ID NO: 77715 - protein, 50 aa, Zea mays
  misc_feature: Ceres CLONE 1562707
MIQWPGGCEKKKDFPSSPLNSRNNGQATWDSHSQHKVASSRKVVVEQRPW

SEQ ID NO: 77716 - DNA, 814 bp, Zea mays
  misc_feature: Ceres CLONE 1562708
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (410)..(410): n is a, c, t, g, unknown, or other
  misc_feature (411)..(411): n is a, c, t, g, unknown, or other
ctccccgcggtggcggccgctctagaactagtggatcccccnngggcnntgcaggaattcgtctcacccctagaaaaaattctccactccgctctctcaaactccccggctccccgctctcccccgcccgtccagctcgtgctccgcctccgctgctctgccctcttcctcctctgcgtttctcctcagagctgtttgacttgaccggacagtgctgttcggtggctcggccgcgatgccggactccgacaacgagtccggcgggcccgagccacgcggaagtctcgtcgccccgggagcaagaacggtttcctgcccaatcgcgaaacgtgaagccggatcaattaaaaaggggcttcccgggccaaaaggccaaaaattttccaaggggacgcccaaagggaaaaaanngggggccaaaaaaaacccctgttttcaaaaaataaaaactcccccttttaaaaaaaccccgggggaaaagagccccctctcccaaaaaaaaatgggcccccccccgccccaaaaaaaaaaccccccaaaaaaaaaactttttttaaaggggggggggaaaaaaaaaaatactttttcttttttggggggggcctaaaaaaaaaaacacccaccccccccgggggtggttttttttaagagaagagaaaaaaaaatttttttttgtaggagaagcgcgcccccccccataaaaaaagagaattttttttatccctccccccccccccaaaacaaaaaaattttttttttctcctcccgcaaaaagttatttttctttttgtggggggggggagggaagaaaaaa

SEQ ID NO: 77717 - DNA, 767 bp, Zea mays
  misc_feature: Ceres CLONE 1562709
  misc_feature: Encodes the peptide sequence at SEQ ID NO. 77718
  misc_feature (675)..(675): n is a, c, t, g, unknown, or other
ctggagctccccgcggtggcggccgctctagaactagtggaacccccgggctgcaggaattcgtctcacccctagaaaaatccgttcggatccgagtgtcctgcagaagcccatcctgttcctgtccccctcgagcaatcgagctcagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgccccgccactggctgctgggggccacggacatcgtccctggctgacgggcaggaggaggccaagaccctggaggccaggctcacccaggtcagcgaggagaaccggcggctcaccgagatcatcgcctacatgtacgccagccaggtcgccgcgcagcggagtcccgacggcaggaagaggagcagggacagcctggagccgtcgaattcgagcgacgccaacgctgccgtcgagagcgccgccctcagcgacgaaggcacgttgcaggcggatcaagctccaccaggtcttgcacaaagatcgacccctccgacaccaacgctcgccgtcaaagacggctaccagntggcgccagtaccgggccagaaggtgaccgcgcggccaaccccgttcccccgaaaagcctacctcccgctgccgcaatacgcaaccatcctc

SEQ ID NO: 77718 - protein, 190 aa, Zea mays
  misc_feature: Ceres CLONE 1562709
  misc_feature (160)..(160): Xaa is any aa, unknown, or other
MMLLMDSGSRGDCSPVCLDLSVGLSPPSPGSGPETTADAERLDRPATGCWGPRTSSLADGQEEAKTLEARLTQVSEENRRLTEIIAYMYASQVAAQRSPDGRKRSRDSLEPSNSSDANAAVESAALSDEGTLQADQAPPGLAQRSTPPTPTLAVKDGYQXAPVPGQKVTARPTPFPRKAYLPLPQYATIL

SEQ ID NO: 77719 - DNA, 910 bp, Zea mays
  misc_feature: Ceres CLONE 1562711
  misc_feature: Encodes the peptide sequence at SEQ ID NO. 77720
ctccccgcggtggcggccgctctagaactagtggatcccccgggctgcaggaattcgtctcacccctagaaaaaaccccaccagtctctggcaggttctcccccccacccctctccgtctccgatcccgtccgcattgcttcgcgccggaccaaggaggaagggtcggcgtcgcaggcattgcggcctgccagccacgagggccatggacccgtgcccgttcgtgcgggtgctggtcggcaacctggcgctgaagatgccggcatcagcgccccccgccgccgccgcgtccggctccggcgtgcacccggccacgccgccctgctactactgccgcatccgcctcaacaagctgccctaccagacggcgcccgcgccgctgctgccggccaccgaggagggctcggcgccggcgccggcgtcgtgcgcggccgccttccacgcctccaaggccgacctggaccgggccgccgccaggcccgcgctcttcctcggcggccgcctccgcaccgcgcgcctcaaggtggccgtgtacgccggccgcgggggcggtgaaggcggcgggaggctgctcggcaagctcgtcttccggttcgacctcaggcgcgccgtggccgagcccttggtcttcctcagcggctggttcgacatcggtaagcgcggcgccgggaagccggcggccaacgccgccgccgcgcgcgcgcagctcaacgtcaccgtcctcggcgagcctgacccgaggttcgtcttcgagttcgacggcgagcccgagtgcagcccgcaggtgctccaggttaaggggagcatgaagcagcccatgttcacgtgcaagttctcctgccgcagcaacagcgacctgcgctcgcggtccgtgcagtccgactcgggcgccgtcggcccgcgcaactggt

SEQ ID NO: 77720 - protein, 235 aa, Zea mays
  misc_feature: Ceres CLONE 1562711
MDPCPFVRVLVGNLALKMPASAPPAAAASGSGVHPATPPCYYCRIRLNKLPYQTAPAPLLPATEEGSAPAPASCAAAFHASKADLDRAAARPALFLGGRLRTARLKVAVYAGRGGGEGGGRLLGKLVFRFDLRRAVAEPLVFLSGWFDIGKRGAGKPAANAAAARAQLNVTVLGEPDPRFVFEFDGEPECSPQVLQVKGSMKQPMFTCKFSCRSNSDLRSRSVQSDSGAVGPRNW

SEQ ID NO: 77721 - DNA, 964 bp, Zea mays
  misc_feature: Ceres CLONE 1562713
  misc_feature: Translation starting site: 275
ctccccgcggtggcggccgctctagaactagtggatcccccgggctgcaggaattcgtctcacccctagaaaaaaattcgggcctggcaaggctggcatgccgtcggcctccctagctcgccgcctcctctctactatatcatctccagcgatcccttcacgcagtaccagcaccagcgccagcaacagcaacagctgtggtttcagcacaagaagggccaggaagaagcgcagctgcgtttcttggacggtgagcgcggctactccggcggacatggcgaccaacagcggcagtgccctggcgaagctggcgccgctggaagccatcctgttcgacatcgacggcacgctctgcgactccgaccccatccacttctgcgccttccgagagctcctgcagcaggccggcttcaacggcggtgtccccatcacggaggagttctacagcgccaacatcagcgggggccacaacgacgacctcgccaggtcgctgttcccgggcatggatcaccagaaggcgatgcggttcatggatgacaaagaagctatgttcagaaagttggcgcctggggcagctgaagcccgtggatggggctgcaagagctgtgcggatggatggaaagccgcgacctgaagcgcgcggcggtgacgaacgccccgagggcgaacgccgagctgatgctgtcgctgttggggctcaccgacttcttcccggtggctcgtcatccggaagcgagtgcgaacgggccaagccgtttcctggacccgtactcaaggggcccagctcaatcgggcatcgcctcaacacacctcatatttgagaacccgcatcgggggtccgggcccgggtggctcccgaaatgccctgggtggcctgaacaaaagaaccccggggaagggcctaaaaccaaggggcaacttgggggccaaggatttcagaaccggaacctaattcgggctcaaa

SEQ ID NO: 77722 - DNA, 782 bp, Zea mays
  misc_feature: Ceres CLONE 1562714
  misc_feature: Translation starting site: 203
  misc_feature (396)..(396): n is a, c, t, g, unknown, or other
ctgggaagctccaccggcggtggcggccgctctagaactagtggatcccccgggctgcaggaattccgtctcacccctagaaaaaatccgttcggatccgagtgtcctgcagagcccatcctgttcctgtccccctcgagcaatcgagctcagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgccccgccactggctgctggggggcacggacatcgtccctggctgacgggcaaggagaagccanaaccctggagggcagctccaccaggtcagccaagagaaacgggcgctcacccagaatcatcggcctactggtcccccagccaggttcccccgccaacggaatcccaacgggccgaaaaagaaccggggaagccctggaacccctcaaattgaaagaaagccaaaacttgccctcaaaaaagcccccccccccaagacaaagggccctggtcagggggattaaaacctcccccgggggttcccaccaaaaaataaacccccccgaaaaacccaattttgcgggttaaaaaaaggggcccacctgggggcccaaatttggcgccaaaaaaaggggagaccccgaaaaaaacccccccccccaaaaagaaaaattttttttgggtgggc

SEQ ID NO: 77723 - DNA, 677 bp, Zea mays
  misc_feature: Ceres CLONE 1562718
  misc_feature: Encodes the peptide sequence at SEQ ID NO. 77724
  misc_feature (503)..(503): n is a, c, t, g, unknown, or other
ctggagctcaccgcggtggcggccgctctagaactagtggatcccccgggctgcaggaattcgtctcacccctagaaaaactccctcctcagtcgtcacacacactcagccagtccgctgcctccgcgctcccccaaaacccaccgcctcgccggaatcctagccttcgccaaccagtcgccatgagagagatcctccacatccagggcgggcagtgcggtaaccagatcggggccaagttctgggaggtgatatgcgacgagcacggcatcgatcacaccggaaagtacgccggcgactccgacctccagctggagcgcatcaacgtctactacaacgaggccagcggcggccgcttcgtcccgcgcgccgtcctcatggacctcgagcccggcaccatggactccgtgcgctcggggccccttcggccagatcttccgcccccgacaatttcgtccttcgggccagtcccggcgccgggcaacaaccgggggccaaggggncccttacacccaagggggcccccaaaagcccatcggaacccccggggctccaaaaattttggtgggcccaagggggggggcccaaaaaaaaagggggaaaagggggccctccaaaagggggggttctcccgggggtttgggcccccccccgcccccgggggggggggggggggg

SEQ ID NO: 77724 - protein, 165 aa, Zea mays
  misc_feature: Ceres CLONE 1562718
MREILHIQGGQCGNQIGAKFWEVICDEHGIDHTGKYAGDSDLQLERINVYYNEASGGRFVPRAVLMDLEPGTMDSVRSGPLRPDLPPPTISSFGPVPAPGNNRGPRGPLHPRGPPKAHRNPRGSKNFGGPKGGGPKKKGEKGALQKGGFSRGFGPPPAPGGGGGG

SEQ ID NO: 77725 - DNA, 850 bp, Zea mays
  misc_feature: Ceres CLONE 1562720
  misc_feature: Encodes the peptide sequence at SEQ ID NO. 77726
  misc_feature (592)..(592): n is a, c, t, g, unknown, or other
  misc_feature (759)..(759): n is a, c, t, g, unknown, or other
  misc_feature (762)..(762): n is a, c, t, g, unknown, or other
  misc_feature (765)..(765): n is a, c, t, g, unknown, or other
ctggagctcaccgcggtggcggccgctctagaactagtggatcccccgggctgcaggaattcgtctcacccctagaaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttccctcaaggaactcttgcagccggcccctctggtttcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctccaactgctgatccttcgccgtctctccctctctctttctctctgagatagtctttcgaatccatctctagggctcctgtttctcccatctnccccccacccaaccccccaccaaacagattcaatccgacaagacaagcatccatgtcgtcgtcacgccggagctcgagccccgacagcaacgacacgacggacgagcgcaagcggaagcggatgctgtccaacagggagtcgggcgcggcggtcgcccgcgcggaancancancggctgggagaaactgggtggcggaggtggccccgcctgcagggcggagaacgcgggcgacgcagggccggcaccgcggcgctgt

SEQ ID NO: 77726 - protein, 68 aa, Zea mays
  misc_feature: Ceres CLONE 1562720
  misc_feature (39)..(39): Xaa is any aa, unknown, or other
  misc_feature (40)..(40): Xaa is any aa, unknown, or other
  misc_feature (41)..(41): Xaa is any aa, unknown, or other
MSSSRRSSSPDSNDTTDERKRKRMLSNRESGAAVARAEXXXAGRNWVAEVAPPAGRRTRATQGRHRGA

SEQ ID NO: 77727 - DNA, 793 bp, Zea mays
  misc_feature: Ceres CLONE 1562721
  misc_feature: Encodes the peptide sequence at SEQ ID NO. 77728
ctggagctccccgcggtggcggccgctctagaactagtggatcccccgggctgcaggaattcgtctcacccctagaaaaaagttctccgcacccacccacccacccactcctttccccaacccatggccgccgccgccgccggcacccgggaggagatggtctacatggccaagctagcggagcaggcggagcggtacgaggagatggtggagttcatggagaaggtcgcggccgccgccgagctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtaccgcgcgcgcgtggaggccgagctctccgggatctgcgcggggatcctgcgcctcctcgacgagcgcctcgtgccggcggcggcggccgtggacgccagggtcttctacctcaagatgaagggggactaccaccgctacctcgccgagttcatgaccggcgccgagcgcaaggacgccgcggactccacgctcgccgcctaccaggccgcgcaggacatcgcccttcaaggagctgccgcccacgcatcccatcaagctcggccctcgccctcaactttctcgtcttctaactacgagatcctcagctccgcggaccgcgccctgctcgctggcccaagcaagccttccgacgaagctatttcagagcctggatagtcttgggggaagaatccgtacaaggatt

SEQ ID NO: 77728 - protein, 213 aa, Zea mays
  misc_feature: Ceres CLONE 1562721
  misc_feature (9)..(213): Pfam Name: 14-3-3 Pfam Description: 14-3-3 protein
MAAAAAGTREEMVYMAKLAEQAERYEEMVEFMEKVAAAAELTVEERNLLSVAYKNVIGARRASWRIVSSIEHKEETRGAAGHAAAARGYRARVEAELSGICAGILRLLDERLVPAAAAVDARVFYLKMKGDYHRYLAEFMTGAERKDAADSTLAAYQAAQDIALQGAAAHASHQARPSPSTFSSSNYEILSSADRALLAGPSKPSDEAISEPG

SEQ ID NO: 77729 - DNA, 889 bp, Zea mays
  misc_feature: Ceres CLONE 1562727
  misc_feature: Encodes the peptide sequence at SEQ ID NO. 77730
  misc_feature (278)..(278): n is a, c, t, g, unknown, or other
  misc_feature (279)..(279): n is a, c, t, g, unknown, or other
  misc_feature (283)..(283): n is a, c, t, g, unknown, or other
  misc_feature (284)..(284): n is a, c, t, g, unknown, or other
  misc_feature (288)..(288): n is a, c, t, g, unknown, or other
  misc_feature (817)..(817): n is a, c, t, g, unknown, or other
  misc_feature (818)..(818): n is a, c, t, g, unknown, or other
ctggagctccccgcggtggcggccgctctagaactagtggatcccccgggctgcaggaattcgtctcacccctagaaaaagcgctgcgctcgcgtctctcgtccccctcagatccaccgactcgctctgagtctctgaccgccccttccgtcgtccccgttcgaaggcgcggcaagcgagcgattcagccagattcgattcgacatgaatcccgagtacgactaccttttcaaacttctgcttattggtgattctggtgttgggaaatcatgcttgcnnttcnntccnaagaaaaattttttttgggcgcgggggaaatgggaaaaatttccccaataatatttttttgggggggaaaaaaagggggtttttacccttttttttggggggggcacccaaaaaatttttttggggggggggggggggtctcaaaaaaaatttttttttttaaaaaaaaaaaaaaaattttttttttgggggggaaaaaaaaaattttttttttttgtggccccccccccccccaaaaaaattggggggggggggggggagaaaaaaaaaaaccccccccccccccccctaaaaaaaaaaaaaacacccctcccccccccccacacaaaaaaaaatttatttttgtgttggagagggggggaaaaaaaaatttccccggcggggtgggggggaaaaaaaaaaaaactctttttcttttggggaggacacacccttctctttggttggggggggggcgcctctcctcccccccgcgggggggggggggcccccccccgggggagaaaaaaaaaaattttttttttttttnnttttttttttttttaaggagggggggggggggcggcggcccccccccccccccacaaaagaaaaataattt

SEQ ID NO: 77730 - protein, 44 aa, Zea mays
  misc_feature: Ceres CLONE 1562727
  misc_feature (25)..(25): Xaa is any aa, unknown, or other
  misc_feature (27)..(27): Xaa is any aa, unknown, or other
MNPEYDYLFKLLLIGDSGVGKSCLXFXPKKNFFWARGKWEKFPQ

SEQ ID NO: 77731 - DNA, 773 bp, Zea mays
  misc_feature: Ceres CLONE 1562728
  misc_feature: Translation starting site: 137
  misc_feature (546)..(546): n is a, c, t, g, unknown, or other
  misc_feature (662)..(662): n is a, c, t, g, unknown, or other
tacccgcggtggcggccgctctagaactagtggatcccccgggctgcaggaattcgtctcacccctagaaaaaagccatcacacgcatactgcatacacaacacagagcatcagaaggagctacgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctgggccatgctcggcgcgctcggggtgcgtgttcccggagctgctcgcccgcaacggcgtcaagttcggcgagggcggtgtgggtcaaggcggggctccagatnctcagcgagggcgggctggactacctcggcaacccgagccctggtcacgcgcagagcatcctggccatctgggcgttgcaggtggtgctcatgggcgccgtcagggggtacccgcngtcgccggcggcccgctccggaaaaggtgggtccaccccgctttaccctgggcggcagcttcgaccccgcttcggggctcgcgaacaaaaccgggaaggccgttcggccca

SEQ ID NO: 77732 - DNA, 751 bp, Zea mays
  misc_feature: Ceres CLONE 1562731
  misc_feature: Translation starting site: 186
ctggagctccccgcggtggcggccgctctagaactagtggatcccccgggctgcaggaattcgtctcacccctagaaaaactgtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccttgccgtccgcagggcttgctatggtgttcttcgttatgttatgggagagtggtgccaagggttgtgaggtgattgttgagtggaaagctcagggcccaaagagccaagtccatgaagttcaaggatggctacatgatctcatctgggtcagccagtgaacgagtacattggactcggctggtgagacacgttcttctccagacaggggtgttctccggtatcaaaggg

SEQ ID NO: 77733 - DNA, 792 bp, Zea mays
  misc_feature: Ceres CLONE 1562732
  misc_feature: Translation starting site: 134
  misc_feature: Pfam Name: PQ-loop Pfam Description: PQ loop repeat
  misc_feature (544)..(544): n is a, c, t, g, unknown, or other
  misc_feature (616)..(616): n is a, c, t, g, unknown, or other
  misc_feature (617)..(617): n is a, c, t, g, unknown, or other
  misc_feature (672)..(672): n is a, c, t, g, unknown, or other
ctggagctccccgcggtggcggccgctctagaatagtggatcccccgggctgcaggaattcgtctcacccctagaaaaaaccattgtcgacgcaagctgcgactgaacctccgtggcgacggaggagacggccatggtggcagcgatggagctcgagatcctaggcatgaatttcgggtgcgtcctcgcggctctgtccgacgccaagatccccgacaaggactgcctgctcccgctcatctctaagctgctcggctacgccatcgtcgccgcatccaccaccgtgaagcttccccagatactgaaaattttgaagcatggaagtgttagaggactaagtgtggcatcctttgaacttgaggttgtcggctacacaattgctttggcatattgtattcataaaggacttcccttttcagcttatggggagctagcttttctgttaatccaagcaattattttggttgcaatcatttactattactcaccaccaatgggaaccaaaacatggatgaaagctttattatattgtggaatggctccnacggttttggctggaaaaatagatcctgctctttttgaagtcctttatgcttcacagcatgctatcttcttnnttgctagagtccacaaatatgggaagattttacgaataaaagggacggcgagctnagctcccttactgtttcatgaactttgctggttccatcgtaaggagttttaccagcatccagagagaactccctttagtgggatcatgggcctcgccattcggattcgcctgaaatggcc

SEQ ID NO: 77734 - DNA, 807 bp, Zea mays
  misc_feature: Ceres CLONE 1562735
  misc_feature: Encodes the peptide sequence at SEQ ID NO. 77735
ctggagctccccgcggtggcggccgctctagaactagtggatcccccgggctgcaggaattcgtctcacccctagaaaaaagcctcatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggacccctccgtgagcgtcgccatcgtggagcagtccgtgtccccgggcggcggcgcgtggctgggcgggcagctgttctcggccatggtggtgcgcaggccggcgcacctgttccctggacgagctgggcgtgggctacgacgaggcccgagaactaccttgggggtcaagcaccgcggcgctgttcacgtccaaccgtgaatgagccgggctcctggccgcggcccaacgtgaaagctggtcaacgcccctgggccggtgaaaggaaccgaatccgggcgggcgggg

SEQ ID NO: 77735 - protein, 174 aa, Zea mays
  misc_feature: Ceres CLONE 1562735
  misc_feature (62)..(170): Pfam Name: Thi4 Pfam Description: Thi4 family
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKDPSVSVAIVEQSVSPGGGAWLGGQLFSAMVVRRPAHLFPGRAGRGLRRGPRTTLGVKHRGAVHVQP

SEQ ID NO: 77736 - DNA, 716 bp, Zea mays
  misc_feature: Ceres CLONE 1562738
  misc_feature: Encodes the peptide sequence at SEQ ID NO. 77737
agctcaccgcggtggcggccgctctagaactagtggatcccccgggctgcaggaattcgtctcacccctagaaaaagccctcttccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttgggggtcgaagtgtttagggcagactattgcctggaaatatcccttggggggggagtttactgcgcccttctcttaacagggggggtgggtttgg

SEQ ID NO: 77737 - protein, 138 aa, Zea mays
  misc_feature: Ceres CLONE 1562738
  misc_feature (3)..(138): Pfam Name: eIF-6 Pfam Description: eIF-6 family
MATRIQFENNCEIGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACNDHVALTHPDLDKETEEFIADVLGGRSV

SEQ ID NO: 77738 - DNA, 821 bp, Zea mays
  misc_feature: Ceres CLONE 1562739
  misc_feature: Encodes the peptide sequence at SEQ ID NO. 77739
ctccccgcggtggcggccgctctagaactagtggatcccccgggctgcaggaattcgtctcacccctagaaaaagcgtcccgtgtcctcgtggcttggccgtgtcgatcgctgatcccaccggctgatagagttggcggccgggggagtgagtcgtcagggatggcgtcggagccggtggcgcgggcggtggcggaggaggtgggccgctggggcagcatgaagcagacgggggtgaccctgcggtacatgatggagttcggctcccgccccacccagcgcaacctgctcctctccgcgcagttcctgcacaaggagctccccatccgcttcgcacgccgcgcgctcgagctcgactcgctgcccttcggcctctccaacaagcccgccatcctcaaggtgcgggactggtacatggactcattccgggacatcagatacttccctgaagtgaggagcaggaacgacgagctcgctttcacgcagatgatcaacatggtcaaggtgcggcataacaatgtggttccaaccatggccttgggagtgcagcagctgaagaaggagctgggccgctcaaggaaggttccattcgagttcgatgagatcgacgaggtccttgaccggttctacatgtcaaggattggcatccgcatgctgatagggcagcatgtggctttgcatgaccctaaacccggagcctggtgtcataggcctcatcaatacaagattatccccaatccaggtggctcaagctgcctgtgaagatgctccgttctgtctgtttaagggggatattggatcagctcctgatattaacatttt

SEQ ID NO: 77739 - protein, 199 aa, Zea mays
  misc_feature: Ceres CLONE 1562739
  misc_feature: SWISSPROT Homolog: EC 2.7.11.2 [Pyruvate dehydrogenase (acetyl-transferring)] kinase
MASEPVARAVAEEVGRWGSMKQTGVTLRYMMEFGSRPTQRNLLLSAQFLHKELPIRFARRALELDSLPFGLSNKPAILKVRDWYMDSFRDIRYFPEVRSRNDELAFTQMINMVKVRHNNVVPTMALGVQQLKKELGRSRKVPFEFDEIDEVLDRFYMSRIGIRMLIGQHVALHDPKPGAWCHRPHQYKIIPNPGGSSCL

SEQ ID NO: 77740 - DNA, 836 bp, Zea mays
  misc_feature: Ceres CLONE 1562740
  misc_feature: Encodes the peptide sequence at SEQ ID NO. 77741
  misc_feature (836)..(836): n is a, c, t, g, unknown, or other
ctccccgcggtggcggccgctctagaactagtggatcccccgggctgcaggaattcgtctcacccctagaaaaagcggttgccccttgcccgcatcatcccacctcgcgaacgaggacggcttctagtccctcgcctaccccgcccccgaacctggcgtctgccctaccaaccgcagcagcgacactagaatggccgcggcgccgtcatccctcgcgtcctcccacctctccccaatcgcggcggtgtccactcccgccgtcccacatcagcttcgcatcggctgctcccgccgccgcgccgggcgcatcgttgccatggctggatccggcaagttcttcgtcggaggcaactggaagtgcaatggaacaaaggactccattagcaaacttgtctctgaattgaatgctgctacccttgaaactgatgtagatgttgtggtggcacctccatttatctatattgatcaggttaagaattcactaactggtcgcattgaggtttctgctcagaatgtgtggattggaaaaggaggagcctacaccggagagatcagtgccgaacaactggtggacatcggctgtcaatgggttattcttggacactctgagcgtagacatattattggtgaaaatgatgagtttattggaaagaaggctgcatatgcattgagccaaaatgttaaggttattgcctgcataggaagagctgctggaagagagggaagcaggcaaaacttttgatgtatgttttaggcagatgaaggcttttgcagatagtatttcaaactgggcagatgttgtaattgcatacgagcctgtttgggctattggaacn

SEQ ID NO: 77741 - protein, 183 aa, Zea mays
  misc_feature: Ceres CLONE 1562740
  misc_feature (49)..(184): Pfam Name: TIM Pfam Description: Triosephosphate isomerase
  misc_feature: SWISSPROT Homolog: EC 5.3.1.1 Triose-phosphate isomerase
MAAAPSSLASSHLSPIAAVSTPAVPHQLRIGCSRRRAGRIVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGRAAGREGSRQNF

SEQ ID NO: 77742 - DNA, 963 bp, Zea mays
  misc_feature: Ceres CLONE 1562743
  misc_feature: Encodes the peptide sequence at SEQ ID NO. 77743
  misc_feature (862)..(862): n is a, c, t, g, unknown, or other
  misc_feature (873)..(873): n is a, c, t, g, unknown, or other
  misc_feature (891)..(891): n is a, c, t, g, unknown, or other
ctccccgcggtggcggccgctctagaactagtggatcccccgggctgcaggaattcgtctcacccctagaaaaaaagcgaaagctcaagcaaatacaagctctcagttagaccacactcaaaccagccacggacagcctcaaaatcccgagcaggagctcgctcgtagccccgagaacccgaaagctctgcagcgagatgtctcccgagctgaccggcaagatggccgccaaggccgccgccgccgctgcggcggtgaagcccgcgacgagggcgtacgtgacgttcctggcgggcgacggcgactactggaagggcgtggtgggcctggccaagggcctgcgcaaggtcggctcggcctatcccctggtggtggcccttctgcccgacgtgccggagtcccaccgccgcatcctcgtctcgcagggctgcatcctccgcgagatcgagcccgtgtacccgcctgagaaccagacgcagttcgccatggcgtactacgtcatcaactactccaagctccgcatctgggagttcgtggagtacgagaggatggtgtacctggacgcggacatccaggtgttcgagaacatcgacgagctgttcgagctcgagaaggggtacttctacgcggtgatggactgcttctgcgagaagacgtggagccataccccgcagtacaggatcggctactgccaacagtgcccggtactaggtggcgtgggcgaccaccgagctgggccctccgcccccgctctactcaacgccggcatgttcgcgcacgagcccagcatggccaccgccaatgcactcctcgtacacctccgcgttactccgtccacccccttcgcagagcagggactccntgacatgttcntcagggaccagtacaggncgatccctacggtgtacaacctcgtgctcgccatgctctggaggcacccgagacgtccagctggaagatggg

SEQ ID NO: 77743 - protein, 255 aa, Zea mays
  misc_feature: Ceres CLONE 1562743
  misc_feature (28)..(254): Pfam Name: Glyco_transf_8 Pfam Description: Glycosyl transferase family 8
  misc_feature: SWISSPROT Homolog: EC 2.4.1.186 Glycogenin glucosyltransferase
  misc_feature (222)..(222): Xaa is any aa, unknown, or other
  misc_feature (226)..(226): Xaa is any aa, unknown, or other
  misc_feature (232)..(232): Xaa is any aa, unknown, or other
MSPELTGKMAAKAAAAAAAVKPATRAYVTFLAGDGDYWKGVVGLAKGLRKVGSAYPLVVALLPDVPESHRRILVSQGCILREIEPVYPPENQTQFAMAYYVINYSKLRIWEFVEYERMVYLDADIQVFENIDELFELEKGYFYAVMDCFCEKTWSHTPQYRIGYCQQCPVLGGVGDHRAGPSAPALLNAGMFAHEPSMATANALLVHLRVTPSTPFAEQGLXDMFXRDQYRXIPTVYNLVLAMLWRHPRRPAGRW

SEQ ID NO: 77744 - DNA, 974 bp, Zea mays
  misc_feature: Ceres CLONE 1562744
  misc_feature: Translation starting site: 316
  misc_feature: SWISSPROT Homolog: EC 3.2.1.21 Beta-glucosidase
acccgcggtggcggccgcatccgaactagtggatcccccgggctgcttgcaattcgtctcacccctagaaaaaatcctacgactaaagcaaagcaaagcacctccacaaagtttatgccagctagcaagacatggctccacttgttgctgctgcaactaatcacactgcccatataagccacatatgagcaggacccaacaataagaattttccaaggcaccaacctggttcatcacaaaacataaacaaaagactcaggcttaggtcacgagcacaaaggataagcagtcagctgcttgaaagccaaaagactgatgccatggcaaatccctaaaagggactggtttcctcctagcttcatctttggtgccgccgccccagcttaccaaattcccccccaacctgtaatgaagatgggaaggggccaagccattgggatcacatctgccacaattgtccggatcggatactgcacccgaacaatggggacacaggagcccaatcctatcaaatttacccttgctgatgtcagattgctgagggaacaatagctgggacccctaccgatttctccactctctacagtccaaaaatacctgactaaaggcaaccgcccccaagggaggcaactctatccagggggtgccctccaggtttttctcaaataaggtttgtgcaacccggaatggacatgaacaacctgaccttggaggcccatttggctcaccgtttttttgagattatggaaacaacccccttcaaaccacctggaaaaatcaagattcaggtgggtttatttttagccccacaggggtttgtcaaaacgaatcctctcatgtaaagttcgcctaaaagatgggtaccctttggaagagctttagtgtgaatacaggaggaagaaaataggtggattggagacccctccacatgtgggcacaatatacatttctcgacaagtcctttatagcgtcag

SEQ ID NO: 77745 - DNA, 921 bp, Zea mays
  misc_feature: Ceres CLONE 1562748
  misc_feature (400)..(400): n is a, c, t, g, unknown, or other
ctggagctccccgcggtggcggccgctctagaactagtggatcccccgggctgcaggaattcgtctcacccctagaaaaaaaggtcgaccgagaattgcaacctgccatgaatcggcacccatatgccatagtcccacacggcggcggacgcgggcgtgctagggttgagcggggctccgtgggcgtgctaaagtttcgtgagcgcagcggtggccggcgcgcaggtgagtgctcccgcctctgattcactccccggctcctcgagcggccaagcgtccgtgcgtggccgtgtgggcgaaccacttgcgccagccgccgtgcgccgctgggcaagcacgtgaggccagatgtgaagcacaggcacaagcaaccgcaccagtttagtgcgagactgcaggntagcatgcaagccacgagcgcgtgactgcagatgctagcccagcgagcgtgtgactgcaggacaacaagcaacgacaacggcaagcaagtagcaacggggatcatgtctgggctcacccttgggctcgttgctcggccttattgagctaagaatcctccacctagaggcactgataccaggcttcagttgtcgtcccttccgctggtcaaaaacagcaccagcctcatgtcacccctgttggttgggtatgttgctggccagggaggaacatgtctggggctcccatttgggggtcatgtcccccacccccgccaaaactggaaaaccccccatggagcagcaaaagctccccggagacccatgatagttttgaaaaatccatggaaaaaaataacccccctcctcaacaaataactttcattcgaggccaagtgccccctccttaatccacttgaacccaaaggacccggcaacttttgacggcctatgaaccagttcaaggacccccaatttgaagttt

SEQ ID NO: 77746 - DNA, 803 bp, Zea mays
  misc_feature: Ceres CLONE 1562749
  misc_feature: Encodes the peptide sequence at SEQ ID NO. 77747
ggagctccccgcggtggcggccgctctagaactagtggatcccccgggctgcaggaattcgtctcacccctagaaaaacccggcgacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctcttcgatagggcgtcgcggctccacgccctggcctccagctccgccctcgaccaggtgcctccctcctctctcttctgggaactggggtcgtctcgcccttcttccgctcacccagagattgagatcgggtgagcggtgcttacgcgcttggtttttttttccgccgcgcaggatgggatccgcacgggggttgacctgctgcggcgctgcgatgacatggtcagcaagctcggcctcttctcccccaacgagaccaaggaggacgtctccacagcaaacctcaagtacctactggtcccatattaccttgcagaaatgaccgaaaagatagcacaggaggatcggatcccggttcttaagacgtcacaggaccatctgaaggagttcattggctctatgtgaagtactagagcttatcccagaagatgagctagaattgtctaggcagaagcagccagatactctgacaaacagaagaagcgcaagaaggttgccccgg

SEQ ID NO: 77747 - protein, 61 aa, Zea mays
  misc_feature: Ceres CLONE 1562749
MVSKLGLFSPNETKEDVSTANLKYLLVPYYLAEMTEKIAQEDRIPVLKTSQDHLKEFIGSM

SEQ ID NO: 77748 - DNA, 840 bp, Zea mays
  misc_feature: Ceres CLONE 1562756
  misc_feature: Encodes the peptide sequence at SEQ ID NO. 77749
  misc_feature (413)..(413): n is a, c, t, g, unknown, or other
  misc_feature (414)..(414): n is a, c, t, g, unknown, or other
  misc_feature (430)..(430): n is a, c, t, g, unknown, or other
  misc_feature (431)..(431): n is a, c, t, g, unknown, or other
  misc_feature (442)..(442): n is a, c, t, g, unknown, or other
  misc_feature (495)..(495): n is a, c, t, g, unknown, or other
  misc_feature (641)..(641): n is a, c, t, g, unknown, or other
tggagctcaccgcggtggcggccgctctagaactagtggatcccccgggctgcaggaattcgtctcacccctagaaaaagattccttccttgtgagctctgagctggttgctgccgccaggattggaggagtgcgcgcgcgcgcaagtgagccatcactgagctgtggacgtgaattgcgatcatccgttctcgctttctggggctcggctgctgtggccatggcgccgccgccgccgccgtacgcgcgggtgatggaggacatggtcaagggccgggagtacgccacgcagctgaaggcgctgctccgggagtcgcccgaggccagccgcctcgtgaaccggatcctgcacgccgtatcgctcaccatccagacggccaaagccgcggccgccgccgctgaggaggaggagnnaggaagaggcatccgnngtgcagagcgnggggggcgggggcgggggggaggtaaaggacaatggcgggggggggggggagnggccgccgcgtggtcggagggggggcgaggcgggcggggggggggacgaagaggtgggggggagtagagaggtcggggcgggggtggggggaggggggggggaaggggggggggggagagggtgaatgcggggggggggcggggtngttgcgcgcgaaaaagcggtatcctcccggcaaaaggaagagaaagggggggggagaaggtaaaaagaggaggccagggaaaggggggataggatgtcgagggaagagaaactgggagaaaagggggaagacaaaaacaggggggaacagaggggggggggacaaagggggggaaaaggaggggggggaaagagggggg

SEQ ID NO: 77749 - protein, 113 aa, Zea mays
  misc_feature: Ceres CLONE 1562756
  misc_feature (65)..(65): Xaa is any aa, unknown, or other
  misc_feature (71)..(71): Xaa is any aa, unknown, or other
  misc_feature (92)..(92): Xaa is any aa, unknown, or other
MAPPPPPYARVMEDMVKGREYATQLKALLRESPEASRLVNRILHAVSLTIQTAKAAAAAAEEEEXGRGIRXAERGGRGRGGGKGQWRGGGGXAAAWSEGGRGGRGGGRRGGGE

SEQ ID NO: 77750 - DNA, 807 bp, Zea mays
  misc_feature: Ceres CLONE 1562758
  misc_feature: Encodes the peptide sequence at SEQ ID NO. 77751
  misc_feature (671)..(671): n is a, c, t, g, unknown, or other
  misc_feature (674)..(674): n is a, c, t, g, unknown, or other
tggagctcaccgcggtggcggccgctctagaactagtggatcccccgggctgcaggaattcgtctcacccctagaaaaagatccagcaatacccgacgcgcaagccagtgccgcgcccagatctccgcgacagatcagtcgttcgtccagctaactgcactgcacgcaatggccaccacggcgaccgaggcgaccaagacgactgcaccggcgcaggagcagcacgccaacggcaacggcaacagcgagcagaagacgcgccactccgaggtcggccacaagagcctgctcaagagcgacgacctctaccaggtaaacaagctgggcgcaatgaatggctgaatctgaccgggatccgagtctctgaccgcgggggtgagaatgatccgcagtacatcctggacacgagcgtgtacccgcgggagccggagagcatgaaagagctgcgcgagatcaccgccaagcacccatggaacctgatgaccacctccgccgacgagggccagttcctcaacatgctcatcaagctcatcggcgccgagaagaccatggagatcggcgtctacaccggctactcgctcctcgacaccgagctcgcactcgcggaggacggcacgatcttggccatggacatcaaccgcgagaactcgagctaggccttcactgcatcnacnaggccggcgtggggacacaagatcgacttccgcgtaggccccgggctccccgtcctgaacgacctcgtggcggaccaggagcacctcgggtagtttcaacgtcaaccttcgtgacaccgaccaggacaactac

SEQ ID NO: 77751 - protein, 73 aa, Zea mays
  misc_feature: Ceres CLONE 1562758
  misc_feature (1)..(74): Pfam Name: Methyltransf_3 Pfam Description: O-methyltransferase
  misc_feature: SWISSPROT Homolog: EC 2.1.1.104 Caffeoyl-CoA O-methyltransferase
MKELREITAKHPWNLMTTSADEGQFLNMLIKLIGAEKTMEIGVYTGYSLLDTELALAEDGTILAMDINRENSS

SEQ ID NO: 77752 - DNA, 961 bp, Zea mays
  misc_feature: Ceres CLONE 1562759
  misc_feature: Encodes the peptide sequence at SEQ ID NO. 77753
  misc_feature (569)..(569): n is a, c, t, g, unknown, or other
  misc_feature (572)..(572): n is a, c, t, g, unknown, or other
  misc_feature (796)..(796): n is a, c, t, g, unknown, or other
  misc_feature (961)..(961): n is a, c, t, g, unknown, or other
ctccccgcggtggcggccgctctagaactagtggatcccccgggctgcaggaattcgtctcacccctagaaaaactccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaagcgtggagcggcatcccgtggttcgaggccggcgcggaaccgagcgccatcgcgcccttctccttcgggtcgctgctgggcacgcagctgctgctgatgggggtgggtggagtcnaancggtgggtggaacttcttcacccggactcccaggcccgtggagtgggccacgccgtgggtcccgcaccgctgagaaactccgccacttcaccggcgagcaagcctaccccgggcggcaagttcttccaacccgcttcgcctcgccggcaccgtcaaaggacggggtctacatcccccgaacgtcaaaagctcaagcgggtcaagctgggcgagatcaaacacgnccgcatcgccatgcttggccatggtcgcctttctacttcgaggccggggcagtcaaaaaccccctcggggcgctcgggccttgatttgcatgctgccgggcaaccaatcagttcctcatttggcgggggtgggggaactcctaggaagtacgggttgaacggaan

SEQ ID NO: 77753 - protein, 247 aa, Zea mays
  misc_feature: Ceres CLONE 1562759
  misc_feature (54)..(202): Pfam Name: Chloroa_b-bind Pfam Description: Chlorophyll A-B binding protein
  misc_feature (145)..(145): Xaa is any aa, unknown, or other
  misc_feature (146)..(146): Xaa is any aa, unknown, or other
MALAPTSAAVLKTPFLGARRALAKPAPRRALVIAAAAAAKKSWIPAIKSDAEIVNPPWLDGSLPGDFGFDPLGLGKDPAFLKWYREAELIHGRWAMAAVLGIFVGQAWSGIPWFEAGAEPSAIAPFSFGSLLGTQLLLMGVGGVXXVGGTSSPGLPGPWSGPRRGSRTAEKLRHFTGEQAYPGRQVLPTRFASPAPSKDGVYIPRTSKAQAGQAGRDQTRPHRHAWPWSPFYFEAGAVKNPLGALGP

SEQ ID NO: 77754 - DNA, 831 bp, Zea mays
  misc_feature: Ceres CLONE 1562760
  misc_feature: Translation starting site: 198
  misc_feature: SWISSPROT Homolog: EC 2.4.1.207 Xyloglucan:xyloglucosyl transferase
ctccccgcggtggcggccgctctagaactagtggatcccccgggctgcaggaattcgtctcacccctagaaaaaaattccatatccaacacacacagcaacgctcgctcggcactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctgttcggcaagatcgacatgcagatcaagctggtgccaggcaactccgctggcacggtcaccaccttctacctgtcgtcccagggcgacgcgcacgacgagatcgacttcgagttcctgggcaacgtgagcggggagccctacacgctgcacaccaacgtgttcacgcgcggacagggccagcgggagcagcagttcccgcctctggttcgaccctaccactgccttccacacctactccatcctgtggaacccgcagcactgaatcttcgcggtggacggcaccccgggtgcgggacttcaagaacacgaggcgcgccggggtggcgttcccgaggatgcagcccatgaagctgttcgccagcctgtggaacgccgacgactgggccacgcaggggcgggcgcgttcagggctgactgggtcaaagcccct

SEQ ID NO: 77755 - DNA, 785 bp, Zea mays
  misc_feature: Ceres CLONE 1562762
  misc_feature (600)..(600): n is a, c, t, g, unknown, or other
ctccccgcggtggcggccgctctagaactagtggatcccccgggctgcaggaattcgtctcacccctagaaaaaagttgagcgtgcttcacctgaatatttgtcagttaatgttggtcatgaagacatgactggtattgattttgtggtttttgaacgccctgaagtaacaatcttgagtggccatgtggaaggagatggcattgatacgttacatccgcatctctctgttgaaatcagatcagcaacagactcttctagagtagaagctgtacttcctcttcctctttcatactactttgaagtccgagatttgcccaagggcaagcatcttgttcagcttcgatctggccttccatcacatacacataggtttgaatcggagttagtcgaagtagatctggaaaaggatccccaaatccatgttggtcccctcaaatataaaactgaggagcgtcatcaaaagcaggaactgaccccagcaccagtttttccgcttattgttggagtttctgtggttgcactggtgatcagtatgtcaaggttaaatgacttataccagagcgctgtagggatgacttctctgggggtcagggatggncacccgacaaaaaagagccacgcaagaatatataaagaaagagagtgtaaatggcatattagcttaacccttaagggttcgagaaatgagacctgacaaaattgagcaatttccaacgttgaaaatagctttctggttttccccccctcggggtaaattttgccaaacaaaaagggattgccccc

SEQ ID NO: 77756 - DNA, 824 bp, Zea mays
  misc_feature: Ceres CLONE 1562763
  misc_feature: Encodes the peptide sequence at SEQ ID NO. 77757
  misc_feature (789)..(789): n is a, c, t, g, unknown, or other
  misc_feature (793)..(793): n is a, c, t, g, unknown, or other
agctccccgcggtggcggccgctctagaactagtggatcccccgggctgcaggaattcgtctcacccctagaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtccgcaacatcgcctccatggtcccaccctacgacaagatcaagtacgccggcaccgggtccgccatcgagtacgccgtgtgcgcgctcaaggtgcaggtcatcgtggtcattggccacagctgctgcggtggcatcagggcgctcctctccctcaaggacggcgcgcccgacaacttccacttcgtggaggactgggtcaggatcggcagccctgccaagaacaaggtgaagaaagagcacgcatcggtgccgttcgatgaccagtgctccatcctggagaagaagccgtgaacgtgtcgctccagaacctcaagagctaccccctcgtccaggaagggctggccnggcnggacgctcaaacctgttgggcgccactacga

SEQ ID NO: 77757 - protein, 160 aa, Zea mays
  misc_feature: Ceres CLONE 1562763
  misc_feature (31)..(161): Pfam Name: Pro_CA Pfam Description: Carbonic anhydrase
  misc_feature: SWISSPROT Homolog: EC 4.2.1.1 Carbonate dehydratase
MDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFHFVEDWVRIGSPAKNKVKKEHASVPFDDQCSILEKKP

SEQ ID NO: 77758 - DNA, 950 bp, Zea mays
  misc_feature: Ceres CLONE 1562764
  misc_feature: Encodes the peptide sequence at SEQ ID NO. 77759
acccgcggtggcggccgctctagaactagtggatcccccgggctgcaggaattcgtctcacccctagaaaaaagacagcctcccattcatcagattcagatcagatcgtagcagccaaggattccgcgctccgggggtgccatgaagctgaagctcctctctccctgccttctcctcctcgccttctttgccaccgcggcgtacgcggcgtcggcgtctgcgtcgcgcgcggcggccgtcgtcaggggcgcgggcgccccgtcgcagtcggagttggagtcggacccggagaaccagtgcgtgtacacggtgtacgtgcggacggggtccatctggaagggcggcacggactcgaccatcggcgtgacgctgctgggccccgacggcacgggcatccggatccgggacctggcggggtggggcggcctcatgggcgccggccacgactactacgagcgcggcaacctggacatcttcagcggccggggcccctgcatgagccaggcgccctgcgccatgatactcacctccgacggcaccggcgcgcaccacggctggtactgcaactacctcgaggccacggtcacggtgccccacctcgggtgcgcgcagcagctcttcaccgtcgagcagtggctcgccaccgacgcgtcgtcctaccgcctgtacgcggtcgtcgacaagtgcaagacgaagcggcaggagccgcgacgctcgcctgccggcgaggccgtgccaccgtgacccgctctatgtacgaacagtagttatcatcgacagaggctagctcctccccctgctgggggtatttacggtaggtgagtgacgatcccatccgattgcgtccgtctgtggaaaacccgcggtgatcccccattgggttccccttcccccctgtgtttttgcccaggaggttctgccaaaaaaaaaaaaaccgaaaccctcaaggt

SEQ ID NO: 77759 - protein, 200 aa, Zea mays
  misc_feature: Ceres CLONE 1562764
MKLKLLSPCLLLLAFFATAAYAASASASRAAAVVRGAGAPSQSELESDPENQCVYTVYVRTGSIWKGGTDSTIGVTLLGPDGTGIRIRDLAGWGGLMGAGHDYYERGNLDIFSGRGPCMSQAPCAMILTSDGTGAHHGWYCNYLEATVTVPHLGCAQQLFTVEQWLATDASSYRLYAVVDKCKTKRQEPRRSPAGEAVPP

SEQ ID NO: 77760 - DNA, 707 bp, Zea mays
  misc_feature: Ceres CLONE 1562765
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
agctccaccgcggtggcggccgctctagaactagtggatcccccgggctgcaggaattcgtctcacccctagaaaaaaacgccgggagaataggggattaggagccagacctggcggcgccgggcgtccaagaaacgctgcctaataaaatccctccggcgtctgtcgtcttgaccgcggcggcgcaggcttcttcttttcgctctccacggcagcgtcatgaagattaaggggaacttgcatgtttgatgtacccctgtagcaaaaaattcttgtgataaaaatttgtttgatttagtcactggtcaggggaggggatctaggttgtcagtttgttttgtaattaaagctggcttggcacctttccctttggcaggggttttccggtaggaaataaaagggggaagaaagccccccctttggggaaaaaaaatggtttttccctttttcccccaggggggttggtgcccttgggcaaaaaaattatccccccctcccccccccgaggaggtgtggaagaaaaaaaaaaccccccccccgggggggggggaacaaaaatctttttttttttaaagagaggagggggggggtttttttctccctttttttnnnnnnggggggggggttttttgggggggggaagaaaaaaaaggggggggggggggggggggcgccccccccccccttttttttttttcccgtttaaa

SEQ ID NO: 77761 - DNA, 954 bp, Zea mays
  misc_feature: Ceres CLONE 1562768
  misc_feature: Encodes the peptide sequence at SEQ ID NO. 77762
ctccccgcggtggcggccgctctagaactagtggatcccccgggctgcaggaattcgtctcacccctagaaaaaatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccggggaggcggcaacgtggtgacgcaggtgaagacggccgccacggacgggtacgacgccgtccatgtcgggttacacggcgtgcgcgaagactagctcacccgcccggagctgggccacctggggcaaagccgggcgccccgccgctgcgccacctgcaggaattccggggtcaccggccgtcgacgcccttcgaagcccggccaagcccctcgacttcggcgaacctcttcaagaagggcgaacttcatcgaattctcccgggaaatcccatcgggaaaggggggtcccaagtgggatccaaaaggacaaatttaaacccggggcttaataacccacgtttccaaaaacccaccgggactttgtttcctctgaaacgggaaaaaccccgggccccgtgtaaaagggaaaaaatcccccggggagtgtggggaacccaaaccaaattggggggccccatatcccaaaataaaaaaccccccggggtccaataaaaagggggcccccaaaaaaaccggaaaacccctccaataacccgcgaaatatggggaaaaaacccacaaaaaattttttttttgggt

SEQ ID NO: 77762 - protein, 102 aa, Zea mays
  misc_feature: Ceres CLONE 1562768
  misc_feature: SWISSPROT Homolog: EC 4.1.1.37 Uroporphyrinogen decarboxylase
MAAVGVGGAVAFLLPQRRQGAVPWSGGRRRAPVAVRASYEAGVGVMATKVGMMTYFDPETGKPVPVTVVGFRGGGNVVTQVKTAATDGYDAVHVGLHGVRED

SEQ ID NO: 77763 - DNA, 785 bp, Zea mays
  misc_feature: Ceres CLONE 1562774
  misc_feature: Translation starting site: 158
  misc_feature (600)..(600): n is a, c, t, g, unknown, or other
  misc_feature (653)..(653): n is a, c, t, g, unknown, or other
  misc_feature (664)..(664): n is a, c, t, g, unknown, or other
ctcaccgcggtggcggccgctctagaactagtggatcccccgggctgcaggaattcgtctcacccctagaaaaaactcccaagtccccaccacccccaaccccgtctctccactgcggcgcaggcttcgcttcggctccgctcggctcgagcagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagcttttggtggttgtcaaacctggacagaataaatcaatcgctggcattgtcactgagagagattatctccggaaaatcatagtgcagggaaggtctccaagtcaactaaggttggcgacatcatgactgaagagacaaactgatcacagtgaatcccgacacnaggtcctgcagggcatgcagctcatgacagaaaaacgcgtcagacacatcccnggtgatcgacngcacggggatgcctgggggatggtctccatccggcgacctcttgcccccccggtggtggcccaacaccaggggaggaactgtaccgggctccatgactaccatccggggagggctccctga

SEQ ID NO: 77764 - DNA, 858 bp, Zea mays
  misc_feature: Ceres CLONE 1562775
  misc_feature: Translation starting site: 257
  misc_feature: SWISSPROT Homolog: EC 4.2.1.1 Carbonate dehydratase
ctggagctccccgcggtggcggccgctctagaactagtggatcccccgggctgcaggaattcgtctcacccctagaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtccgcaacatcgcctccatggtcccaccctacgacaagatcaagtacgccggcaccgggtccgccatcgagtacgccgtgtgcgcgctcaaggtgcaggtcatcgtggtcattggccacagctgctgcggtgggcatcagggcgctcctctccctcaaggacggcgcgcccgacaacttccacttcgtggaggactggggtcaggatcggcagccctgccaagaacaaggtgaagaaaagcacgcatcggtgccgttcgatgaccagtgctccatcctggaagagaggccgtgaacgtgtcgctcagaacctcaagagctaccccttcgtcaaggaagggctggccggcgggacgcttcagctgggttgcgccaactacgactcgtcaaaagggagtcgtcaacatggagct

SEQ ID NO: 77765 - DNA, 790 bp, Zea mays
  misc_feature: Ceres CLONE 1562776
  misc_feature: Translation starting site: 159
  misc_feature: Pfam Name: MED7 Pfam Description: MED7 protein
  misc_feature (303)..(303): n is a, c, t, g, unknown, or other
  misc_feature (406)..(406): n is a, c, t, g, unknown, or other
ctcaccgcggtggcggccgctctagaactagtggatcccccgggctgcaggaattcgtctcacccctagaaaaattcgtttccgcatcggcgtatctcccggcggcaaaggcgctctcctcccgacctccctgcggtgccggtacgacagtcgacaggatggcaatggccacatcagcatcgtaccctccacctcctccattttaccgattgtacaaaaaatttgagcaagatccctcatctgcaccagaacctccaccaccaattgatgaaccattcaaagccttgggtgttgattacacanggagatgttgtgattccaagcttggagagtcataatgtccgtcagctttatccaaagggtcccaatattgacttcaagaaggagcttaggaccctcaacagangagcttcaatttgcatatttttgggagcctggggcaaaaatatttagttgaaaaacatctcaatatgctcctaagggaagaaaaaatttaccctcatatttcaaaaactaaatcatcttcccaatttccttacgaccccctcaggggaagggccccctttgattcccatgccttgaaaacccaaattccggcccccccagggaaccatttttaaatttttaaaacccaaagggggggggggaaaccccccaaaaaaaggcctgggggggaaaaaaaccggcgtattattttttggggggggggggggagacccaaaacaaacacctcttttgggggggggggaaacacccccccccccccaaaaaaaaaataattattgtgggt

SEQ ID NO: 77766 - DNA, 805 bp, Zea mays
  misc_feature: Ceres CLONE 1562778
  misc_feature: Encodes the peptide sequence at SEQ ID NO. 77767
  misc_feature (676)..(676): n is a, c, t, g, unknown, or other
  misc_feature (710)..(710): n is a, c, t, g, unknown, or other
ctcaccgcggtggcggccgctctagaactagtggatcccccgggctgcaggaattcgtctcacccctagaaaaaaagaatttgtactgttcaaggtgtaatgggttgcttttggaaagtttcacacaaatagtcatgtatgggaagtctctgcttcatgaaggttcatgtgagccaaggattcaggaagttgaagcagaagttcaggaaccttcagttcatccttggggaggtctttcgacaacaaaggatggcatcctaactcttcttgattgcttcataaatgcaaaatctcttcatgtgatccagaatgtatttgacaatgcacgtgcgagagaacgtgaacgtgagatgctttaccctgatgcatgtggtggcggtggcagaggatggattagcccagtgatacctaactatggcaggggccatggaacacgagatacctgtgctttgcacactgcacacctttcttgtgatactctggtggatttttggtcggctctgggtgaagaaactagatcatctcttttaaggatgaaagaagaggacttcattgaaagacttatgcacagattcgacagcaagagattctgcagagactgcagaaggaatgttattcgcgaattcaaggagctcaaggaactaaaacgcatgcgaagggaacctcgctgcactantttggtttttgtgttgcagataccacatttaaantgtgaaggtgttccaaggatgctatttcttgtttgattggcattcaatcctttatttggaagcaaagatgggaatatacccatcattttcggaga

SEQ ID NO: 77767 - protein, 247 aa, Zea mays
  misc_feature: Ceres CLONE 1562778
  misc_feature (225)..(225): Xaa is any aa, unknown, or other
  misc_feature (236)..(236): Xaa is any aa, unknown, or other
HRGGGRSRTSGSPGLQEFVSPLEKKNLYCSRCNGLLLESFTQIVMYGKSLLHEGSCEPRIQEVEAEVQEPSVHPWGGLSTTKDGILTLLDCFINAKSLHVIQNVFDNARAREREREMLYPDACGGGGRGWISPVIPNYGRGHGTRDTCALHTAHLSCDTLVDFWSALGEETRSSLLRMKEEDFIERLMHRFDSKRFCRDCRRNVIREFKELKELKRMRREPRCTXLVFVLQIPHLXCEGVPRMLFLV

SEQ ID NO: 77768 - DNA, 856 bp, Zea mays
  misc_feature: Ceres CLONE 1562779
  misc_feature: Encodes the peptide sequence at SEQ ID NO. 77769
ctccccgcggtggcggccgctctagaactagtggatcccccgggctgcaggaattcgtctcacccctagaaaaaaacttgcgtagagagttgggcgcagagaatccccaagcaaatcaacagggtagagggagaggagaggagaggagaggagaggagaggttgggtctgggacccatggctccgatgaagctgtacggggcggtgatgtcgtggaacgtgacgaggtgcgcaccggcgcttgaggaggctggctccgactacgagatcgtgcccatcagcttcgccaccgccgagcacaagagccccgagcacctcgtcccgcacccttttggtctcgttccccctctctcggcatggtgacttttacctctttccatcaccagccatcttccaatacccttcttcccaaaaccatccctagcttgtttaggggaaggtaccctccaggcagccacaattggtggattttttgcatctgggttggggtttacctctttccccccttccctgaaccccctttcttctttccgggccctctttctttccgagcctttggggggccccccccccccccaaattttttttgttttccacccctttccaaaccctacccaaggctttctcggtggtttccaggggcccccctttccccttgtcccaaatccctttttagggattttttttttgctttttcccccatttaacctttttcccggcgcccccctggcttttttttttacccccccccccttttggtgttccctccccccccccctttaaaaccccctggggtttttgtcctttatttaaaccccttttccccctagtttccccccccccatggtaactttctc

SEQ ID NO: 77769 - protein, 61 aa, Zea mays
  misc_feature: Ceres CLONE 1562779
  misc_feature: SWISSPROT Homolog: EC 2.5.1.18 Glutathione transferase
MAPMKLYGAVMSWNVTRCAPALEEAGSDYEIVPISFATAEHKSPEHLVPHPFGLVPPLSAW

SEQ ID NO: 77770 - DNA, 971 bp, Zea mays
  misc_feature: Ceres CLONE 1562780
  misc_feature: Encodes the peptide sequence at SEQ ID NO. 77771
  misc_feature (817)..(817): n is a, c, t, g, unknown, or other
  misc_feature (866)..(866): n is a, c, t, g, unknown, or other
  misc_feature (908)..(908): n is a, c, t, g, unknown, or other
  misc_feature (936)..(936): n is a, c, t, g, unknown, or other
  misc_feature (937)..(937): n is a, c, t, g, unknown, or other
ctccccgcggtggcggccgctctagaactagtggatcccccgggctgcaggaattcgtctcacccctagaaaaactcgagcacctgcagcgccgccagacactccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacaaacttctggggcatgaattttaccaccgataagctcagatctctagtaaagaagtggcagacattgattgaagcccatgttgatgtcaagacaaccgacaactacatgctgcgtttgttctgcattggttttaccaagaggcgcccaaaccaggtcaagagaacctgctatgctcaggcatcccagattcggcagatttcgccgcagatggttgagattatgatcaaccaggcttctacatgtgaccttaaagaactttgttctaagttcattccggaaagtattggcaagaagattgagaagtctacctccagcatcttccccactcaaaacgtcttcatccgcaaggtgaagatactcaagggccccccagttngaatctccggaaagtggatggaggtccatggcgactacaaaagaggacntttggtgtgaaacttgaaaggcctgtccaagggtgataaggnctttgcaaggagttgctgcctgcccaannattttaattggctactctttatttagacaaaatt

SEQ ID NO: 77771 - protein, 242 aa, Zea mays
  misc_feature: Ceres CLONE 1562780
  misc_feature (11)..(222): Pfam Name: Ribosomal_S3Ae Pfam Description: Ribosomal S3Ae family
  misc_feature (224)..(224): Xaa is any aa, unknown, or other
  misc_feature (240)..(240): Xaa is any aa, unknown, or other
MAVGKNKRISKGKKGGKKKTVDPFSKKDWYDIKAPSVFSVRNIGKTLVSRTQGTRIASDGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQISPQMVEIMINQASTCDLKELCSKFIPESIGKKIEKSTSSIFPTQNVFIRKVKILKGPPVXISGKWMEVHGDYKRGXLV

SEQ ID NO: 77772 - DNA, 789 bp, Zea mays
  misc_feature: Ceres CLONE 1562782
ctccccgcggtggcggccgctctagaactagtggatcccccgggctgcaggaattcgtctcacccctagaaaaagtatcactcctcagttgcttcgacgtatttctctctctatctatacgattccgaagaaggtagagagagaaactcgaaggggagaggacagaagagggagatacaggttaatttttaggtaccagatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttgggggaaggaaggctctgcctttttggccccaaaattacattacagcccatcttttgcttgtattccttatacttctgatgcttattatagtgcgggttggggtcttgacaggatatcctccacatgccatttgtcatccccagcaaaatgatacaacgaacactccggggtatgttaccctgtgaacctgcagaagaccaattatatgttaatgcaaaaacataccatgcaatcctttagaagaaggccaacaacgtgctaaa

SEQ ID NO: 77773 - DNA, 892 bp, Zea mays
  misc_feature: Ceres CLONE 1562783
  misc_feature: Encodes the peptide sequence at SEQ ID NO. 77774
ctccccgcggtggcggccgctctagaactagtggatcccccgggctgcaggaattcgtctcacccctagaaaaaagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggcgccgtcgagggctaccgtattgccggcgggccgctcggcgaggtcgtcgacccgctgtaccctggcggcagcttcgaccccctcggcctggccgacgaccccgaggcctcgccgagctcaaggtgaggagctcaagacggccgcctcgccatgtttccatgttcggcttctcgtccaggcatcgtcacgggcagggccgctcgagaactcgctgacacatcgctgaccagtcaacacaacgcatgggcctacgcaccacttcg

SEQ ID NO: 77774 - protein, 207 aa, Zea mays
  misc_feature: Ceres CLONE 1562783
  misc_feature (61)..(208): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFDPLGLADDPEASPSSR

SEQ ID NO: 77775 - DNA, 834 bp, Zea mays
  misc_feature: Ceres CLONE 1562785
  misc_feature: Encodes the peptide sequence at SEQ ID NO. 77776
  misc_feature (716)..(716): n is a, c, t, g, unknown, or other
  misc_feature (727)..(727): n is a, c, t, g, unknown, or other
tggagctccccgcggtggcggccgctctagaactagtggatcccccgggctgcaggaattcgtctcacccctagaaaaaacctgcctcctccccttctcccatctctccccctctccctctcgtggccacgactgccgctgccgccctacgccaggtgtccaggtcatctccggcccattcgccggcgacgagcaccccactagatcgaccgagatatggacggcctgtggcatctgggggacgagctccgcgggcagcccaaggtggtggaggaccgccagtggtcgctcatgacgtccaagctggcagagatcaccatgtccaggggcgagaggacgaacgacctcgactacgccaggatgaacgccgcccccgacgccaagcggtggggcaaggcggcgtcctaccagcaccatgacgagggcaggatggaccaccacgtcagcctcagcctcaagatgaacgatctcaagatgaacgaggccgccgctgccgccatcatgaagctccccttccgcggcgtgccctacaacgtcaacccgatgtaccccaaggggagcaacgccaacgcctatgtcgacgcattccagatgaatgtcggggtgaacaagtactccagcagcgcgaacgggaaagaccctgcgggtaaagcatgtggcggtggcagcaaccatcacagcagcagcggaggcaacggctatgggaccgcacacgnccagttcgcgntcgacaagcgcttcaagacgttgccgacaagcgagatgctgcaaagacgaacgtccttggcgggtacatcttctgtctgcaacatcgatacaatgccagaaggaccc

SEQ ID NO: 77776 - protein, 206 aa, Zea mays
  misc_feature: Ceres CLONE 1562785
  misc_feature (167)..(167): Xaa is any aa, unknown, or other
  misc_feature (171)..(171): Xaa is any aa, unknown, or other
MDGLWHLGDELRGQPKVVEDRQWSLMTSKLAEITMSRGERTNDLDYARMNAAPDAKRWGKAASYQHHDEGRMDHHVSLSLKMNDLKMNEAAAAAIMKLPFRGVPYNVNPMYPKGSNANAYVDAFQMNVGVNKYSSSANGKDPAGKACGGGSNHHSSSGGNGYGTAHXQFAXDKRFKTLPTSEMLQRRTSLAGTSSVCNIDTMPEGP

SEQ ID NO: 77777 - DNA, 820 bp, Zea mays
  misc_feature: Ceres CLONE 1562786
  misc_feature: Encodes the peptide sequence at SEQ ID NO. 77778
ctggagctcaccgcggtggcggccgctctagaactagtggatcccccgggctgcaggaattcgtctcacccctagaaaaaagtcgttgatccgaaagccgtcgcctcggcgcaccagttcaccgtggtaatcgacggcgtcgagacgaccgtccacgagggcgtgctccggcgcaacggcggcacggtggccgtggtcggcccgggcgtcctcgaggtgagccgtctccagcacgtggtggtgcgcggcgggggcgggggcgacgtgcgcttctcccggtgcctgtacgcggccgccgaggactgcggcgcggcgtcgttccaccggtgcgaccgtgcgccctgtgaagggcgcccgcgccgtggccgtgcgccgctgccgctcggccgacgtggagcgcgcgggcgccgtggccatccgccgctgcaagggcgccgcgcgcgtccgcggcgccggggagctgcgcgtgggccggtgccgggaggccgacgtcggcgcgtgcgccgacgtcgccgtggcccgctgtcgcgccgagcgcaccgactggtgcggcgcgctcgccctcggcaagtgcggttccgccgacgtcagccgctgcggcgccgtgcgcgtcgaccggtgccgctacccccccgtgggccgggtgctgcaccgtcccccgtgcgcccccgcaaagtcaggcatggtggaaactgaaccgccagatgccggccggatttccccgaaacaaaccccgaattgtttaagcagggagggatcctgttgctcttccaccacccggggaggaatcactggccccatattttaagggaggcccaat

SEQ ID NO: 77778 - protein, 41 aa, Zea mays
  misc_feature: Ceres CLONE 1562786
MVETEPPDAGRISPKQTPNCLSREGSCCSSTTRGGITGPIF

SEQ ID NO: 77779 - DNA, 819 bp, Zea mays
  misc_feature: Ceres CLONE 1562787
  misc_feature: Translation starting site: 204
  misc_feature (467)..(467): n is a, c, t, g, unknown, or other
  misc_feature (698)..(698): n is a, c, t, g, unknown, or other
  misc_feature (725)..(725): n is a, c, t, g, unknown, or other
ggagctccccgcggtggcggccgctctagaactagtggatcccccgggctgcaggaattcgtctcacccctagaaaaaagctttgcgtctgtggccaaccaggcgcctccctcccaccacccggctctccacgccgccgccgccgccgccacaagcgaccgcgcatccgctcttctccctcccttcgctctcggcggccggcgatgggggagaccgtacgggcgggcgacgttgcaatcacgactcacgagatggagagccacaacccatcgcactctcagatcgccgaagtgacgatggacatcgcagcgtcagcttctggagcggcagggagcaagttctgcaagggcgcagcctgcgacttctccgacgccagcaactcctcgaaggacgccagggagaggtcggcgtcgatgaggaagctgatagtcgcggtggtcctctgcgtcgtattcatggcggtggangtttgggtggggggcatcaaggcgaacagcctggccatcctgaccgacgcggcgcacctcctgtcggacgtggcggcgttcgccatctcgctgttctcgctctgggccgccggggtgggaggcgacgccgcggcagtcgtacgggttctcccggggtggagatcctcggcgccctcgtctccatccagctcatctggctgctcgcgggcatactggtgtacgaggccgtcntgaggctcgtcggcgaaagcgcgaacntgcgggggtcgctcatgttcgccgtgtcggcgtccggctgggcgtcacgttctcaatggcgtgttgctgggcatgacacgggcaacgcacggca

SEQ ID NO: 77780 - DNA, 731 bp, Zea mays
  misc_feature: Ceres CLONE 1562788
  misc_feature: Translation starting site: 176
  misc_feature (419)..(419): n is a, c, t, g, unknown, or other
ttggagctccccgcggtggcggccgctctagaactagtggatcccccgggctgcaggaattcgtctcacccctagaaaaaggatagagcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccngggggcttcatcgagcccaagtggctggcctacggcgatgtgatcaacggccgctacgccatgctggggcgcgggtgggcgcccatcgcccccgagatcttcggcaagatgggcatcatcccgccggagaccgcgcctgcgtggtttcaagacgggcgtcatccccgcccgccgggcacctacaactactggggccgaactcctacacgctccttcgtcttcaaacatgggcgcctaattggggctttcccccaaaccacccgcccgccccccagggacatggggaaaaacccccggggcttcccatggggt

SEQ ID NO: 77781 - DNA, 907 bp, Zea mays
  misc_feature: Ceres CLONE 1562789
  misc_feature: Encodes the peptide sequence at SEQ ID NO. 77782
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (676)..(676): n is a, c, t, g, unknown, or other
  misc_feature (677)..(677): n is a, c, t, g, unknown, or other
  misc_feature (683)..(683): n is a, c, t, g, unknown, or other
  misc_feature (696)..(696): n is a, c, t, g, unknown, or other
  misc_feature (705)..(705): n is a, c, t, g, unknown, or other
  misc_feature (756)..(756): n is a, c, t, g, unknown, or other
  misc_feature (794)..(794): n is a, c, t, g, unknown, or other
ggagctcaccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccccccagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcaccaaggggtgggtttgttttgggggggttgtttnnnnttnntttttnggggggggggganttgggttgnggttgggaaaggtttgtttgggggggtggaaagtgtgattttggaggaatntattattttagaaaaggaaaaggggtgggagtgtttangagtttttttaaaaaggggataagtatagggttaaaagagggttttggagtttggtaattttaaagtgtgaggaggaggaaggattataatggtgtattttgggattgtgtgg

SEQ ID NO: 77782 - protein, 236 aa, Zea mays
  misc_feature: Ceres CLONE 1562789
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (177)..(177): Xaa is any aa, unknown, or other
  misc_feature (178)..(178): Xaa is any aa, unknown, or other
  misc_feature (179)..(179): Xaa is any aa, unknown, or other
  misc_feature (181)..(181): Xaa is any aa, unknown, or other
  misc_feature (185)..(185): Xaa is any aa, unknown, or other
  misc_feature (188)..(188): Xaa is any aa, unknown, or other
  misc_feature (205)..(205): Xaa is any aa, unknown, or other
  misc_feature (218)..(218): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPPSVDSAQLAGLFEQAGSVEMVEVVYDRMTGRSRGFGFVTMSSAEEAGAAVEQFNGYTFQGRPLRVNCGPPPPRDGSAPRAPRGGFVLGGLFXXXFXGGGXLGXGWERFVWGGGKCDFGGXYYFRKGKGVGVFXSFFKKGISIGLKEGFGVW

SEQ ID NO: 77783 - DNA, 791 bp, Zea mays
  misc_feature: Ceres CLONE 1562791
  misc_feature: Encodes the peptide sequence at SEQ ID NO. 77784
  misc_feature (448)..(448): n is a, c, t, g, unknown, or other
ctccccgcggtggcggccgctctagaactagtggatcccccgggctgcaggaattcgtctcacccctagaaaaactgccccctccttttcccctccctccccacgcaccgccgcgtccgcccccttcgctgcccctgcccggtcggttccgatggggtacgtgctgtcggcggtggcgagggtgctggagcagcccacggcgtggggggcggcccgggagatggcgctcctcgcggggccgctctgggcggcggtcctcctcggcctcctgctcggctgggcctggcgcccgcgctgggcagctggcctcgtcgccgcccccgcccccgccgccgctgcgcagccgcccttcgccacgctcggtttctggaaggcccagctccccgcccgtctccgcgccccgctcggctccgccgccgccgtgcggcacggggaggagggaggaggnaggacgaggtctccgtgcgagggtcgtcggaggcggggagcgaggagctggcggtggggaagcgtgacctggcgaacctctggaggctggtggagggcagggacggcggcccggcctggatcaagatgatggacaggtcccttccaccatgacctaccagcggggcgaaggacccgcagaccggaccaccccgtatcagaatagcagctcctttgaggaagcccctccggaggaaagtgagggacttcttccgggaaaaaaagttcccggggtgtccaacaagtgggaaacaacttgctggttttcccataaaaccccttgaaggagggcccgaacccccggg

SEQ ID NO: 77784 - protein, 141 aa, Zea mays
  misc_feature: Ceres CLONE 1562791
MGYVLSAVARVLEQPTAWGAAREMALLAGPLWAAVLLGLLLGWAWRPRWAAGLVAAPAPAAAAQPPFATLGFWKAQLPARLRAPLGSAAAVRHGEEGGGRTRSPCEGRRRRGARSWRWGSVTWRTSGGWWRAGTAARPGSR

SEQ ID NO: 77785 - DNA, 987 bp, Zea mays
  misc_feature: Ceres CLONE 1562792
  misc_feature (53)..(53): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
tgatgggttggggggggagtagttggtttcacaccctaactcacgattttttnaaaaaaaannnnnnnntnntccaaagctggagctcaccgcggtggcggccgctctagaatagtggatcccccgggctgcaggaattcgtctcacccctagaaaaaaccctttccctctcccttctcgtcctcggtcctccccaacccatggccacggccaccaccacccactgccccttctcccaccacgctatttatcgcggctgcacgactcctgcccatcaggcgccatacagacgcgtgggacctaagccgccgatcaagcgctgctcggggcggatcagcggccggcggtggtgagtgctggcagacaggcctgcaagtcaggcaaagtgaccatctggcgagtcgaaccttgagcggggagctggacttttggtgggttccggacggcctccggaaacgagagatgggggcttggaattctcaaacttcccccccccccaccggggggaaaaaccggggccacccgttcgaaggccttccgaacccgttgcccatgcaaaaaattccccccccgggaaaccggggccgggggcgctttttccccgggggctttttcggggggccctttcggggcctatttccccgggaggggaagagagaccccgcctccctccgatttttctcccccaaaagccggaaaaaactcctataacggcgaaacacccgtgtgggccccacaccccacgaagagttgtggaaacaaaaatatgtggagacatgccctccttgtggggagcacccaaacatgattcccccagtcggtggggggggggttgtccccacaaggggaacaccccccggggggtacaaccaccgcttcatatttttccccccggatccccccccccggagaaccccccgggggcctcgggggacccgaaaaaacccccggggaaaaccccccggggaagacacccccggggggggg

SEQ ID NO: 77786 - DNA, 769 bp, Zea mays
  misc_feature: Ceres CLONE 1562793
  misc_feature: Translation starting site: 257
  misc_feature (433)..(433): n is a, c, t, g, unknown, or other
gcggtggcggccgctctagaactagtggatcccccgggctgcaggaattcgtctcacccctagaaaacgccccacgcagctgaggcgttgatcctcaccggcgtcgccatcgtaatcgccttggacagcggcaccagaacctctgcctccgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgccagaatatccggaagttggttaaaggatgggtttatcatcaagaagcctcataagatccactnctagatcccgtgcaagaagggcacatgacgccaagcaaaagggacgccactcaggatatggtaagcgtaggggtaccagggaggctaggctacccaccaaggttctgtggatgaggaaggatgcgtgtggctgaggcgccttctccgcaagtatcgtgaggccaagaagattgacaagcacatgtatcatgacatgtacatgaaagtcaaaagtaacgccttcaagaaaacagaggtgccttatggagagtatccacaaagtcaaaggctgagaaagccagagagaagacactttcctgaccagtttggaggcaagcgcgccaagaagcaagcgag

SEQ ID NO: 77787 - DNA, 782 bp, Zea mays
  misc_feature: Ceres CLONE 1562796
  misc_feature: Encodes the peptide sequence at SEQ ID NO. 77788
  misc_feature (671)..(671): n is a, c, t, g, unknown, or other
  misc_feature (699)..(699): n is a, c, t, g, unknown, or other
tggagctccccgcggtggcggccgctctagaactagtggatcccccgggctgcaggaattcgtctcacccctagaaaaaagccgcccattgccggcattgctcgcagcgctagcttcttgcgctcatcagtcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacgtgctggcgtcccgcccgcggaaccccgtcgccgacatcatccgctacaactcgacggacgtggccttcgcgccgtacggcgagtactggcgcacggccgcggaaggtggtcaacacgcacctgctcagcgccaagatggtcttctccaancggcgggaccggggaagaggaggttgcnccctggtggttgggcccggatccgcgacgcccgcccgaggcgtcccccgggggacgggcggctcgaccatgacggaaactgcc

SEQ ID NO: 77788 - protein, 207 aa, Zea mays
  misc_feature: Ceres CLONE 1562796
  misc_feature: SWISSPROT Homolog: EC 1.14.13.68 4-hydroxyphenylacetaldehyde oxime monooxygenase
  misc_feature (171)..(171): Xaa is any aa, unknown, or other
  misc_feature (180)..(180): Xaa is any aa, unknown, or other
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVADIIRYNSTDVAFAPYGEYWRTAAEGGQHAPAQRQDGLLQXAGPGKRRLXPGGWARIRDARPRRPPGDGRLDHDGNC

SEQ ID NO: 77789 - DNA, 875 bp, Zea mays
  misc_feature: Ceres CLONE 1562797
  misc_feature: Encodes the peptide sequence at SEQ ID NO. 77790
  misc_feature (253)..(253): n is a, c, t, g, unknown, or other
  misc_feature (263)..(263): n is a, c, t, g, unknown, or other
  misc_feature (269)..(269): n is a, c, t, g, unknown, or other
  misc_feature (285)..(285): n is a, c, t, g, unknown, or other
  misc_feature (315)..(315): n is a, c, t, g, unknown, or other
  misc_feature (390)..(390): n is a, c, t, g, unknown, or other
  misc_feature (392)..(392): n is a, c, t, g, unknown, or other
  misc_feature (404)..(404): n is a, c, t, g, unknown, or other
  misc_feature (413)..(413): n is a, c, t, g, unknown, or other
  misc_feature (416)..(416): n is a, c, t, g, unknown, or other
  misc_feature (417)..(417): n is a, c, t, g, unknown, or other
  misc_feature (429)..(429): n is a, c, t, g, unknown, or other
  misc_feature (576)..(576): n is a, c, t, g, unknown, or other
  misc_feature (579)..(579): n is a, c, t, g, unknown, or other
  misc_feature (647)..(647): n is a, c, t, g, unknown, or other
  misc_feature (657)..(657): n is a, c, t, g, unknown, or other
  misc_feature (663)..(663): n is a, c, t, g, unknown, or other
  misc_feature (664)..(664): n is a, c, t, g, unknown, or other
  misc_feature (734)..(734): n is a, c, t, g, unknown, or other
  misc_feature (735)..(735): n is a, c, t, g, unknown, or other
  misc_feature (763)..(763): n is a, c, t, g, unknown, or other
  misc_feature (764)..(764): n is a, c, t, g, unknown, or other
aaagctggagctccccgcggtggcggccgctctagaactagtggatcccccgggctgcaggaattcgtctcacccctagaaaaatccgctgcaggtggtctaggatcgccaaacacctgcctggcaggaccgacaacgaggtcaagaaccactggaactcgtacctcaagaagagggtcgagggcaaggatggacccagcacgccgccgtccgattcaaacgactcgcattgcgccaagcccggaggcggaancacggcccgngagacnggagacgaccgcccancggactactccggctcgtcggagccgcgcnagccgtcgccgtcgtcgtcgtccggacacgagctgcctgcagggccccccgaaggtcgctgttcgtggactgggntngacctggactgnatggtgggnggnnggggggggggcngatggggggagggggggagaaggtggggggggcgtgagattgggggggtgggtggggggtggggaataggggggggggtgggggggggggtgggggggggcgagggggatgatgggggtttggtagtcccgggcgggggcccgacgntgnccccctgccaccggaacgtttccagtagaacaaacggcaggcgcccgggctaactagagaattggccnacaacaagtnctgggnnggtagtgaaaggcgggcggggggggttggcggggggaggttggggggtaaggtggggaggaaggttcggnnggggggggagtcggagtggggcatacgnngggggcaagaaacccgggggggcatgactatgggggaaaagggggtggccaagatctgggtggagtgagaagtgggttttgggagaaaggggttgcgagattttcaccgaa

SEQ ID NO: 77790 - protein, 75 aa, Zea mays
  misc_feature: Ceres CLONE 1562797
  misc_feature (5)..(5): Xaa is any aa, unknown, or other
  misc_feature (9)..(9): Xaa is any aa, unknown, or other
  misc_feature (58)..(58): Xaa is any aa, unknown, or other
  misc_feature (59)..(59): Xaa is any aa, unknown, or other
MVGGXGGGXWGEGGRRWGGREIGGVGGGWGIGGGVGGGVGGGEGDDGGLVVPGGGPTXXPCHRNVSSRTNGRRPG

SEQ ID NO: 77791 - DNA, 760 bp, Zea mays
  misc_feature: Ceres CLONE 1562798
  misc_feature: Encodes the peptide sequence at SEQ ID NO. 77792
  misc_feature (491)..(491): n is a, c, t, g, unknown, or other
  misc_feature (492)..(492): n is a, c, t, g, unknown, or other
  misc_feature (547)..(547): n is a, c, t, g, unknown, or other
ctccccgcggtggcggccgctctagaactagtggatcccccgggctgcaggaattcgtctcacccctagaaaaacacacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctcctacccgcggcgctgctcccttcgttgcagcccgccaggaggcacacgctgcagccgcccgccgcagccgccgagtccgcaggggaggccaagtctgtgggtttcctggagaaagtaccggccctggtcacccggctcttcnntctcatgtggtacttcctcaacgtcatattcaacatcctcaacaagaagatctancactaactcccataatcatacttttgtggtcttgatccatctaagaatggggggtcgtaatactgcctcatccgccgggagggtcggtcttccccaaggcaaggggccaatcaaggggaccgctcctcaagctttctctttttccaagtcgccctggggcccagggggattgggcccacatcccccaagccaaatgggggccctttcccgcgg

SEQ ID NO: 77792 - protein, 131 aa, Zea mays
  misc_feature: Ceres CLONE 1562798
  misc_feature (112)..(112): Xaa is any aa, unknown, or other
  misc_feature (130)..(130): Xaa is any aa, unknown, or other
MSALGTLSGGAAGVSGLLRLRRRAAPAPAIAAPSHLPAGTVKCAAAVPDAAPIVWGRQLRPALLLPAALLPSLQPARRHTLQPPAAAAESAGEAKSVGFLEKVPALVTRLFXLMWYFLNVIFNILNKKIXH

SEQ ID NO: 77793 - DNA, 806 bp, Zea mays
  misc_feature: Ceres CLONE 1562801
  misc_feature: Encodes the peptide sequence at SEQ ID NO. 77794
  misc_feature (356)..(356): n is a, c, t, g, unknown, or other
  misc_feature (444)..(444): n is a, c, t, g, unknown, or other
ggagctccccgcggtggcggccgctctagaatagtggatcccccgggctgcaggaattcgtctcacccctagaaaaaagcgtccccatggcggcgggaagagaaaccgacgaacagctgaccgagtacgagaagcagcggctgtcgcggatacgcgagaacgaggcccgactcgaggccctgggcctccgcagcctcgcagcgtcccctcttctccgcagctcgtcgccggggacggccaaggggaagcagaagaggtccgtcgacgaggacgaggagtacgtcccgtccgatagcggcggtgaggagaaggacgagagctcgtcggagagcgcgcaagacgaagaggtggatggnagaggggaaatcagcttctatgtcacgcgccaagggaaagaaaaagaaattgtcaaaaactggtaaatctacaaagaacacgcctacntaagggtagtgctaattttgctgaggtggtggatgatgatacagccttacagcaggctattgctctctccctggcggaatttcagaaaagcctgtgacttcattgggtgcagaaacatcaagcacagtaacaagagcgagtgaaagtactccccagaagaacagcaaagcatccattcaggactcagctaagaacaagaagattaaaaagctgggtaagagcaggattcagctgacagaaagatgatgtggttcaattcttcttctcaatttgacgaagttggtaaaggatatattaccaccatggggaatcttgaaagaatggctaccataaatgatttcatctggacagattctgagatt

SEQ ID NO: 77794 - protein, 111 aa, Zea mays
  misc_feature: Ceres CLONE 1562801
MAAGRETDEQLTEYEKQRLSRIRENEARLEALGLRSLAASPLLRSSSPGTAKGKQKRSVDEDEEYVPSDSGGEEKDESSSESAQDEEVDGRGEISFYVTRQGKEKEIVKNW

SEQ ID NO: 77795 - DNA, 709 bp, Zea mays
  misc_feature: Ceres CLONE 1562802
  misc_feature: Encodes the peptide sequence at SEQ ID NO. 77796
  misc_feature (130)..(130): n is a, c, t, g, unknown, or other
  misc_feature (331)..(331): n is a, c, t, g, unknown, or other
  misc_feature (348)..(348): n is a, c, t, g, unknown, or other
  misc_feature (425)..(425): n is a, c, t, g, unknown, or other
  misc_feature (512)..(512): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
ctccccgcggtggcggccgctctagaactagtggatcccccgggctgcaggaattcgtctcacccctagaaaaaagcccgacaggtgaagccgccgccgctgcagtgtccatagccaccgcaggagactngagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatnctctgctagtatagcanggtgatatggggttcttgctttctgctactcgcatgagttgccacgatatggtctttgaagtttggtctggatcaanttattgcaagcttgcctactgccactgggcctttctggttgggctcccccgtgggggccccaaaaaaccggggggtttttaaaaaangggaaaatttaggggccattgtttggccccctgggggggaaaattttttcttttttgccccccccttaaaagaaagagggggggttttttcgggggcgttttttgggggggggggggcccccctttataagaaaacaccaccccgggggggggaacacccccctttttttttttttttnnnnntcggcgtccgcccc

SEQ ID NO: 77796 - protein, 68 aa, Zea mays
  misc_feature: Ceres CLONE 1562802
  misc_feature (66)..(66): Xaa is any aa, unknown, or other
MGGFVKTHKSNAYFKRFQVKFKRRRAGKTDYRARIRLINQDKNKYNTPKYRFVVRFTNKDITAQIXLC

SEQ ID NO: 77797 - DNA, 893 bp, Zea mays
  misc_feature: Ceres CLONE 1562803
  misc_feature: Encodes the peptide sequence at SEQ ID NO. 77798
  misc_feature (371)..(371): n is a, c, t, g, unknown, or other
  misc_feature (398)..(398): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (578)..(578): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (600)..(600): n is a, c, t, g, unknown, or other
  misc_feature (607)..(607): n is a, c, t, g, unknown, or other
  misc_feature (616)..(616): n is a, c, t, g, unknown, or other
  misc_feature (634)..(634): n is a, c, t, g, unknown, or other
  misc_feature (646)..(646): n is a, c, t, g, unknown, or other
  misc_feature (649)..(649): n is a, c, t, g, unknown, or other
  misc_feature (650)..(650): n is a, c, t, g, unknown, or other
  misc_feature (653)..(653): n is a, c, t, g, unknown, or other
  misc_feature (656)..(656): n is a, c, t, g, unknown, or other
  misc_feature (665)..(665): n is a, c, t, g, unknown, or other
  misc_feature (673)..(673): n is a, c, t, g, unknown, or other
  misc_feature (674)..(674): n is a, c, t, g, unknown, or other
  misc_feature (679)..(679): n is a, c, t, g, unknown, or other
  misc_feature (696)..(696): n is a, c, t, g, unknown, or other
  misc_feature (715)..(715): n is a, c, t, g, unknown, or other
  misc_feature (720)..(720): n is a, c, t, g, unknown, or other
  misc_feature (727)..(727): n is a, c, t, g, unknown, or other
  misc_feature (738)..(738): n is a, c, t, g, unknown, or other
  misc_feature (739)..(739): n is a, c, t, g, unknown, or other
  misc_feature (744)..(744): n is a, c, t, g, unknown, or other
  misc_feature (745)..(745): n is a, c, t, g, unknown, or other
  misc_feature (748)..(748): n is a, c, t, g, unknown, or other
  misc_feature (749)..(749): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (765)..(765): n is a, c, t, g, unknown, or other
  misc_feature (766)..(766): n is a, c, t, g, unknown, or other
  misc_feature (772)..(772): n is a, c, t, g, unknown, or other
  misc_feature (775)..(775): n is a, c, t, g, unknown, or other
  misc_feature (776)..(776): n is a, c, t, g, unknown, or other
  misc_feature (779)..(779): n is a, c, t, g, unknown, or other
  misc_feature (781)..(781): n is a, c, t, g, unknown, or other
  misc_feature (782)..(782): n is a, c, t, g, unknown, or other
  misc_feature (787)..(787): n is a, c, t, g, unknown, or other
  misc_feature (799)..(799): n is a, c, t, g, unknown, or other
  misc_feature (802)..(802): n is a, c, t, g, unknown, or other
  misc_feature (807)..(807): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (831)..(831): n is a, c, t, g, unknown, or other
ctggagctccccgcggtggcggccgctctagaactagtggatcccccgggctgcaggaattcgtctcacccctagaaaaaacacttataagccacggcccacggacaagccgtcctccacccgcgctcgccaccacaccagcaggaggcagagcgcgctggcggctgggacaagtacacgttgatggcatctaccgccatcccgtccccgccgcctccggcagtgccggagcggagagtgccgctggtgccgcggctggcggacgatggcggcggggacggaaggggtgacgcgcgagggagtagcgcgggaggtggcgggagcgggagcggcagcgtggcgggcatctcgccgagcatcctcgtcatcgncagtcatcgtggtggtgatgctgctcngcgtcgctgtgcatccactactttatccgccacctctgccgccacgtgggcccagcggggtcctcctcctcctcctcctctttgtcccggcaggctccgccgctcccgctcgtggcgcgccccagcggcgggggcgtccgtggcgcccccaccgggcgnnnaaaaaaaaaagaaaaaaangnnnnnnnnnnnnngggaaggnaaaaggnggaaagggnaaaaaggggagattgggngaaggtaaaggnggnnaanggnagattgggngggggggnnaaagnaagggggggggaagggngacggggggaaaaaaccgnggttnagagaanaaagaagaggnntgggnnatnngggnnnggggagaagnnaaaggnttnnaangnnggggnggggggggaaanaanggggnttagaggtaaaggggtnnntgaanaggtggtgggggggaatgggataagaggggtggaagaaggaggaaatttaaaggaaatttgt

SEQ ID NO: 77798 - protein, 152 aa, Zea mays
  misc_feature: Ceres CLONE 1562803
  misc_feature (63)..(63): Xaa is any aa, unknown, or other
  misc_feature (72)..(72): Xaa is any aa, unknown, or other
  misc_feature (125)..(125): Xaa is any aa, unknown, or other
  misc_feature (126)..(126): Xaa is any aa, unknown, or other
  misc_feature (132)..(132): Xaa is any aa, unknown, or other
  misc_feature (133)..(133): Xaa is any aa, unknown, or other
  misc_feature (134)..(134): Xaa is any aa, unknown, or other
  misc_feature (135)..(135): Xaa is any aa, unknown, or other
  misc_feature (136)..(136): Xaa is any aa, unknown, or other
  misc_feature (137)..(137): Xaa is any aa, unknown, or other
  misc_feature (142)..(142): Xaa is any aa, unknown, or other
  misc_feature (145)..(145): Xaa is any aa, unknown, or other
  misc_feature (151)..(151): Xaa is any aa, unknown, or other
MASTAIPSPPPPAVPERRVPLVPRLADDGGGDGRGDARGSSAGGGGSGSGSVAGISPSILVIXSHRGGDAAXRRCASTTLSATSAATWAQRGPPPPPPLCPGRLRRSRSWRAPAAGASVAPPPGXXKKKKKXXXXXXEGKRXKGXKGEIGXR

SEQ ID NO: 77799 - DNA, 850 bp, Zea mays
  misc_feature: Ceres CLONE 1562804
  misc_feature: Encodes the peptide sequence at SEQ ID NO. 77800
ctccccgcggtggcggccgctctagaactagtggatcccccgggctgcaggaattcgtctcacccctagaaaaagcagataaaaccctccctcgattaaccctaattccttttctcttcggggatactcctttcaccgagtctcttctggttctcggcgtgtgctcgtgtgcagatttgactccatgtcggcggcgctcgcggtgacggacgaggtggccctgccgatccgggcggtgggggatctggcggccgccgccgaggtctcgcgggaggaggtcgccgtcatcacccagtgcgcggcgctcggtgggaagttgccttttgaagatgcatcagttggtgcggttcttgcagtcattaaaaacgtggaaagcttgagggagcaattggttgctgaaatcaggcgggtgctgaaagctggtggaagagtattggtgcagagccctgcaccctcatccagtcagaagccgaacactgatattgagcgcaagttactgatgggtggatttgctgaagtgcaatcttctgctgcaaactcgcaggatagcgtgcaatctgttacagttaaggcaaaagacgctagctggagcatgggctcttcttttccccttaagaaaccacgaaagcccttcccaagaatcaaattgacgacgactctgatctgattgatgaagacagtctcttgactgagggaggactgaagaaaccacactttccagtgttggggactgtgaggtgggggcagcaaagaaagcatgcaagacctgtacttgtggcaaggcttaagcccaggaaaaagtttgggaagctggagctccctgcggagcagatcaataaccttcagtcag

SEQ ID NO: 77800 - protein, 160 aa, Zea mays
  misc_feature: Ceres CLONE 1562804
  misc_feature (4)..(160): Pfam Name: DUF689 Pfam Description: Anamorsin family
MSAALAVTDEVALPIRAVGDLAAAAEVSREEVAVITQCAALGGKLPFEDASVGAVLAVIKNVESLREQLVAEIRRVLKAGGRVLVQSPAPSSSQKPNTDIERKLLMGGFAEVQSSAANSQDSVQSVTVKAKDASWSMGSSFPLKKPRKPFPRIKLTTTLI

SEQ ID NO: 77801 - DNA, 775 bp, Zea mays
  misc_feature: Ceres CLONE 1562805
  misc_feature: Encodes the peptide sequence at SEQ ID NO. 77802
tggagctccccgcggtggcggccgctctagaactagtggatcccccgggctgcaggaattcgtctcacccctagaaaaagaaccaactttcttctccgtcacctgactcacacctccactcacctccggtccaccaacccctgccggccatggcggctgcggcggcgcagaagctcctcgaggcgagcacgaagatcatcggcgtcgggcgcaactacatcgcccacgccgaggagctcggcaacccggtccccaaggagcccgtactattcctaaagccgacctcgtcgttcctccacgctggcgtggccaccgccgccgtcgagatcccggagccgctcgaatcgctacaccacgaggtcgagctcgccgtcgttatctcccggcgtgggcgtgacattcctgaagcgtctgccatggacttcgtcggaggctatgcacttgctttggacatgacagcaaggggccttcaatctgttgctaagtctgcaggccttccatgggacttggctaaagggcaagacacattcactccaattagtgcagtagttccaaaatcatctgtcactaatcctgacgatctcgagttatgggctaaaggtagatgatgaactaaggcagaaaggatcgacaagtgacatgataattccagatccccttttctgatcagctatatcagctccatcctgactttaagggggaggggggatggggtacctaaacaggacctccccgaaaggggggggggggcccccggtggccaaataaggcccaa

SEQ ID NO: 77802 - protein, 152 aa, Zea mays
  misc_feature: Ceres CLONE 1562805
  misc_feature (30)..(153): Pfam Name: FAA_hydrolase Pfam Description: Fumarylacetoacetate (FAA) hydrolase family
MAAAAAQKLLEASTKIIGVGRNYIAHAEELGNPVPKEPVLFLKPTSSFLHAGVATAAVEIPEPLESLHHEVELAVVISRRGRDIPEASAMDFVGGYALALDMTARGLQSVAKSAGLPWDLAKGQDTFTPISAVVPKSSVTNPDDLELWAKGR

SEQ ID NO: 77803 - DNA, 843 bp, Zea mays
  misc_feature: Ceres CLONE 1562806
  misc_feature: Translation starting site: 416
  misc_feature: SWISSPROT Homolog: EC 2.7.11.1 Non-specific serine/threonine protein kinase
caaagctggagctccccgcggtggcggccgcttcagaactagtggatcccccgggctgttgcaattcgtctcacccctagaaaaaatccgggttacatctcacggaatctgaggctgaggcgacggagcgcaagcaagcaagcaagcgaaagggcagggctgcctgccacacaagagacaagggaagaggagaagggtagacgagtagacgactgtgatgaggctagaagaagagcaggcaggagctataagtaccccgcccccttccaccctctccttccacctccctcccttgctgcctcatccattccagagctgcgaagacagacagacagagagaaagagggatcgacggagcaaggcggggccgtgtccggtcacacacgagcgagccctctcggccgcgcgtttgtgaatggtgaacggcgagcggcgggcggacgcggagtgcacgcgggcgtcgctgctggggaggtatgagatcgggcggaccctcggcgagggcaacttcggcaaggtgaagtacgcgcgccacatcgccagcggcggccacttcgccatcaagatcctcgaccgcagcaagatcctctccctccgcatcgacgaccagatcagggagggagatcgggacgctcaagctgctcaagcacccgaatgtcgtccgcttgcacgaggttgctgccagtaaaacgaagatctacatgggtgcttgagtttgtcaacggcagcgagctcttcgacaagatcgctatcaaggggaaactgtccaaacacaagggcaggaggctcttccagcagctaattcaagggggtcagctattgccaaggacagaagtggtctac

SEQ ID NO: 77804 - DNA, 795 bp, Zea mays
  misc_feature: Ceres CLONE 1562807
  misc_feature: Translation starting site: 179
  misc_feature (529)..(529): n is a, c, t, g, unknown, or other
tggagctccccgcggtggcggccgctctagaactagtggatcccccgggctgcaggaattcgtctcacccctagaaaaaagcgcacctcatctcgctccaagcacaccaccactccacagtgcacttcactctctacagcaacagaaaagtgagcagcagacagcagcagctgctgccatggaggcgtggagatctctcctcgcgagcttcgtgctcgccgtgctggccgcgcaggccttggtggccgtggtcgagtccaggaccggtcccgtggagcaggcgagcgaaggtgacgacgtgaagaagccggactgcgtgccggggatggacccgcgctcgttcccggggaccggcggcggccacggcatcacgcccgtgacgccatcgcacggaggctccagctccccgacgccgtcccacggcggcggcggcgggtacgttccaacgccgtcgcatggcgggacgctgcctttcccgtcccacggcggctccggctccggctcctctccgacgtcgccctccacggcngcggcgcgtacagtgggtctccgtccacccccggcggtggcgcgtacagtggggtctccttcgtccacccccagcggcaggcggccgttatggtggggtctccgtctacctcccagcggttggcggcgcctaccggaagcggtttccccctcgccctgcctcattggtgctggttggcgccctatggggagctctcccaacgccccgccgtaccgggcgattccccccttggcaccgcgggcattcggggaccctcggtcacccga

SEQ ID NO: 77805 - DNA, 774 bp, Zea mays
  misc_feature: Ceres CLONE 1562809
  misc_feature: Encodes the peptide sequence at SEQ ID NO. 77806
acccgcggtggcggccgctctagaactagtggatcccccgggctgcaggaattcgtctcacccctagaaaaaactcccagtcccaaacccatttcccttgccttcccctccggctccgcctcctcgaccactccgacaaccccagcgcctccggcgagctccacccctccaccggctgcggcgagaagcggcgggggctaactaagtctgtaggcggcggcggaggtgatccgggagccggagccgagtctagggcgatggggcagcagtcgctgatctacgcgttcgtggcgcgtggcaccgtggtgctggctgagtacaccgagttcaccggcaacttcaccaccatcgccgcccagtgcctgcagaagctccccgccagcaacaacaagttcacctacaactgcgacggccacaccttcaactacctcgtcgaggacggattcacgtattgtgtagttgctgttgaatcagttgggcgacaaatccccatagctttcctggacagagttaaggaagacttcaccaaaaagtatggaaggcgggaaagcagctactgctgcagcgaacagcttgaaacagggagtttgggatcaaagctaaaagagcacatgccagtactgggtggaacacccctggaggaggttagcaagcttggccaaggtgaagggcccaagtctccgaaatccaaagggagttttggatgggaaaacattgaaaaagggttcttggaccgggggggaagaaaattggaactggctttgtcgaaaaaaa

SEQ ID NO: 77806 - protein, 172 aa, Zea mays
  misc_feature: Ceres CLONE 1562809
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGRRESSYCCSEQLETGSLGSKLKEHMPVLGGTPLEEVSKLGQGEGPKSPKSKGSFGWENIEKGFLDRGGRKLELALSKK

SEQ ID NO: 77807 - DNA, 994 bp, Zea mays
  misc_feature: Ceres CLONE 1562810
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (315)..(315): n is a, c, t, g, unknown, or other
  misc_feature (589)..(589): n is a, c, t, g, unknown, or other
  misc_feature (643)..(643): n is a, c, t, g, unknown, or other
  misc_feature (644)..(644): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
nnnnnnnnnnnnnnnnnnnnnnnnnnnnnnnnnnnnnnnnnnnnggggggnnnnnnnnnnnnnnnnnnnnnnnnnnnnnnnnnnnnaaaagctgggactccccgcggtggcggccgctctagaactagtggatcccccgggctgcaggaattcgtctcacccctagaaaaacgtccggatagtgccaggactgccagcccgatctcgcgtcgaacgatgtgaaagaactcctttcttctacgcggacggattcctctcgtctcgatcagctcgcttcgtgacttctctctcctctcgatcgattgcttcctccanccgagcgggggaaagcgccgcccaaatcgccgtaggcaaagcgcgatcactccagctctgagcataagtttcttgcagaaggctcgtgaaatcagtaatcgtatcttgcaatgggcaccccccccaccctgggaaatggctaaacttggaaaaccggggggttgtttatttaaagggcgggccccccggggttttttttttgccccccgggcaaaggggaatttcccttccccggaacccaaaaaaaaaaaaaggtgttttctccccaaaaaangggggaaattaagggggggggaaaaccccccccccctttttttttttttctccnncnnnnnncnnnggggggggggacccccccccccggggtttttttttccgaaaaaaaaaaaagggtgggaacctttttggggggggagagggggggggtcctccctgtggggggggccccccacccccgccgttttttttctctttcaaaaaaaaaaaacacacgggggggaaaatttgggttgttctcttccttttttcacaaaaaaaaaagagggggggggggggctcttttttttttttttttaaaaaaaaaaaaaaaccccccccccccccccaaaaaaaaaaaaaaaaaattccccccccccgggggggggggggggtgtgtgtttttttttttttaaaaataaaa

SEQ ID NO: 77808 - DNA, 767 bp, Zea mays
  misc_feature: Ceres CLONE 1562812
  misc_feature: Encodes the peptide sequence at SEQ ID NO. 77809
  misc_feature (594)..(594): n is a, c, t, g, unknown, or other
  misc_feature (725)..(725): n is a, c, t, g, unknown, or other
ggagctccccgcggtggcggccgctctagactagtggatcccccgggctgcaggaattcgtctcacccctagaaaaagtgtcttccttccacctgaaaacccaacccacacgctcgcgcctccgcgaagaaaaacaccgaggcccatggcgccgagaacgtcagagagagcgatgacatcggcggccgcggggctcgcgcgtggcgccggcccgcactacagaggcgtcaggaagcggccgtggggccggtacgccgcggagatccgcgacccggccaagaagagccgcgtgtggctcggcacgttcgacacgcccgaggacgccgcgcgggcctacgacgccgccgcgcgcgagtaccgcggcgccaaggccaagaccaacttctccttccctgcgtgcctgccgctcgccgccgcggacgtggccggcgcctgccggagcggcaacagcagcagcaccaccaccaccaccaccgtcgactccttcggcggcgacgtgcaggcgccgcccatgcaggccatgccgctcccaccgtccttctgcgccagcggcgccgtacgcttccctttcagcagctaccccgtgacgcaccngtattacttcttcgggcaggccgcagcagggtgccatatgctgaagctgccaccgacgaccggtgactgtggctcagagcgactccagactcctcgtcgggtcgaggaatctgtcggccgtccgcggtccnccgtcgcccgccgggccgcggtgtccagcgacgagaatccgc

SEQ ID NO: 77809 - protein, 207 aa, Zea mays
  misc_feature: Ceres CLONE 1562812
  misc_feature (23)..(74): Pfam Name: AP2 Pfam Description: AP2 domain
  misc_feature (150)..(150): Xaa is any aa, unknown, or other
  misc_feature (194)..(194): Xaa is any aa, unknown, or other
MAPRTSERAMTSAAAGLARGAGPHYRGVRKRPWGRYAAEIRDPAKKSRVWLGTFDTPEDAARAYDAAAREYRGAKAKTNFSFPACLPLAAADVAGACRSGNSSSTTTTTTVDSFGGDVQAPPMQAMPLPPSFCASGAVRFPFSSYPVTHXYYFFGQAAAGCHMLKLPPTTGDCGSERLQTPRRVEESVGRPRSXVARRAAVSSDENP

SEQ ID NO: 77810 - DNA, 828 bp, Zea mays
  misc_feature: Ceres CLONE 1562816
  misc_feature: Encodes the peptide sequence at SEQ ID NO. 77811
ctggagctccccgcggtggcggccgctctagaactagtggatcccccgggctgcaggaattcgtctcacccctagaaaaagctaacccaaacggacaaacccaatcagaccgaatgggcaccgcatcaccggactccggcgaccttatcgaggtggggccggcgaggccgggatctccggtagccgtggtgaccatcaaccggccttcggcgctcaacgcgctgacgaagcccatgatgatctccatggcggctgcgttccggcggctgggtgccaacgacgccgtggcagcggtggtgcttgcgggccgcggtcgcgcgttctgctccggggtggacctgacggcggcggcggaggtgttcaagggcgatgtgaaggacgtcgccacggaccccgtcgtgcaaatagagctctgccggaagcccatcttccgcgccatcgccgggttcgccgtcactgccgggttcgagatcgccctcgcctgcgacatcctcgtcgctggacgctccaccaagttcttggacacccacgccaagtttgggatatttccttcctggggtctttcacagaagctttctcgcatcattgggccgaatagagcaagggaagtgtcactaacttgcatgcctgttactgctgaaatggcagagaggtgggggcttgttaaccacgtcgtggatgataatgacgtgctgagtaaggccatagacgtcgctgaggctatcgtgacgtacaccgcacctgtattgtattgtacatatcggttatacatcgacgatttaaactggacttggagcatgctcaagcacttgagaaggatagagtcat

SEQ ID NO: 77811 - protein, 238 aa, Zea mays
  misc_feature: Ceres CLONE 1562816
  misc_feature (24)..(189): Pfam Name: ECH Pfam Description: Enoyl-CoA hydratase/isomerase family
  misc_feature: SWISSPROT Homolog: EC 4.2.1.55 3-hydroxybutyryl-CoA dehydratase
MGTASPDSGDLIEVGPARPGSPVAVVTINRPSALNALTKPMMISMAAAFRRLGANDAVAAVVLAGRGRAFCSGVDLTAAAEVFKGDVKDVATDPVVQIELCRKPIFRAIAGFAVTAGFEIALACDILVAGRSTKFLDTHAKFGIFPSWGLSQKLSRIIGPNRAREVSLTCMPVTAEMAERWGLVNHVVDDNDVLSKAIDVAEAIVTYTAPVLYCTYRLYIDDLNWTWSMLKHLRRIES

SEQ ID NO: 77812 - DNA, 792 bp, Zea mays
  misc_feature: Ceres CLONE 1562817
  misc_feature: Encodes the peptide sequence at SEQ ID NO. 77813
  misc_feature (646)..(646): n is a, c, t, g, unknown, or other
ctggagctcaccgcggtggcggccgctctagaactagtggatcccccgggctgcaggaattcgtctcacccctagaaaaaatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccatcaagatcgatnctggagaccaaacaagattgtggactttcatcaagtttgatggttgcaacgtcgtcatggtggactggtgggaaggacactggcccgggtggggtgttatcaagaaccagggagaagcaccaagggcaggctttgagaccaattat

SEQ ID NO: 77813 - protein, 212 aa, Zea mays
  misc_feature: Ceres CLONE 1562817
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (164)..(164): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDXGDQTRLWTFIKFDGCNVVMVDWWEGHWPGWGVIKNQGEAPRAGFETNY

SEQ ID NO: 77814 - DNA, 859 bp, Zea mays
  misc_feature: Ceres CLONE 1562818
  misc_feature: Encodes the peptide sequence at SEQ ID NO. 77815
  misc_feature (454)..(454): n is a, c, t, g, unknown, or other
  misc_feature (801)..(801): n is a, c, t, g, unknown, or other
  misc_feature (830)..(830): n is a, c, t, g, unknown, or other
ctggagctcaccgcggtggcggccgctctagaactagtggatcccccgggctgcaggaattcgtctcacccctagaaaaaaaaacaaatttagctgttttttctttcgacgttttcgtccctacctcgcggttggggctcgcggctctcgcggcccgcctgtgctactgctgcacccgcacggccgcgcgcacctccaccgcaacggtcacttctagctctcgtgcagtcgtgcgtcctccatcgtcgcctctcctcccgcggtcagggtaacgccgcgtgtctcccgtcgcatactcgctcacacccatggccgcaccgccggccgcctcgctagtggcacgcgccgccctcccgccgcgccttcgcccaaccaccgcttctccccttggccccgccgtcctcggtcccagcagccgccgccggtacctccgtctccgccgctcgccatcgcntggcggggactgccgcggcggcggcgagctccccatccgtgccttcctcgtttccggggcccgggccaggtatcggcgatgccctcggcgacgtcgaaatctactccgcggccaccggcgagcccgtcctgttcagagacctgtgggaccaggacgaggggagtgtctgttgttgcgctgctaaggcatttcgggtgcccatgctgctgggagttggcctctgttctgagggacacaaagagagatttgattctgctggagtaaaactgattgcttgttggtgttggcactccagcttaaagcccgtattcttgccgagcgctttgccctttcccgtggaatacctncatggctgatcctggatccgaaggcgtanaaatctctgggccctatattttggggggg

SEQ ID NO: 77815 - protein, 61 aa, Zea mays
  misc_feature: Ceres CLONE 1562818
MPSATSKSTPRPPASPSCSETCGTRTRGVSVVALLRHFGCPCCWELASVLRDTKRDLILLE

SEQ ID NO: 77816 - DNA, 791 bp, Zea mays
  misc_feature: Ceres CLONE 1562820
  misc_feature: Encodes the peptide sequence at SEQ ID NO. 77817
  misc_feature (364)..(364): n is a, c, t, g, unknown, or other
  misc_feature (652)..(652): n is a, c, t, g, unknown, or other
ctccccgcggtggcggccgctctagaactagtggatcccccgggctgcaggaattcgtctcacccctagaaaaaagatccgcccggcaaatcttaggtagagaccagaccgctgcatcgccgactccgcggagaggcaggcatcacattttgtagcgtgatcgcgcgccgccgccacgcctccccatgcaagctactccgatcctagctactggctagctagttgcaactactcgagctaccagctagctaactggccagcagcaggtagtctgctcagggtcggagggtcggccggcgcggcggcggggcgcgcgcgcgcgggaaggcgggaagccgggaacgcatgggcaacgccctggggntgccgcgggggctcggcgagcggctggcggccagcgcgaggaacggcgacgcggcggaggtgcgccgcctgctggaggaaaacccggggctcgcgcgctgcgccgccgtcggcagcagcctcaactcgccgctccacctcgccgccgccaaaggccaccacgagatcgccgcgttgctgctggagaacggagcagaagtgaatgctaggaacctttacagcgagacggcgttgatgcaagcgtgccggttcgccactggggatggtggtcagacgctgctgggtttcnagatgcaaccgtggtccaaggtggacagcctgagccggccaaacagcgcttgcacttggccggccggcgggaggccactccaccttgccgcccgcttgcctgccttggccgggcgcccagcgcccggctgggaacaagt

SEQ ID NO: 77817 - protein, 148 aa, Zea mays
  misc_feature: Ceres CLONE 1562820
  misc_feature (46)..(78): Pfam Name: Ank Pfam Description: Ankyrin repeat
  misc_feature: SWISSPROT Homolog: EC 2.4.2.30 NAD(+) ADP-ribosyltransferase
  misc_feature (7)..(7): Xaa is any aa, unknown, or other
  misc_feature (103)..(103): Xaa is any aa, unknown, or other
MGNALGXPRGLGERLAASARNGDAAEVRRLLEENPGLARCAAVGSSLNSPLHLAAAKGHHEIAALLLENGAEVNARNLYSETALMQACRFATGDGGQTLLGFXMQPWSKVDSLSRPNSACTWPAGGRPLHLAARLPALAGRPAPGWEQ

SEQ ID NO: 77818 - DNA, 786 bp, Zea mays
  misc_feature: Ceres CLONE 1562822
  misc_feature: Encodes the peptide sequence at SEQ ID NO. 77819
  misc_feature (511)..(511): n is a, c, t, g, unknown, or other
ctccccgcggtggcggccgctctagaactagtggatcccccgggctgcaggaattcgtctcacccctagaaaaaacgacgccgcgcccgcggaatccatcttctccatctccaactgtgctactgtaggagctgctgcaatcggggagagaaacgcgaccagtttgccggcaccaacacggcctgctgccacatctccggcatcttcttccggtgcgccaaataacccctcctcttttctgactgctagtcagggttggggactgaaaactgtcgctgttagttggggttggggactctttcagtggtaagtccacatgcaggctgcagcaagcaactggacgatggtggcttccaggcagtcagagaacaatgcacaagaagaagcatcaccattgacgactcctaacgccaacatagccaggatcatcccttcgctgcccctcgagaccaggtggccaccgttccctctccgacggtacgccaatttttggctgccctgagtaacattngaaggaggcgtcccccgcgttcattcctgcttcgagccgagacccaccggacgtggtccttcgcaagcttcccccaagtcttgggacccccctggcttcaaggcccttgccttttcggaagccttaaagggttccaaggcattccgcccgtttgaaaaaaaaacaaattcgggttgggccttttggaaaccccctccagaaacgggggtccgagggttcccctcaaaactttttttttttcccccccccccaaaagggggtgaaagatccccagg

SEQ ID NO: 77819 - protein, 61 aa, Zea mays
  misc_feature: Ceres CLONE 1562822
MQAAASNWTMVASRQSENNAQEEASPLTTPNANIARIIPSLPLETRWPPFPLRRYANFWLP

SEQ ID NO: 77820 - DNA, 791 bp, Zea mays
  misc_feature: Ceres CLONE 1562823
  misc_feature: Encodes the peptide sequence at SEQ ID NO. 77821
  misc_feature (385)..(385): n is a, c, t, g, unknown, or other
  misc_feature (386)..(386): n is a, c, t, g, unknown, or other
  misc_feature (419)..(419): n is a, c, t, g, unknown, or other
  misc_feature (433)..(433): n is a, c, t, g, unknown, or other
  misc_feature (436)..(436): n is a, c, t, g, unknown, or other
  misc_feature (450)..(450): n is a, c, t, g, unknown, or other
  misc_feature (469)..(469): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
caaagctggagctcaccgcggtggcggccgctctagaactagtggatcccccgggctgcaggaattcgtctcacccctagaaaaaatatttgttaagtttcaggcagagagaaagatagaggagcaaacagcaactccagaagatgagtctccctcgccgccgccaccttgtcctgctcgcctgcctcctggtcttcctcgtcttcgccgcgtccgcgtcgacgagttccgccgaggtggccccgagcgtggcggtggacttcgtgcggcggtcgtgccggtcgacggagtacccgcgcgtgtgcgagagcacgctggtcccctgcgcggctggcgtggggcgcagcccgcgcctgctggcgcgagcgggcttgggtggttggcnngcgacgcgcgcgcaactgctcctcctacatccncggcggcggcggcngcncgatgaaggactgncgcgagctggcgcgcgacncggaaggagcggctgcggcagtccgccgcagaaatggaagcggatgggccgtgccggcacaccgccgcttcgcttgggcccctcagcaaacttcagaacctggggccaggcccggcttaacgaaacctccacctggcttgactcccttgcccaaaaatcccccggggggaaaggaaagcaaccacccctcaggaaaaaaaaaaagggggggggggccttttnnncaagaaacacgaaaaagcgctgggggctcttaaaaagggtcccgccggggccccccccgggggggggtcccttgaaaccctggtggtacaaaccttat

SEQ ID NO: 77821 - protein, 216 aa, Zea mays
  misc_feature: Ceres CLONE 1562823
  misc_feature (81)..(81): Xaa is any aa, unknown, or other
  misc_feature (97)..(97): Xaa is any aa, unknown, or other
  misc_feature (98)..(98): Xaa is any aa, unknown, or other
  misc_feature (103)..(103): Xaa is any aa, unknown, or other
  misc_feature (109)..(109): Xaa is any aa, unknown, or other
  misc_feature (183)..(183): Xaa is any aa, unknown, or other
  misc_feature (184)..(184): Xaa is any aa, unknown, or other
MSLPRRRHLVLLACLLVFLVFAASASTSSAEVAPSVAVDFVRRSCRSTEYPRVCESTLVPCAAGVGRSPRLLARAGLGGWXATRAQLLLLHPRRRRXXDEGLXRAGARXGRSGCGSPPQKWKRMGRAGTPPLRLGPSANFRTWGQARLNETSTWLDSLAQKSPGGKGKQPPLRKKKKGGGAFXXRNTKKRWGLLKRVPPGPPPGGGPLKPWWYKPY

SEQ ID NO: 77822 - DNA, 794 bp, Zea mays
  misc_feature: Ceres CLONE 1562824
  misc_feature: Encodes the peptide sequence at SEQ ID NO. 77823
atagctggagctccccgcggtggcggccgctctagaactagtggatcccccgggctgcaggaattcgtctcacccctagaaaaagtccaaaaccctagcccttgcgccgccgcctcctccgccacccagcgctcgagctcctcgcgtcctgcgagcgcgcgccgcaacgccaccatgaagttcaacatcgcgaacccttccaccgggtgccaaaagaagctggaaatcgatgacgaccagaagctgcgtgccttttatgaccgaaggatatcccaggaggtcagtggtgatgctctgggtgaggagttcaagggttatgtcttcaagatcatgggtggatgtgacaagcaaggcttcccaatgaagcaaggagttttgacttctggtcgtgttcgtcttctgctccataggggcactccctgcttccgtggttatggcaggcgtaatggtgagcgcaggaggaagtctgtccgtggttgcatcgtgagccaagacctatctgttatcaacttggtgattgggaaaaagggggagaatgatctgcctggtctgactgacactgagaagcaaaggatggggggtcccaagagggcctcccagagcaggaaagcgggtccacctgaagagggggggaggaggacgcgagggcggggacagagggccggaggaaggttcactaccagagagcggggaaggagggcgcgggagggcccctgaggagtccaacgggggggggagcaccccttggagacgccccagaagagaagcggggggggggaagtgggcggaagagg

SEQ ID NO: 77823 - protein, 180 aa, Zea mays
  misc_feature: Ceres CLONE 1562824
  misc_feature (1)..(129): Pfam Name: Ribosomal_S6e Pfam Description: Ribosomal protein S6e
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIGKKGENDLPGLTDTEKQRMGGPKRASQSRKAGPPEEGGRRTRGRGQRAGGRFTTRERGRRAREGP

SEQ ID NO: 77824 - DNA, 806 bp, Zea mays
  misc_feature: Ceres CLONE 1562825
  misc_feature: Encodes the peptide sequence at SEQ ID NO. 77825
  misc_feature (629)..(629): n is a, c, t, g, unknown, or other
  misc_feature (654)..(654): n is a, c, t, g, unknown, or other
ctccccgcggtggcggccgctctagaactagtggatcccccgggctgcaggaattcgtctcacccctagaaaaagccgccgctttcctcccacggtcccaccacgcgcgcggccggcgggcggccaacggcggggagcagcaccgcgcgatcgtcaccgacgcttccacctacctgtgtcagaacaaggtagcaaaatgaacaaccacctaagcttcgaggagggctggaaagtcctggaacaggggattgtaaaatgctcgaagattttggagtgcaccagtacaaggcctaccgtgaacgaatacatgaactactatgattgtgcttacaggatggctgtgcagaaacaacattactgtccagaaatgtacaatggtttcaagatgatgcttgcagaatgtgtccgcacaatggttctgccccatctcatgcacaagcaaaatgacagctttttcagagagcttgtgaaaatgtggtcaaactattgcatcatgattagatgtgtaattggcttcttcagctatttggaccgctgctatgtgaagcagtacaaactaccatcgcttagcaacactgctgctaccctcttctttgatccagtcttttcctactttcatgatgaagcangaacggctcttcttactatgatccnacagaacgtgatgggatcaggatggatcgagcccttcgggatgtatgcatggcatatgttgttctgagcaaaatcataatgcaaaatgcttttcttgatgaaaatatggctacactccggggagaagtccgaaaggataagccctactcctg

SEQ ID NO: 77825 - protein, 174 aa, Zea mays
  misc_feature: Ceres CLONE 1562825
  misc_feature (145)..(145): Xaa is any aa, unknown, or other
  misc_feature (153)..(153): Xaa is any aa, unknown, or other
MNNHLSFEEGWKVLEQGIVKCSKILECTSTRPTVNEYMNYYDCAYRMAVQKQHYCPEMYNGFKMMLAECVRTMVLPHLMHKQNDSFFRELVKMWSNYCIMIRCVIGFFSYLDRCYVKQYKLPSLSNTAATLFFDPVFSYFHDEAXTALLTMIXQNVMGSGWIEPFGMYAWHMLF

SEQ ID NO: 77826 - DNA, 827 bp, Zea mays
  misc_feature: Ceres CLONE 1562826
  misc_feature: Encodes the peptide sequence at SEQ ID NO. 77827
  misc_feature (788)..(788): n is a, c, t, g, unknown, or other
catagctggagctccccgcggtggcggccgctctagaactagtggatcccccgggctgcaggaattcgtctcacccctagaaaaactccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaagcgctctgtagaggttgtgaaggtcacagatgagatgaaagcgtttgcggcctatggcaagctccgccttgagcggatgaaacagagcacctcggtgcccgccagaaagaggcagctgaagcagagaaggaagacnagaagtgaagcagccaaactttgtagcctgttttgttct

SEQ ID NO: 77827 - protein, 219 aa, Zea mays
  misc_feature: Ceres CLONE 1562826
  misc_feature (6)..(185): Pfam Name: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKRLAPTIGISVDHRRKNKSLEGLQANVQRLKTYKAKLVIFPRRARKVKAGDSTLEELTTATQVQGDYMPITRGEKRSVEVVKVTDEMKAFAAYGKLRLERMKQSTSVPARKRQLKQRRKTRSEAAKLCSLFCS

SEQ ID NO: 77828 - DNA, 853 bp, Zea mays
  misc_feature: Ceres CLONE 1562828
  misc_feature: Encodes the peptide sequence at SEQ ID NO. 77829
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (808)..(808): n is a, c, t, g, unknown, or other
ctccccgcggtggcggccgctctagaactagtggatcccccgggctgcaggaattcgtctcacccctagaaaaaagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgctatatatatnnnnnannnnnnnnnnnnnnnnnnnnnnnnnaaaaaaattcgtcgcacgatggcgtccaagaacccagttgatctcgagttccagaagcccacgccgatgcacgccgtcgttgcatcggctcccgcagctgccgtgcggcttncttctggtacaggctccgtcgttgcttggatctccacgctgcgcg

SEQ ID NO: 77829 - protein, 128 aa, Zea mays
  misc_feature: Ceres CLONE 1562828
  misc_feature (32)..(128): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRKGKGKGVYQFVDKYGANVDGYSPIYNEDDWSPTGDVYVGGTTGLLIWAVTLAGILGGGALLVYNTSALSG

SEQ ID NO: 77830 - DNA, 776 bp, Zea mays
  misc_feature: Ceres CLONE 1562830
  misc_feature: Encodes the peptide sequence at SEQ ID NO. 77831
ctggagctcaccgcggtggcggccgctctagaactagtggaacccccgggcctgcaggaatttcgtctccacccctagaaaaagtccagcacgtacacaccacaccagcacccagcctcccaacgatgacggcggcggcggcaccggcggtcgctagcagggtgtgggaagtgggaaggaaggttggccgtcggcggtggccgaggcgacggcggacgaggcgtgggcgctgctgtcggacttcctggcgttccaccggtggcacccgcgcgtggccgcgtgccgcctcgcgtccggcaccccgcgcgcgccgggctgcgtgcgctactgcgagggcaccgccaccgccgccgacggcgagccggcgcccgactgggcgcacgagacgctgctggagcacgacgccgagcgccgcttcttccgctacgagatgaacgacaacaacatgggcttcggcctcttcttcgccacgttccgcgtcgtcccggccgccgccggcgggtgcgagctgcgctgggagttcgagtgcgagcccgtgcgcggcacgcccagggacgcgctcgtggcgcgcctgcaggccgggctcgacggcatggcggcgcgcgtgcgtgaccacgtcctcgccgctcgcgccgccgcccctgccgtggtgcccgccggtgcagctggtgagctcgtcgtcgtcaagctcgacagctccatcgccgccgtctgatcaccggccggcgcggcgtcgacggcgatccaacacgtaccaaccaagagaccgccgttcc

SEQ ID NO: 77831 - protein, 94 aa, Zea mays
  misc_feature: Ceres CLONE 1562830
MNDNNMGFGLFFATFRVVPAAAGGCELRWEFECEPVRGTPRDALVARLQAGLDGMAARVRDHVLAARAAAPAVVPAGAAGELVVVKLDSSIAAV

SEQ ID NO: 77832 - DNA, 840 bp, Zea mays
  misc_feature: Ceres CLONE 1562831
  misc_feature: Encodes the peptide sequence at SEQ ID NO. 77833
ctccccgcggtggcggccgctctagaactagtggatcccccgggctgcaggaattcgtctcacccctagaaaaagtcacaaggagaccctcctcagccgctagtaccagtagtcgtcgcgttagcaggcagatctgagttagccggcggatccgatccgtgcgcgtgcagtgtacgtgtgtcggtggagatggccacagcttacgctcccatggcgagccaggtgatgaagagcagcctcgtcgtgcactcgaggccgaggggcctgtcaggcgctgctgcgctcacgaggcggccgcggttcaccgtcaaggccatccagcccgagaaggcaacgtaccaggtggtgcagcccatcaacggcgaccccttcatcggcagcctggagacgccggtcacctccagcccgctcgtcgcgtggtacctctccaacctcccggcctaccgcaccgccgtgagtctgctgctgcggggcgtcgaagtcggcctcgcgcacggctacctcctcgtggggccccttcgcgctcacggggcccgctccgcagcacgcccgtgcacgggccaggccggggcgcttgggggccgcccgggctcgttcccaatcctcagcgttttgcctcaccatgtaaggggggtcccttcccttcaacaagggggacccgtccccgggggcccttgtttaaggttaaccgggaggaaaaaagggaaggccaaaaaatttgcaaaacctcccaaaggggttgggccaaattttacccgggggggaaatttttttttgggggggatttccccgggggggtgcttggggcgcaaattttttctcctctacgaggggcccacc

SEQ ID NO: 77833 - protein, 210 aa, Zea mays
  misc_feature: Ceres CLONE 1562831
  misc_feature (43)..(207): Pfam Name: PsaL Pfam Description: Photosystem I reaction centre subunit XI
MASQVMKSSLVVHSRPRGLSGAAALTRRPRFTVKAIQPEKATYQVVQPINGDPFIGSLETPVTSSPLVAWYLSNLPAYRTAVSLLLRGVEVGLAHGYLLVGPLRAHGARSAARPCTGQAGALGGRPGSFPILSVLPHHVRGVPSLQQGGPVPGGPCLRLTGRKKGKAKKFAKPPKGVGPNFTRGGNFFLGGISPGGCLGRKFFLLYEGPT

SEQ ID NO: 77834 - DNA, 892 bp, Zea mays
  misc_feature: Ceres CLONE 1562832
  misc_feature: Encodes the peptide sequence at SEQ ID NO. 77835
  misc_feature (844)..(844): n is a, c, t, g, unknown, or other
ccaagctggagctcaccgcggtggcggccgctctagaactagtggatcccccgggctgcaggaattcgtctcacccctagaaaaaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctccctcaactgcgtcaagttcggcgaggccgtctggttcaaggccggctcccaaatctgcaacgagggcgggctggactaccttggcaaacccagcctgatccacgcgcaggagcatgcctcgccatctgggccctgccaggcacgggcccaatggagcgccggtcgaggggctaccgtgtttggcctgcgaggccccaaccggcaaagtacttgataacacggtgatatacgtgggggagcgaggtgggaaacccccacaagacttgggcccgaataatacccggaagggcctttaggccgagagctataagggaggaagaggaggggacagaaaaaagggagcgcccncctgggccatgggttaagatccatgtgtcaggtgtggattcgcacccg

SEQ ID NO: 77835 - protein, 181 aa, Zea mays
  misc_feature: Ceres CLONE 1562832
  misc_feature (56)..(175): Pfam Name: Chloroa_b-bind Pfam Description: Chlorophyll A-B binding protein
MAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSLNCVKFGEAVWFKAGSQICNEGGLDYLGKPSLIHAQEHASPSGPCQARAQWSAGRGATVFGLRGPNRQST

SEQ ID NO: 77836 - DNA, 845 bp, Zea mays
  misc_feature: Ceres CLONE 1562833
  misc_feature: Translation starting site: 201
  misc_feature: Pfam Name: SAM_1 Pfam Description: SAM domain (Sterile alpha motif)
  misc_feature (744)..(744): n is a, c, t, g, unknown, or other
ctggagctccccgcggtggcggccgctctagaactagtggatcccccgggctgcaggaattcgtctcacccctagaaaaatccccagtccccaccacctccctgtatccctcctccccttctggccgacgaaaccctacgcgcgcgcgctgccaagacctcgccgccgacgcctactccgactccgacgccgcagtcgtgatgtacgccgacaggacctcgggcaggaaacgctctgtaatggaccgcctcggctcgggcggcggctcgcgctcgcggtccgacgacgcaaaaaggttttgccaggatgatgggacatggagacgtgagctttataaggattctagaggaactcagacttcatctgaacctacttccagaaatctggaatcgaacaaaaaatcccaagtgcagcaaaaggttgtgaagaaattaccagtttcagatcttcgtggaaagttatctggtgtcgcgagccagcgccctcaacttagcagtactgttcaggtcccaaaacctgtaaaagaggttattaagagcaacaaacctgttcaaaagagagaccccgctccaactactgcccctcctgacatcaagaaacccagtgcacctgcacccgtaccagcaccatctgcactaccaaagcaatcccagaacaagattgatgcttcgcttgacagtttactgaagtctcttgatctagagaagtatttgataaatttccaggctgaagaggttgatatgnaaagcattggtgtacatgaacgaagaagatatgaagtctttaggaattccaatgggtccccaggaaaagatactatcagcattggctcacagaaagaacaa

SEQ ID NO: 77837 - DNA, 870 bp, Zea mays
  misc_feature: Ceres CLONE 1562834
  misc_feature: Translation starting site: 161
  misc_feature (374)..(374): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
tccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacngctgggacaccgcggggctgtccgccgacccggagactttcgccaagaaccgcgagctggaggtgatccactgccgctgggccatgctgggcgcgctcggggtgcgtgttcccggagctgctcgcccgcaacggcgtcaagttcggcgaggccctgtgggtcaaaggcggggtcccagatcttcagcgagggcgggcttgactacctccggaaccccaggctgatcacgcggcgagcatcctggccatctggggcgtgccagggggggctcatgggccccctccagggggtaccccattccccggggggcctcggannnnnnnnagaggggccaacccctctgtnnncccggcggggggttttactccctttggggtttcccaaaaaaccccaaaggggtttcccgggaactccgggggtcaaggaaatataaaaaaacggccccccccccccccggtttctccccaggtgggggcgtcctttcgggggcgggcct

SEQ ID NO: 77838 - DNA, 799 bp, Zea mays
  misc_feature: Ceres CLONE 1562836
  misc_feature: Encodes the peptide sequence at SEQ ID NO. 77839
ctccccgcggtggcggccgctctagaactagtggatcccccgggctgcaggaattcgtctcacccctagatgctaaaatcaaggcaaggaatatcaaaagaaaagaatcaacgaatgatgtagaagctaatattattgatgatgagggtgatgaggtcatggtggacgtagaagaagctattgaaggacaacctgaagtcaatggagtttccaatcagttgatcaaaactctgaatatcactaaagatggctcaagcagaagcattgatgttctctctgattcaacagcacaagaatcatttttggaggcggtgaagcccagtggtcgtatcaatgcatgcttggccgtagggaaagatatgctctacttgtatggaggaatgatggaagtgaaagatagagaaattactcttgatgatctatattcacttaaccttagcaaacttgatgagtggaagtgtatcatatcggcctcagaatctgaatggttagaaatttctgaggaagaggatgatgatgatgatgatgatgagactgatgatgatgaaaatgaagagggggatgctagccagacagatgaagatgaagaagagtctgatgaagatgctgcaaagaacgtgtccagtgctgtgtctctgctgaagggtgaaagtaagaccatgcgtagaaaagagaagcgtgctcggatagaacagatcagggtcatccttggcctttctgattctcaaaggactccagtgcctggagaatcactgagagatttctacaagaagacaaatatgtactgggcaaatggctg

SEQ ID NO: 77839 - protein, 265 aa, Zea mays
  misc_feature: Ceres CLONE 1562836
PRGGGRSRTSGSPGLQEFVSPLDAKIKARNIKRKESTNDVEANIIDDEGDEVMVDVEEAIEGQPEVNGVSNQLIKTLNITKDGSSRSIDVLSDSTAQESFLEAVKPSGRINACLAVGKDMLYLYGGMMEVKDREITLDDLYSLNLSKLDEWKCIISASESEWLEISEEEDDDDDDDETDDDENEEGDASQTDEDEEESDEDAAKNVSSAVSLLKGESKTMRRKEKRARIEQIRVILGLSDSQRTPVPGESLRDFYKKTNMYWANG

SEQ ID NO: 77840 - DNA, 928 bp, Zea mays
  misc_feature: Ceres CLONE 1562837
  misc_feature (928)..(928): n is a, c, t, g, unknown, or other
ctccccgcggtggcggccgctctagaactagtggatcccccgggctgcaggaattcgtctcacccctagaaaaagccctggcccgaagaacgctaaccctagcggctgctccagtgctcccccgtgccccgtttccgcttccgccgccggccgctcgcccgcaggccgcagcgcgctccgtgcctccctccgcgctgtccgcggaccgcggtcccctgcagccctgctctgtcgtccgcccccagccccctgctccgctgcgggctgcggcgctgcctgctccctggctctcagcctgccgcttctcagtccacttctgccgcagcccctcttctctcggtctagagatccgtccgggcgcggcagcctcgctttcgtttcgcattcagggacccccttgcctatatcagccctgtggtcataactccttgtagagaaaggagaagatgcacgcctctagggcaaggctttttctggagtaccaaggagggacagccgagagaagtcacctgacccctgaatcccaattaaaatgggaggaatcccaccctattcaaggggactggctcttattcaaggggcccttctgaaacacccttatgaaaggggggtgggggtttcaaccttgcggttcgccaatttccgaaagaaggaaccccctaatcggcccccccccaaggtgggatttttttaacccaaaattttccccccccaccaggggggattttttaagaacaagggggagaaaattttccctgtggaaaaaatttgaaaaaaaaagagttgggggccccctgccatggggaaccccctctcactcctggtttgtggtggaaggcggaaaatttggtctctttgaggggggccattcctctgaaaaccaaaaaaaggccccacccttataatgggggggagttctgaggcagan

SEQ ID NO: 77841 - DNA, 817 bp, Zea mays
  misc_feature: Ceres CLONE 1562841
  misc_feature: Translation starting site: 419
  misc_feature (579)..(579): n is a, c, t, g, unknown, or other
  misc_feature (623)..(623): n is a, c, t, g, unknown, or other
  misc_feature (665)..(665): n is a, c, t, g, unknown, or other
  misc_feature (734)..(734): n is a, c, t, g, unknown, or other
gctggagctccccgcggtggcggccgctctagaactagtggatcccccgggctgcaggaattcgtctcacccctagaaaaagctacagatccaacgtgcgctccagattaggcaaggaagcggaagcgaggcgcccgtcatgctctgcctcagcctggtcgcgccaccaccgatggcccccgccggccggcggcggcggcggcggcatccgacttctgtgacccgccgcggccaaaccctcgccgccctcccgtgccactgtggacggcggcacgtcatcggtgcctcctcggctgccgctctccttcctttcctcgcccctccttctctggccgctccgcccgtcgaccccgacgtggtgctccagcgagtgcacccgtcgaggccggactggtatgaggagttctatgcctcggccatggaccagggaatgaaatcatacgaagcagagatcgcaggatacaaagtaaagctcttctctcaactgtcgcctgcgggaaagaacattctcgagctcggtgttgggacagggcctaacttcaaatactatgcaagtgaagatggggttaatgtggatcnggagtggaccctaacaagcacatggagaactatgcaagggctgnctgttgtgtctgctgggactcgcgtcgtcgagcttcaattcnagaagaggggttgctgaagccttgccggcagaagacaattcatgggaatgtggtggtcggcacactggntgctgtgctctgtaaacacatcgacatggcactgagagaaataagcgagtcctaaagcccggtggtctccacgtgttcattgt

SEQ ID NO: 77842 - DNA, 804 bp, Zea mays
  misc_feature: Ceres CLONE 1562842
  misc_feature: Translation starting site: 150
  misc_feature: Pfam Name: DUF620 Pfam Description: Protein of unknown function (DUF620)
ctccccgcggtggcggccgctctagaactagtggatcccccgggctgcaggaattcgtctcacccctagaaaaactggagcagcagcaacaaacacgcgcggcacggcacggcagcctgactcggaagctacacgcaggccgtagcgagatgaagtcgagggtggcgctggagccgctggcggaggagcccggctgcggggaggaggacgcggcgcgccggcgctcgggcctccacgcggcgctgcaccggtgggcgcgcctcctctccggtggcgtggcaggggacgacgcccgaccggccgccgacctgcgcgtgctcctctccgtgctcgcctgcccgctctcccccgtgcccctcctcccgcgccttccacgccacgtcgcgtcgtcggcgcagtacatcatcgagcagttcagggccacgacggggtgcgggaagctggaggacggcgccgtcaagagcatgtacgcgtccggccgggtgcgcctctccatgctgcatgagcccggcggtgggggaatgcggcgggcgcggccacgaggggagcttcgtgctgtggcagctcgcgcccagcatgtggctcgtcgagatgtccgtggccggggcagagcgtcgccgcgggcagcgacggccgcgtcgcctggcgccgcacgccctggctcggcgcccacgccggcgcggcgtgggctcccgccccgctccgacgcgcgctccagggccctggacccctgttgacgatcgcgtccatcttctcgacggccgagcacgcgggcctaaaaaggaggtgggacggcgaaggact

SEQ ID NO: 77843 - DNA, 840 bp, Zea mays
  misc_feature: Ceres CLONE 1562843
  misc_feature: Encodes the peptide sequence at SEQ ID NO. 77844
  misc_feature (244)..(244): n is a, c, t, g, unknown, or other
  misc_feature (385)..(385): n is a, c, t, g, unknown, or other
aaagctggagctccccgcggtggcggccgctctagaactagtggatcccccgggctgcaggaattcgtctcacccctagaaaaatcctcctctatcttcgcatctggcacgagcagccaagcaaataaaagtagagcggcgagcgacgaccggcctgggccaccctttcggccgagcgtagccgagcaggtcgtcgtcgtcgtcgcagcaccccgccggctagcatggccacgaggaggcagtnggtggtggtggtgcctgctgctgctggcggcgtggtgctgcgccgcggccgcgcagtcgccgccggcggcggacccgctgcagagcaagtgccagggggacttcgggaagctgacggactgcatggactacgcgacggggncacgcggcgtcgccctcgtccacctgctgcggcgacgccggcgaccgggaggaaggcgcgccccgagtgcctctgctacatcatccagcaggtgcacacggggcgcaaccaggtgcagtcgctcggcctgcgcttcgaccgactcatggcgctccccgccgcctgcaacctccccaactccaacgtctcgctctgcatcaccctgctgaacctgaagccgggctctgcggactacgccctcttcgccacgcctccaagatcacgccgtcagccggcggcaaccctgcgagcgacagcgcgcggggcagcggcgtcaagctccgggctggggtaaaaaggggcggcgtcccggcttgccgtgggtctccggcgatcgcctcgtccactcttctggatgggacgacctcctctcaaggagaccagcgggcggtttttttttacccctcccgggggat

SEQ ID NO: 77844 - protein, 164 aa, Zea mays
  misc_feature: Ceres CLONE 1562843
  misc_feature (7)..(7): Xaa is any aa, unknown, or other
  misc_feature (54)..(54): Xaa is any aa, unknown, or other
MATRRQXVVVVPAAAGGVVLRRGRAVAAGGGPAAEQVPGGLREADGLHGLRDGXTRRRPRPPAAATPATGRKARPECLCYIIQQVHTGRNQVQSLGLRFDRLMALPAACNLPNSNVSLCITLLNLKPGSADYALFATPPRSRRQPAATLRATARGAAASSSGLG

SEQ ID NO: 77845 - DNA, 790 bp, Zea mays
  misc_feature: Ceres CLONE 1562845
  misc_feature: Encodes the peptide sequence at SEQ ID NO. 77846
  misc_feature (674)..(674): n is a, c, t, g, unknown, or other
ctccccgcggtggcggccgctctagaactagtggatcccccgggctgcaggaattcgtctcacccctagaaaaaaagaatttgtactgttcaaggtgtaatgggttgcttttggaaagtttcacacaaatagtcatgtatgggaagtctctgcttcatgaaggttcatgtgagccaaggattcaggaagttgaagcagaagttcaggaaccttcagttcatccttggggaggtctttcgacaacaaaggatggcatcctaactcttcttgattgcttcataaatgcaaaatctcttcatgtgatccagaatgtatttgacaatgcacgtgcgagagaacgtgaacgtgagatgctttaccctgatgcatgtggtggcggtggcagaggatggattagcccagtgatacctaactatggcaggggccatggaacacgagatacctgtgctttgcacactgcacacctttcttgtgatactctggtggatttttggtcggctctgggtgaagaaactagatcatctcttttaaggatgaaagaagaggacttcattgaaagacttatgcacagattcgacagcaagagattctgcagagactgcagaaggaatgttattcgcgaattcaaggagctcaaggaactaaaacgcatgcgaagggaacctcgctgcacntagttggttttgtgttgcagatccacatttaaggtgtgaggtgttcgaggatgctattcttgttgattggcatcaatctttattggagcaagatggaatataccatcatttcgagt

SEQ ID NO: 77846 - protein, 224 aa, Zea mays
  misc_feature: Ceres CLONE 1562845
PRGGGRSRTSGSPGLQEFVSPLEKKNLYCSRCNGLLLESFTQIVMYGKSLLHEGSCEPRIQEVEAEVQEPSVHPWGGLSTTKDGILTLLDCFINAKSLHVIQNVFDNARAREREREMLYPDACGGGGRGWISPVIPNYGRGHGTRDTCALHTAHLSCDTLVDFWSALGEETRSSLLRMKEEDFIERLMHRFDSKRFCRDCRRNVIREFKELKELKRMRREPRCT

SEQ ID NO: 77847 - DNA, 777 bp, Zea mays
  misc_feature: Ceres CLONE 1562846
  misc_feature: Translation starting site: 112
ctccccgcggtggcggccgctctagaactagtggatcccccgggctgcaggaattcgtctcacccctagaaaaaacgccacgactctccaacgccacaggttgcgcccgcaatggcactcgtctccgcctcctcgtcctccaccaccgacgtcaaggggctccccactaatgggcagcgggcgtcgacctccttcctcggcggcaagacgctgctgagacatgccgaagcggcccggccgtcgatcgccgtgcgcgccacggcagaaccctacacgccgatactggttgcccggaagcacccctccgccgatggctcgacggtagtcttcccggcgacttctgctatgaatcctggggcctcggatctgaaccggatagcctgcagtggaaccttcatgcagagctggtgcactgtcagggggcgatgattggagctgtcggcatctttgttgcggaagttctgaccaatataggcgtactcgatacgcccttctgggtaattgtcaggagagcaacaatatttcccgaataccaccactcctcttcgtcattcaagttatacctcatcgggtgtgggccaagggccgacccctgggtggaaatcataaaacccccggaagtgttaaaacgggaacctttttttcccttaaaaaaagttacccgggaaccaaaatcttggaaacccagttggggcccccgggtgggaggccccccccgaggggggggggaaaatttttttcccgaaaaaaaaaagggggctttttcccacccccgga

SEQ ID NO: 77848 - DNA, 760 bp, Zea mays
  misc_feature: Ceres CLONE 1562847
  misc_feature: Encodes the peptide sequence at SEQ ID NO. 77849
  misc_feature (575)..(575): n is a, c, t, g, unknown, or other
  misc_feature (625)..(625): n is a, c, t, g, unknown, or other
  misc_feature (645)..(645): n is a, c, t, g, unknown, or other
  misc_feature (668)..(668): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
tggagctccccgcggtggcggccgctctagaaaagtggaacccccgggctgcaggaattcgtctcacccctagaaaaaattctaagggaaattgatgatgctgacaagctggttgcagctatccaggcaaagaagggtggcaaggcagtggttgttggaagaggttatatcggcctcgaactgagtgcagccctgaagatcaatgactttgatgtcactatggtgtttcctgaaccttggtgcatgcctcgcctcttcactgccgatattgctgctttctatgaggcttactatactaacaaaggtgtaaagatcttgaagggcacgctagctgttggttttgatgctgatgccaatggtgatgtcactgcagttaagctaaaggatggcacagtacttgaagccgatattgttgttgtcggtgttggaggcagaccattgactactctcttcaagggtcaagttgctgaggagaagggtggaatcaagactgacgcttcctttgaaacaagcgttcctggagtatatgccattggtgatgtggctaccttcccctttgaagatgtacaatgagnttgaggagaagtggaacatgttgaccattcctagaaagtctgccagagcnaggctgtaaaggcgatcaanggcaaaagagtcccggtgaaccnaggttccggaagtatgaactacccctgccatacttccctactcccggatcatttccgacccctggcgtggcaattcctaccnnngcgacaac

SEQ ID NO: 77849 - protein, 117 aa, Zea mays
  misc_feature: Ceres CLONE 1562847
  misc_feature (1)..(70): Pfam Name: Pyr_redox Pfam Description: Pyridine nucleotide-disulphide oxidoreductase
  misc_feature: SWISSPROT Homolog: EC 1.6.5.4 Monodehydroascorbate reductase (NADH)
MVFPEPWCMPRLFTADIAAFYEAYYTNKGVKILKGTLAVGFDADANGDVTAVKLKDGTVLEADIVVVGVGGRPLTTLFKGQVAEEKGGIKTDASFETSVPGVYAIGDVATFPFEDVQ

SEQ ID NO: 77850 - DNA, 858 bp, Zea mays
  misc_feature: Ceres CLONE 1562848
  misc_feature (562)..(562): n is a, c, t, g, unknown, or other
  misc_feature (661)..(661): n is a, c, t, g, unknown, or other
  misc_feature (681)..(681): n is a, c, t, g, unknown, or other
  misc_feature (739)..(739): n is a, c, t, g, unknown, or other
atagctggagctccccgcggtggcggccgctctagaactagtggatcccccgggctgcaggaattcgtctcacccctagaaaaaggaagggcctcttcttctgcttctggcacgccgacaagccgctctaccagagctccgtcgccacgcgcctcgcctccgccgtctccgccccgccgtcccccgccgacggcgccgccttccttgccgcctacctcaccacgctccgccgcgagtgggcacacatcgacgtccaccgcctcgacaagttctacctcctcaaccgccggttcctccaccacgccttcctgctcctcagcgccaactcattcgcccccgtcgtcacctcccaggtcgtgtccgtcctgtcagataaggccctgctcccggaagccgacagcgccgccgccggcacctcccggggcctcgggtaccacgtcgccgaggcattcctagacgagctcttgcctgtgctccccgttagcctggagacggtggacgccctgctggctccgttcttcatcgtgttggcgaagtcgaccgatcgggtgatggtgaggtnaaggtgaaggcatgcgtggtttgagaggttactgggagagtggcagtcgtttgcttgagatggtgagaaagggggaagggaagtgggacaaggggtagncgctgaggagaagctcgggnaaatttgggtttagtgtttggattttaggaagaggttccctggataattggtgcgaantgcagcgacgggtgcatgggaaccgggaaggtgctctttgggggttgaagggatggctttttgtgaaagatatcgaggaaggtttttgcaagctatcctggggtctcggagatcccccg

SEQ ID NO: 77851 - DNA, 913 bp, Zea mays
  misc_feature: Ceres CLONE 1562851
  misc_feature: Encodes the peptide sequence at SEQ ID NO. 77852
  misc_feature (37)..(37): n is a, c, t, g, unknown, or other
  misc_feature (293)..(293): n is a, c, t, g, unknown, or other
  misc_feature (378)..(378): n is a, c, t, g, unknown, or other
  misc_feature (379)..(379): n is a, c, t, g, unknown, or other
  misc_feature (393)..(393): n is a, c, t, g, unknown, or other
  misc_feature (398)..(398): n is a, c, t, g, unknown, or other
  misc_feature (667)..(667): n is a, c, t, g, unknown, or other
  misc_feature (879)..(879): n is a, c, t, g, unknown, or other
ctcaccgcggtggcggccgctctagaactagtggatnccccgggctgcaggaattcgtctcacccctagaaaaagcaagacttcatggaagtggttgagttcttgaagaaacccgaaaggttcactgctgttggtgctcgcattcctaagggtgtactgcttgtcggtcctcctgggacgggtaaaactttgcttgccaaggcaattgcaggagaggctggcgtgccatttttctcaatttcaggttctgagtttgtggagatgtttgttggtgttggtgcttccagagttcntgacctttttaagaaggccaaggagaatgctccttgcatagtgtttgttgttgaccccgatgcggtgggggggggggggggtacnngtattggttgttgnaaatnatgaaaagggaacagactcctcatcaactacttagtggagatggatggctttcgaggggcaaccctggaattattggtttttgctgcccactaacccggcctgaacgtcttgggattccccttttacttagaaccggggagttttccataaaaagggtgttcctgtcgacggtcccttaattgagctggccaagggagggaaattccccaaccggcggctggggttgcacccaagagagtttgggttccggaaagatctcccgaggccncctcatacaaagtgagggaaccccctgggggtgggcctaaatctaaccttcggccccccccggtccccccgggacgggccccactccgccccctggacaaacggggggaacacacccccagtcttctcctctcccctataatacgagcgagaggtcgtttggccgggagagtcgcccgcctctgaggacaagaggcgatagaggggaaaggnaggcggggggaccacccggcgaaggcgtcgggag

SEQ ID NO: 77852 - protein, 104 aa, Zea mays
  misc_feature: Ceres CLONE 1562851
  misc_feature (23)..(106): Pfam Name: AAA Pfam Description: ATPase family associated with various cellular activities (AAA)
  misc_feature: SWISSPROT Homolog: EC 3.6.4.3 Microtubule-severing ATPase
  misc_feature (70)..(70): Xaa is any aa, unknown, or other
  misc_feature (99)..(99): Xaa is any aa, unknown, or other
  misc_feature (103)..(103): Xaa is any aa, unknown, or other
MEVVEFLKKPERFTAVGARIPKGVLLVGPPGTGKTLLAKAIAGEAGVPFFSISGSEFVEMFVGVGASRVXDLFKKAKENAPCIVFVVDPDAVGGGGGTXIGCXK

SEQ ID NO: 77853 - DNA, 792 bp, Zea mays
  misc_feature: Ceres CLONE 1562852
  misc_feature: Encodes the peptide sequence at SEQ ID NO. 77854
  misc_feature (671)..(671): n is a, c, t, g, unknown, or other
  misc_feature (724)..(724): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (749)..(749): n is a, c, t, g, unknown, or other
  misc_feature (750)..(750): n is a, c, t, g, unknown, or other
tggagctccccgcggtggcggccgctctagaactagtggatcccccgggctgcaggaattcgtctcacccctagaaaaaacatgatagaacaaagcaaacatctgcaaactgtaatggcggctccagtaggtgccaatgccataggagcgggcgacgagctgctcctgctgggcacatggtcgagcccatgggtgatccgagcgaggatggcgatggggctcaagggcctgagctacgagtacctcgaggaggacctcggcaacaagagcggcctcctgctccggtccaacccggtgcacaagaaggtgcccgtcctcatccacggcggccgcccagtgtgcgagtcgctcgtgatcctgcagtacctcgacgaggcatggccgacggccggtcctccgctcctcccggccgacccctacgaccgcgccacggcacggttctgggcggcctacatcaacgacacgtttttcccggcgttcagggcgctgttcagatcgctgacggacaagcagaaaggggaggcgctgcggaacgccccgcctgcggtggagaccttggaacgagcgctccccgaatgctcccgggggaaagggcttcttccggcgggaacaccctcagggtcccggaacatccccccccggaaacccccccgtccaggatcccaaaaggnggaaaaagagtgggaaagccccagccgcacggagaacgaaacaaagaacccangagaagaacaaaggggnnncggaanngggggcgtcggaatcgaaagtccatcgttatgttatgtgttt

SEQ ID NO: 77854 - protein, 226 aa, Zea mays
  misc_feature: Ceres CLONE 1562852
  misc_feature (14)..(87): Pfam Name: GST_N Pfam Description: Glutathione S-transferase, N-terminal domain
  misc_feature: SWISSPROT Homolog: EC 4.4.1.5 Lactoylglutathione lyase
  misc_feature (186)..(186): Xaa is any aa, unknown, or other
  misc_feature (204)..(204): Xaa is any aa, unknown, or other
  misc_feature (210)..(210): Xaa is any aa, unknown, or other
  misc_feature (212)..(212): Xaa is any aa, unknown, or other
MAAPVGANAIGAGDELLLLGTWSSPWVIRARMAMGLKGLSYEYLEEDLGNKSGLLLRSNPVHKKVPVLIHGGRPVCESLVILQYLDEAWPTAGPPLLPADPYDRATARFWAAYINDTFFPAFRALFRSLTDKQKGEALRNAPPAVETLERALPECSRGKGLLPAGTPSGSRNIPPRKPPRPGSQKXEKEWESPSRTENETKNPXEEQRGXGXGGVGIESPSLCYVF

SEQ ID NO: 77855 - DNA, 834 bp, Zea mays
  misc_feature: Ceres CLONE 1562857
  misc_feature: Encodes the peptide sequence at SEQ ID NO. 77856
  misc_feature (596)..(596): n is a, c, t, g, unknown, or other
agctccccgcggtggcggccgctctagaactagtggatcccccgggctgcaggaattcgtctcacccctagaaaaaaagggaaacacaggaacgacaggcaattcgaggcgggcaatctaatcgactgccatcccgtctcatcgatctcccaaatctgagagcgttcccaggacctagggttcttgagatccagccccaggatggatccgagaccctagagctcccctcctcctcgccatcgtcgttctcgcacttggcgtatccgtggtggccagcgcagaggacgacgcgtcgggggtctctctgggacgccgcgccggggggttcttgcacggcctgaagaatgatgcactggcggagggcgatcatggggtggcaatataccaggttggaccggggctgttcgacgcactctttgcgcagctctccatgatactagtcagtgagattggagatgagaccttcatcattgctgcgctgatggagatgcggcaccccaagtcaactgtgctgtctggtgcactatctgcactttatgtgatgacagtatagtaactggactcggcctatactgctggacttgatacaaggagcncactaatagggctgctacagttttcgagtggtacttggactacggttgctggaactttgctggaaatcgacccaacgaatcccggagatgaaaatggatcagtgcaaaaaaccttgggtccggtcaaggaaacaacccttccgaggttctttgcgaaatttgtcccacatttttttggagggtttcatctaaacttttttaaaggaatggggggaccggggtcataagggaaatttgg

SEQ ID NO: 77856 - protein, 40 aa, Zea mays
  misc_feature: Ceres CLONE 1562857
MILVSEIGDETFIIAALMEMRHPKSTVLSGALSALYVMTV

SEQ ID NO: 77857 - DNA, 771 bp, Zea mays
  misc_feature: Ceres CLONE 1562858
  misc_feature: Encodes the peptide sequence at SEQ ID NO. 77858
  misc_feature (682)..(682): n is a, c, t, g, unknown, or other
ggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcaatcttcagcgagggtgggctggactacctcggcaacccgagcctgatccacgcgcagagcatcctcgccatctgggccctgccaggtcgtgctcatgggcgccatcgagggggtaccgcgtcgccgggcgccgctccnggaaaggtcgtcgaccccgctctaccccggcggcagctttcaacccgctcggcttcggcgacgaccctgaagcctttcccggacctcaa

SEQ ID NO: 77858 - protein, 150 aa, Zea mays
  misc_feature: Ceres CLONE 1562858
  misc_feature (64)..(151): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQSSARVGWTTSATRA

SEQ ID NO: 77859 - DNA, 682 bp, Zea mays
  misc_feature: Ceres CLONE 1562859
  misc_feature: SWISSPROT Homolog: EC 2.7.11.1 Non-specific serine/threonine protein kinase
  misc_feature (498)..(498): n is a, c, t, g, unknown, or other
agctcaccgcggtggcggccgctctagaactagtggatcccccgggctgcaggaattcgtctcacccctagaaaaattttaatcagcgtctagaaattgcaattgacgtggctcatgcacttacttatcttcatctgtatgcagagaagactataattcatcgtgatgtgaagtcatcaaacatcctgctgacagatagctatcgggccaaggtgtctgactttgggtttgcaagaagtggccctagtgacacggagaagacacacatatcaacgaaagtgaaaggcacagctgggtacctggaccccgaatacttgaggacataccagctaactccaaagagtgatgtcttctcatttggcatattgcttgtagaaattctttctgctcgcagacccgtagagctgaagcgaaccctgaagagaggatcacaatcagatggactttcaaaaaatttcacgaaggcaacacgagagagatactggacccattgctggnaagatcacgtggacgacgaagtgcttgaaaagctccttaaccctggcttttcaatgcgctgctccgacaccgggacgacggggcgaccaatgaaggagtttggggagcagctgtgggagataaggaaagagtcccgaaagaatgtgtaggaaagggggttgaaaaatcatggaaaaaaattttc

SEQ ID NO: 77860 - DNA, 776 bp, Zea mays
  misc_feature: Ceres CLONE 1562863
  misc_feature: Translation starting site: 505
  misc_feature (409)..(409): n is a, c, t, g, unknown, or other
  misc_feature (671)..(671): n is a, c, t, g, unknown, or other
ctggagctcaccgcggtggcggccgctctagaactagtggatcccccgggctgcaggaattcgtctcacccctagaaaaatccgctgcaggtggtctaggatcgccaaacacctgcctggcaggaccgacaacgaggtcaagaaccactggaactcgtacctcaagaagagggtcgagggcaaggatggacccagcacgccgccgtccgattcagacgactcgcattgcgccaagcccgggggcggaagcacggcgcgggagacgggagacgaccgcccagcggactactccggctcgtcggagccgcgcgagccgtcgtcgtcgtcgtcgcccgacacgagctgcctgacgggcccgcccaaggtcatgttcgtggactggctcgacatggactgcatgggtggtggntgggtggtggcccgccgggcgcggcggcagcggcagcggcacctggtctgggcgctgctgcgggcgtggccagggccagcacgggcgatgatcagatgacgatggatgatgggtcggcgtccggtcgtgccgacgtgtccctgcacggtacgttcggtgacagcggcggcgccggctgctgggagttccacgagagcttcgatcagatgcaggcggccggcttctgcgacctgctctcctccattgggcgagtactacttcngactcgactaggctctcggccctggtttggtgatcggccgttgctcaaaggatttgcgcgtttttttttttttttactttgttaaaatttccaagggatgctttt

SEQ ID NO: 77861 - DNA, 668 bp, Zea mays
  misc_feature: Ceres CLONE 1562864
  misc_feature: SWISSPROT Homolog: EC 1.11.1.7 Peroxidase
  misc_feature (233)..(233): n is a, c, t, g, unknown, or other
tggagctccccgcggtggcggccgctctagaactagtggatcccccgggctgcaggattcgtctccccctagaaaaacaacacgacgatcgtggagatggaccccggcagcttccgcaccttcgacctgagctactaccgcggcgtgctcaagcggcgggcctgttcagtcgacgcgcgctcatcacgacgcgcctcaaggcgactctcacgtgatcacgcgcgccgagtgtnctcagtctcccggctcatgtcagatggcccctccagtcagaccgctccaggcgagatccgggaaccctgggcccctcttaaaaaagaccttgggggggggggaattcttttgccggggaaaaaagggggcccccccctttggggggcccccccaaaaaaaaaaaaaacccccccctgggtgggggggaaacccccccccctttgtgttcttcttctcttttttggggggggggtgttgcccccccccctgggggggggaagaaaaaaaccccgggggggggagggaaaaaacccggggggggtataatttgtggtgggcgcggggtccccccgggggggggtgtgggaaaaaattttgggggggggcccccccccccccccctttttttttttttgagggagaaagaaaagggggtgtttttttttttttttttt

SEQ ID NO: 77862 - DNA, 771 bp, Zea mays
  misc_feature: Ceres CLONE 1562866
  misc_feature: Translation starting site: 165
  misc_feature: SWISSPROT Homolog: EC 3.4.11.21 Aspartyl aminopeptidase
  misc_feature (481)..(481): n is a, c, t, g, unknown, or other
agctccccgcggtggcggccgctctagaactagtggatcccccgggctgcaggaattcgtctcacccctagaaaaagcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgcctttcacgccgttgacgaggcgaagcggcggctgaaggcggcggggttcgtgcagctgtcggagcgggaggagtgggcgggtctcgagcccgggcgcaagtacttcttcacacgcaaccactccactattgtcgcttttgccatcggcgcaaaatacgttgctggcaatgggttccacatcatcggtgcacacactgacagcccttgcctgaagctcaagcctgtctccaaggtaaccaaaggaggttaccttgnaggttggggttcaacgtatggtggtggggggtgtggtacacatggtttgaccgtgatcttactgtagctggtagagtgattatacgggagaagaaggatggcgtggtctcttatgcacacaagctttgtacgggtacaggaaccaattatgcggatacctactttgggctattcacctggacagggactatctcctcagaaggtctcaaggtaacaatcagagtcatcttgttccccgtgggctggctacttgtatcaaggatgaaaatgcaaaaatttgggagcagatt

SEQ ID NO: 77863 - DNA, 770 bp, Zea mays
  misc_feature: Ceres CLONE 1562867
  misc_feature: Translation starting site: 166
  misc_feature: SWISSPROT Homolog: EC 3.4.22.34 Legumain
  misc_feature (41)..(41): n is a, c, t, g, unknown, or other
  misc_feature (59)..(59): n is a, c, t, g, unknown, or other
  misc_feature (411)..(411): n is a, c, t, g, unknown, or other
tccccgcggtggcggccgctctagaactagtggatcccccngggctgcagggaattcgntctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgtcaccaggcggacatctgccatgcataccagatcatgaagaagggcggacttaanggacgagacatcgttgtcttcatgtacgatgacatcgcgcataagcccggaaaatccgagggccgggtgtcatcataaatcatccccagggtgggcgacgtcttatgcttgggtgcccaaaggatacacctggggcagaatgtcaccctcaacaatttctttccctggtctgcttgggcaacaaactggttttaaggggtgggaaccgcaaaggttttggaaacgggccccccaggaaaaaaaaatgggttttcaacagggcccaggaggggccccttgccaaagggacaaaaaggggttttggccccccccccgtcaaaatcccaaagaaaaaattcttgggggggaaaaactttccc

SEQ ID NO: 77864 - DNA, 774 bp, Zea mays
  misc_feature: Ceres CLONE 1562868
  misc_feature: Encodes the peptide sequence at SEQ ID NO. 77865
  misc_feature (600)..(600): n is a, c, t, g, unknown, or other
  misc_feature (667)..(667): n is a, c, t, g, unknown, or other
ctggagctccccgcggtggcggccgctctagaactagtggatcccccgggctgcaggaattcgtctcacccctagaaaaaaaaaaaatcctttcttgtctggggtccagctttgtcacgagccactgcatccaggaggaggaggcggcggcggcgttacctgccctgctccggtcgactggctcccgggagttcggagccgagatctcgccaggccccggtcggcggcggcgttgtgggaaacaggatgggggatctgcccgcgctgcgcctgtggctctgcttgctggcggcaatggcggcggccgcgtcggcgccgtggccggcggatgcgctggggatgaactggggcacgcaggccacgcacccgctgccgcccaagatcgtggcgcagctcctcagggacaacggcatcaagaaggtcaagctgttcgacgccgaccaggacacgctcagcgcgctcgccggcaccggcatcgaggtcatggtcgccatccccaacgtcatgctcgacaccatgacggactacgacaccgcctagggagtgggtggcgccggaacgtgtcccgctacaacttcggacggcggcgtcaccatcaangtacgtggccgtgggcatacgagccgttcccttgcggcctacaacggcacgttcgaacagggtgacngttcccggcgctgcagaacatccagaacgcgctgaaacgaagccgggctcggcgaaccccggtgaaagggcaacgtccccctggaaacgccgaacttgtacattgtc

SEQ ID NO: 77865 - protein, 97 aa, Zea mays
  misc_feature: Ceres CLONE 1562868
  misc_feature: SWISSPROT Homolog: EC 3.2.1.39 Glucan endo-1,3-beta-D-glucosidase
MGDLPALRLWLCLLAAMAAAASAPWPADALGMNWGTQATHPLPPKIVAQLLRDNGIKKVKLFDADQDTLSALAGTGIEVMVAIPNVMLDTMTDYDTA

SEQ ID NO: 77866 - DNA, 728 bp, Zea mays
  misc_feature: Ceres CLONE 1562872
acccgcggtggcggccgctctagaactagtggatcccccgggctgcaggaattcgtctcacccctagaaaaaacgacgccgcgcccgcggaatccatcttctccatctccaactgtgctactgtaggagctgctgcaatcggggagagaaacgcgaccagtttgccggcaccaacacggcctgctgccacatctccggcatcttcttccggtgcgccaaataacccctcctcttttctgactgctagtcagggttggggactgaaaactgtcgctgttagttggggttggggactctttcagtggtaagtccacatgcaggctgcagcaagcaactggacgatggtggcttccaggcagtcagagaacaatgcacaagaagaagcatcaccattgacgactcctaacgccaacatagccaggatcatcccttcgctgcccctcgagaaccaggtggccaccgttcccctctcgacggtacgccaattttttgctgccttgaggaacaatgaaggaaaggcgtccccgggcgttcaattcctgcttccgagccgagaccccacccgacgtggttccttcgcaagcttcccccaaattttggggacccccctgggtttaaggggcccttcccctttcccgaaacctttaaaaggttttccaccgggatttccccgccgtttttaaaaaaaaaaaacaaattcccgtgggggccccatttgtaaacccccc

SEQ ID NO: 77867 - DNA, 747 bp, Zea mays
  misc_feature: Ceres CLONE 1562873
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnaagctggaactccccgcgtggcggccgctctagaacagtggatccccgggctgcaggaattcgtctcacccctagaaaaagagatcaattggctagtacgaatttcttctctcctccaaaccggccaagccaccaaccagcgccccccaccgccgcctttttatttcatccacgctgctcgtgctcgctgccctgcttctcgcggcgatcgtctcggcctctcgggatctagagtggcgccggctctccgcctgtctgtcgtcgctgctcctttccccagatgtcgaacgttctgagagcgcactgaaaagattatgagcagcttcttgggataccatggctgaacacctttcttaagcagaaaatcttgggaaaaattggattccaggtttcagtccccctgaaaaaaaggggaaaaaaattaacccgtttttggggccctcccaaaaaaacacctttccagggaaattttctcgggggggggggggaaaaaaaccccggcggcaaaaggggcccgttttttggggagggaaaaaaaaaaaaaaaaaatctccccccccgagggggtttttgggggcccttttgaaaaaaaaaagaaaatttgggggggggttttttcttttcttgaaggggggggcgcccccacaaaacccccccccttttttgtgga

SEQ ID NO: 77868 - DNA, 812 bp, Zea mays
  misc_feature: Ceres CLONE 1562875
  misc_feature: Encodes the peptide sequence at SEQ ID NO. 77869
tggagctccccgcggtggcggccgctctagaactagtggatcccccgggctgcaggaattcgtctcacccctagaaaaactctgctgacgccgccgccgccgggagccgtaccccgggagagccccccagcccttatcaaaccctaaatcaaaaactatccaaaaaaatccgcaaaaaactagaaaaaatcccaaaaatcaccacttgattggagatggcggcgcaagggcaggcggcggctggatccgcgtccgagtctggcggctcaccggctgcctcagctgctgcagcggcggcggctgcgttcccggcgacttctctctacgtgggtgacctgcacgagagcgttcaggacgcacagctcttcgacgtcttcagccaggtcggcggcgtcgtctccgtgcgcgtctgcagagacatcaactcccgcaagtcgctcggctacgcctacgtcaactacaacaacactagcgacgctgcacgggcacttgaactgcttaacttcactcctatcaatggaaagcctatcaggatcatgtattctaaccgtgaccccagctcgcgcaaaagcggtgcaggaaatatatttattaagaatcttgataagtcaatagacaacaaagctttatatgacacgttctgtgcatttgggaatatcctttcatgtaaaattggcacagacccctcaggagatcagggggaatatggtttttgttcagtttgagatggatgaatccgcctcagtctgccattgataaactcaatggtatggctatcaatgacaaagaaagtgtatgtttggaaccttttt

SEQ ID NO: 77869 - protein, 169 aa, Zea mays
  misc_feature: Ceres CLONE 1562875
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAQGQAAAGSASESGGSPAASAAAAAAAAFPATSLYVGDLHESVQDAQLFDVFSQVGGVVSVRVCRDINSRKSLGYAYVNYNNTSDAARALELLNFTPINGKPIRIMYSNRDPSSRKSGAGNIFIKNLDKSIDNKALYDTFCAFGNILSCKIGTDPSGDQGEYGFCSV

SEQ ID NO: 77870 - DNA, 762 bp, Zea mays
  misc_feature: Ceres CLONE 1562877
  misc_feature: Encodes the peptide sequence at SEQ ID NO. 77871
ctccccgcggtggcggccgctctagaactagtggatcccccgggctgcaggaattcgtctcacccctagaaaaagccacctccgcgcgggcacggcacgtcgtagtaaaaccctagaaaaacagtagcccaccgcgccggcgagccgaagcgagcgcggagctaaggatgccgcggaccaccgtggtagagagctccggctgcccgccgctccgcgccctcaccaccgacatcctcggcctcgtcaaagtcgtcgaggcccacgcgaggccggcgggcgccgccaaggtcgtcgagacgtggggcgcgcctgacgcttcccgtgccatcgttgctgcctccctcgccgatcgtgccgccgaccccgtcttggctgtggcgaggaggaacggcgtggttgagctgctgaatcccttgaatggaagtgctctggctgctgtcaagaccgcggggtcagcgccaaatgacagtggcgctgaaggtgatcccctcgccgcactgcatcttttcgcaagacagacttcggactcgatcttaggcacatttcttgccggcacggagaaagggaaagcttctatcaggtccatcacgaaagaaatgcagattcggggttcggatgttgggccatcagccacattgggatgtgtggcatggggggccaatgtgcaattttgctcagtagatcatggccgaaagctatgtggatattttgggaggaaaaggcttagaaagtgaacttggtgggatatccccattctaggat

SEQ ID NO: 77871 - protein, 188 aa, Zea mays
  misc_feature: Ceres CLONE 1562877
MPRTTVVESSGCPPLRALTTDILGLVKVVEAHARPAGAAKVVETWGAPDASRAIVAASLADRAADPVLAVARRNGVVELLNPLNGSALAAVKTAGSAPNDSGAEGDPLAALHLFARQTSDSILGTFLAGTEKGKASIRSITKEMQIRGSDVGPSATLGCVAWGANVQFCSVDHGRKLCGYFGRKRLRK

SEQ ID NO: 77872 - DNA, 844 bp, Zea mays
  misc_feature: Ceres CLONE 1562879
  misc_feature: Encodes the peptide sequence at SEQ ID NO. 77873
ctggagctccccgcggtggcggccgctctagaactagtggatcccccgggctgcaggaattcgtctcacccctagaaaaagtcctccgttctcctcttcctctctctctcttcactctctctctacggattgcctcacacgcatctcgcgtgcaattcaagcgaaactttctgaatatcaaagtggcatagagctccacttttatggccatccctatgaaggcctctccgggttcctgatatagatgtttccttgttctgaacatgaaaagttctcaggtactccgccgttgatgaactgcctccacacctgcggcgacaagaagacgctgaagaagtggtttttcatcgacaagacagtaggctaaatccagtcccagagaacaaattgaagcaccactccccaccgcacagcagcacagctcttctcttcaccgatcccgatggatatgggcagcggctcgtcacctgtcatcaccgatccgatatcgataagcccaccgctgctgggaggcttgacgtcgaacctgatgccgttctcggtcatgtccggaggctgctcctccagtcctagcatgagcgccagcagcaggcgtaaaatcgaggaggtccttgtcaatggcctgctagacgcgatgaaatcgtcgtcgcctcgcaagaagcacaacctcgccttcggacaggataattcgcccgacgaagatcctgcttacactgcatggctgtcaaaatgcccttctgcgctggcctccttcaagcagatagtagccacgcacagggcaggaaggatcgctgtgttcttggattacgacggcccccctgtcgccgatcgtcgacgatccgaa

SEQ ID NO: 77873 - protein, 134 aa, Zea mays
  misc_feature: Ceres CLONE 1562879
MDMGSGSSPVITDPISISPPLLGGLTSNLMPFSVMSGGCSSSPSMSASSRRKIEEVLVNGLLDAMKSSSPRKKHNLAFGQDNSPDEDPAYTAWLSKCPSALASFKQIVATHRAGRIAVFLDYDGPPVADRRRSE

SEQ ID NO: 77874 - DNA, 1227 bp, Zea mays
  misc_feature: Ceres CLONE 1562882
  misc_feature (106)..(106): n is a, c, t, g, unknown, or other
  misc_feature (845)..(845): n is a, c, t, g, unknown, or other
  misc_feature (960)..(960): n is a, c, t, g, unknown, or other
attagggggccatttcggtttattagattttatttacctttttgcttatctttttaatatttttttttttcaaagctggagctccccgcggtggcggccgttctanaatagtggatcccccgggctgtaggaattcgtctcacccctagaaaaagtcctccgttctcctcttcctctctctctcttctctctctctctacggattgcctcacacgcatctcgcgtgcaattcaagcgaaactttctgaatatcaaagtggcatagagctccacttttatggccatccctatgaaggcctctccgggttcctgatatagatgtttccttgttctgaacatgaaaagttctcaggtactccgccgttgatgaactgcctccacacctgcggctaccagaagacgctgaagaagtggtttttcatcgacaacacagtaggctaaatccagtcccagagaaacagattgaaccaacgttgctcaccgcacagcagcacagctcttctcttcactgattcccgatgggatatggggaggcggctccgtcacgctgtcattcaccatatccgcatattcgagtaagctccacccggctgccttggggaaggctttggaccgtccaaaaacttgaattgcccgtttacatcgaggccatgattcgcgggagaggcttagcttcctttcccaggttccttaaacaattgaaagccgtccccggtgcagtctaggtgccgattagaaaaaatccgcaaggagaagaggataccactttgtgttcaaaaagtgagagctcttgggcgataaaggcacgccgctccgacagtgtgagatatatttgcggtgtacgngtattagtgccgtctgtatggtgttattgaagagaatacaatctaaaacccctatctctcactctcttctcgtgcgacgaggaggtgaatgtaaatatttctggccctccgaaanctagaagaacatatctctgggctttataccgacctgagaagaagggaacttgtgtacaagaaaatggtccacgtttcatttgcagcctattggagcctactcctttccagacccaggaatgagtcaacctccacacccgcactagggggcgaaggagaggaatgcgctcgacggattctcttggggaataccaaaggggaaccctatggtgacgcaaaattaattaataaaactccgaaggagagttgttattggttccccgggggg

SEQ ID NO: 77875 - DNA, 830 bp, Zea mays
  misc_feature: Ceres CLONE 1562884
  misc_feature: Encodes the peptide sequence at SEQ ID NO. 77876
  misc_feature (660)..(660): n is a, c, t, g, unknown, or other
ctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctactcggacgcctttccacgcgtcatcggcttcgacaacatcaagcagacgcagtgcgtcagcttcatcgccctacagcccccgggcagcgactagaacgcgcccgncgggcgccccccgccggctagctagctagctagcctctgcgtgagctagtagctagtgccatgcgtcgtctctgtcgttcggtttttgctcggggcaccgggaacctttgccttgctgggttcctcctttccttttttccctttttttttctccttttcccgggccaggt

SEQ ID NO: 77876 - protein, 170 aa, Zea mays
  misc_feature: Ceres CLONE 1562884
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYSDAFPRVIGFDNIKQTQCVSFIALQPPGSD

SEQ ID NO: 77877 - DNA, 1305 bp, Zea mays
  misc_feature: Ceres CLONE 1562886
  misc_feature: Encodes the peptide sequence at SEQ ID NO. 77878
gtaccagaacaccaaaagccatctgatctccactcctgcgaagagatctagcacatcgccacatccacacacacttccagctcctccaaatatttcgcgccacttgcgggctctgacggtttagctccactccagccatgagctcccgaatggccggagcagcgctcctgcgccacctaggcccccgcctcttcgcggccgagccggtgaccgggctcgcggcgaggggcgtcatgcccgcggccgcgaggattctccccgcacggatgtccagcacggccgcggaggccgccaaagaagctgccgcgccacaacagcgccaaaagcccgaggccgcggccgcggcgccggaggggcaggacaagaaggccgtcgtcagctactggggcatcgagccgcgaaagctcgtgaaggaggacggcacggagtggaggtggttctgcttcaggccatgggacacgtacagagcggacacgtcgatcgacatgaagaagcaccacgagccgaaggcgctgccggacaagctggcctactggctggtcaagtcgctggtcgtgcccaagcagctcttcttccagcgccggcacgccagccacgcgctgctgctggagacggtggcggccgtgccgggcatggtgggcggcatgctgctccacctgcgctcgctgcgccgcttcgagcacagcggcggctggatccgcgcgctgctggaggaggccgagaacgagcggatgcacctcatgacgttcctggaggtggcgcagcccaagtggtgggagcgcgcgctcgtgctcgccgcgcagggcgtttacttcaacgcctacttcgtcgcctacctcgcctcgcccaagttcgcccaccgcttcgtcggctacctcgaggaggaggccgtgcactcctacacggagtacctcaaggacctcgaggccggcatcatcgacaacacgccggcgccggccatcgctatcgactactggcgcctccccgccgatgccaggctcaaggacgtcgtcgccgtcgtgcgcgccgacgaggcgcaccaccgcgatgtcaatcacttcgcatcggacatccattaccagggcatgaagctgagggacacgcctgcgcctctcggctaccactaattagtcaacgtggcctgctagtttagcaatgtcgcctgtattacgggtcggtcatgatgttaattaacctactgccttatttgtgatcaatttgtctgcattatttgtgtataaataaataatatagttgtgccaaaaacaaaaaaacaaaaaaaaaaaagaaaaaaaaacaaaaaaa

SEQ ID NO: 77878 - protein, 329 aa, Zea mays
  misc_feature: Ceres CLONE 1562886
  misc_feature (45)..(327): Pfam Name: AOX Pfam Description: Alternative oxidase
MSSRMAGAALLRHLGPRLFAAEPVTGLAARGVMPAAARILPARMSSTAAEAAKEAAAPQQRQKPEAAAAAPEGQDKKAVVSYWGIEPRKLVKEDGTEWRWFCFRPWDTYRADTSIDMKKHHEPKALPDKLAYWLVKSLVVPKQLFFQRRHASHALLLETVAAVPGMVGGMLLHLRSLRRFEHSGGWIRALLEEAENERMHLMTFLEVAQPKWWERALVLAAQGVYFNAYFVAYLASPKFAHRFVGYLEEEAVHSYTEYLKDLEAGIIDNTPAPAIAIDYWRLPADARLKDVVAVVRADEAHHRDVNHFASDIHYQGMKLRDTPAPLGYH

SEQ ID NO: 77879 - DNA, 954 bp, Zea mays
  misc_feature: Ceres CLONE 1562890
  misc_feature: Encodes the peptide sequence at SEQ ID NO. 77880
  misc_feature (404)..(404): n is a, c, t, g, unknown, or other
cccgcggtggcggccgctctagaactagtggatcccccgggctgcaggaattcgtctcacccctagaaaaaacctccacagctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctggggaaaaagagcgagctgctcctccgcgccaacccggtgcacaagaagatccccgtgctgctgcacgacggccgccccgtctgcaacccccccgtcatcntgcaatacctcgacaaggcgttcccggcggcggcgccggcgctgctccccgccgacccctaacgcgcgcgcgcaggccccgcttctggggcggactacgtccgaccagaaacctgtacaaactggcggcacccgggctggtggaaagcttaaggggggggaccggcccagggcgcaaggccgcccccgcccaaagaatggtccaagaattcctccccgcaaccccttggaagggggcgcgccctccggcggaaacgggggcctcttttctttgcggtggggcgaaagcaccccctcgggccttcggttcaaaaagtccggcccctcggtgccccctttcacaggctctggggtctccccggcctaaagaaagccgcctctctggggggggcccatggcccgggagaaaaaggagggcccctaggagctgggcgcccccggggccaaagggccttgttgccgagagcccccccagtgtgggccaaaaaattccttctcctgggccgaaaagggccccagaattttcgtctgtgggggaacacaacaaaagg

SEQ ID NO: 77880 - protein, 94 aa, Zea mays
  misc_feature: Ceres CLONE 1562890
  misc_feature (7)..(80): Pfam Name: GST_N Pfam Description: Glutathione S-transferase, N-terminal domain
  misc_feature: SWISSPROT Homolog: EC 4.4.1.5 Lactoylglutathione lyase
  misc_feature (75)..(75): Xaa is any aa, unknown, or other
MAEEKKQGLQLLDFWVSPFGQRCRIALDEKGLAYEYLEQDLGKKSELLLRANPVHKKIPVLLHDGRPVCNPPVIXQYLDKAFPAAAPALLPADP

SEQ ID NO: 77881 - DNA, 834 bp, Zea mays
  misc_feature: Ceres CLONE 1562891
  misc_feature: Encodes the peptide sequence at SEQ ID NO. 77882
  misc_feature (670)..(670): n is a, c, t, g, unknown, or other
  misc_feature (674)..(674): n is a, c, t, g, unknown, or other
  misc_feature (827)..(827): n is a, c, t, g, unknown, or other
ggagctccccgcggtggcggccgctctagaactagtggatcccccgggctgcaggaattcgtctcacccctagaaaaagctcgctccctccctccctccctcccgcgcggatcacagaagggctcacggtcacggccggcctcccaattcgcaacctcgcctccgcctctcctcctaccccctccgaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgcgggccagggccaggctacggaagccgcggcgagggcgtccgcgagccggtgctccagctgccggaagcgcgtggggctgacngggnttcggtgccgctgcggcgagctcttctgcggcgcgcaccggtactcggaacggcacggctgcagctacgactacaggggcgccgccggggacgccatcgctcgggaggaaccggtggtgcgcgcggccaagggtcgttaagttctgatccacngacggaa

SEQ ID NO: 77882 - protein, 161 aa, Zea mays
  misc_feature: Ceres CLONE 1562891
  misc_feature (104)..(144): Pfam Name: zf-AN1 Pfam Description: AN1-like Zinc finger
  misc_feature (116)..(116): Xaa is any aa, unknown, or other
MAQRDKKEEPTELRAPEITLCANNCGFPGNPATQNLCQSCFSASRSPSSPTSSSSSLASAASQPRPAALVVDAAAVEALAAPAAAAAGQGQATEAAARASASRCSSCRKRVGLTGXRCRCGELFCGAHRYSERHGCSYDYRGAAGDAIAREEPVVRAAKGR

SEQ ID NO: 77883 - DNA, 858 bp, Zea mays
  misc_feature: Ceres CLONE 1562893
  misc_feature: Encodes the peptide sequence at SEQ ID NO. 77884
  misc_feature (754)..(754): n is a, c, t, g, unknown, or other
  misc_feature (813)..(813): n is a, c, t, g, unknown, or other
ctccccgcggtggcggccgctctagaactagtggatcccccgggctgcaggaattcgtctcacccctagaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggctggcaaggtgcctgccgagccatgctgtaccctcatcaaaggccttgcggacttcgaggccgccgtctgcctctgcacggccatcaaggccaacgtgctcggcgtcgtcatcgatgtccccatcaagctcagcgccctcgtcaactactgtggcaagtgcgtgcccaagggctacttgtgcgcgtaagcagcttccggcggtcacacgctcgtagctgttcacgtacgagattacatatgcacgcaccctgcatggcacgaatgcatgcattgtgtctgctgatatatctctcctgtctcagttgcattgtgcacctttcggttctacaaaactagaatcattccagccaaatacttgtcagttcaattcgcatgtattgtctctttgtgaatcccnattttttttgtatttgggcattttctcggaagagtccgacacttcttcagggaaaaggnctagtgtgagagtcattgttgtgtatgtaaaaccaaaccttgacc

SEQ ID NO: 77884 - protein, 133 aa, Zea mays
  misc_feature: Ceres CLONE 1562893
  misc_feature (51)..(132): Pfam Name: Tryp_alpha_amyl Pfam Description: Protease inhibitor/seed storage/LTP family
MASKAVLFLALNLLFFTVANACGNCPTPTPPVEPPPPPPAATPPPSSSGKCPLNALKFGVCADVLGLVKGEAGKVPAEPCCTLIKGLADFEAAVCLCTAIKANVLGVVIDVPIKLSALVNYCGKCVPKGYLCA

SEQ ID NO: 77885 - DNA, 891 bp, Zea mays
  misc_feature: Ceres CLONE 1562894
  misc_feature: Encodes the peptide sequence at SEQ ID NO. 77886
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (430)..(430): n is a, c, t, g, unknown, or other
  misc_feature (449)..(449): n is a, c, t, g, unknown, or other
  misc_feature (830)..(830): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctggagctcaccgcggtggcggccgctctagaactagtggatcccccgggctgcaggaattcgtctcacccctagaaaaagacgcccccatttcgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatngtgctccaagtgccacaanggagatgataatgaagcaggagcaggcccagttggctgccctcctcatcgatagcattgtcaatggcggtgataatgggaaaggacctgcaattgctgcaactgtaggggggggcagttcctccagtcgagggagaaaactatcgcccgggaacctattgctggtcccttgaaacccaccaagggttgctgcttgtttttcccgaagggccaagggaggggcccaaacccggggggcccaaacctgtaagaaaaacccgttttgggggtttaaccgggttttttaaaacggccccaaagggggggaaaaaacccattattttttttttaaagaaacccccccttttcccccgccgaaaaaaaacccccggcgcggggcccntttttccaaaaattttatataaaaaaaccgccccgcctttggggggggcggcacccccttc

SEQ ID NO: 77886 - protein, 40 aa, Zea mays
  misc_feature: Ceres CLONE 1562894
  misc_feature (32)..(32): Xaa is any aa, unknown, or other
  misc_feature (39)..(39): Xaa is any aa, unknown, or other
MEHKEAGCQQPEGPILCINNCGFFGSAATMNXVLQVPQXR

SEQ ID NO: 77887 - DNA, 810 bp, Zea mays
  misc_feature: Ceres CLONE 1562895
  misc_feature: Encodes the peptide sequence at SEQ ID NO. 77888
  misc_feature (467)..(467): n is a, c, t, g, unknown, or other
  misc_feature (483)..(483): n is a, c, t, g, unknown, or other
  misc_feature (486)..(486): n is a, c, t, g, unknown, or other
  misc_feature (496)..(496): n is a, c, t, g, unknown, or other
ctccccgcggtggcggccgctctagaactagtggatcccccgggctgcaggaattcgtctcacccctagaaaaattcgaacaccggcgaggttcaaaatgtgaagctcatccgcgacaagaattcaggacagcttcagggctatggttttgttgaatttacaagccgtgcagctgcagagcgagttcttcagacatataatggacaaatgatgccaaatgttgacttgacatttcggctgaactgggccagtgctggtgaaaagcgtgatgatactcctgactatactattttcgttggtgatttggctgcagatgttacagattacttgttacaagagacattcagggttcattatccctcggtgaagggtgcaaaagttgtgactgataaattgacaatgcgtaccaagggttatggatttgtgaaatttggcgatcctacagagcaagctcgtgcaatgactgnaatgaatggaatgccnttngtctccaggnctatgcgtattggtcctgcagcaagtagaaaaatgcagggtgtgttgttcaagagagaggataccaacaggctctatccgtataggggtcttggaactgacctgagctgcaatgcattttctggttaatgggtggcctcatttagaaccaaatctcaaggagtcagtcttgagatgatcttaacataccccttaattggtgggtgggcttgacccaagtcccttgaaaatgtctaaaacaagctttttccctttaggcaaatcatcccggttaaaatccgtttgggaaaaaaatggggtttttcccatttgtta

SEQ ID NO: 77888 - protein, 138 aa, Zea mays
  misc_feature: Ceres CLONE 1562895
  misc_feature (28)..(100): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (87)..(87): Xaa is any aa, unknown, or other
  misc_feature (93)..(93): Xaa is any aa, unknown, or other
  misc_feature (97)..(97): Xaa is any aa, unknown, or other
MMPNVDLTFRLNWASAGEKRDDTPDYTIFVGDLAADVTDYLLQETFRVHYPSVKGAKVVTDKLTMRTKGYGFVKFGDPTEQARAMTXMNGMPXVSRXMRIGPAASRKMQGVLFKREDTNRLYPYRGLGTDLSCNAFSG

SEQ ID NO: 77889 - DNA, 818 bp, Zea mays
  misc_feature: Ceres CLONE 1562896
  misc_feature: Encodes the peptide sequence at SEQ ID NO. 77890
  misc_feature (502)..(502): n is a, c, t, g, unknown, or other
  misc_feature (507)..(507): n is a, c, t, g, unknown, or other
  misc_feature (692)..(692): n is a, c, t, g, unknown, or other
ctggagctcaccgcggtggcggccgctcctagaactagtggatcccccgggctgcaggaattcgtctcacccctagaaaaatcggcactgtgtagataagagtctttccagaatttcatggacctactggttcaagaaagtattgtactaccaagttgctctagtctatactctgactagactggtgactaatgtttcacaggcatttcttgctttctatgtaatcaatgatttagaaatgagtcaatcctccaaagcattggtacctgctattatctacatctgcagtttgatagtatctgtaatattacaggagactagatggtcaagttggcgtcttaagctttacttttcagctggagcagtgctttggatattgtcaggtcttggaattgtttttctaccgagcagaatgcacaacctcatgtatgctatttcaatcataataggagctgcgaatgcgcttatgacagtgacaagtattagcatggaaggtgttttnagtangagaagatctaaatggttgtgccttttgtgtatggctcattaagttttgttgacaaagtttcatggtggagtagttctgtatatttcttgagtcctatcaaggaagtacagagatcagatcaaatttaggaacagcatttggctattcaattacaagactttggcttgggcttagttcccagctngtctgttcgctgcttttcatcaatagtgggcttataccatggaccctcccttgaccctgatactcggcgggaagaccttttggtggaagcccctttctaggataaactttccctggtgaaccctgt

SEQ ID NO: 77890 - protein, 32 aa, Zea mays
  misc_feature: Ceres CLONE 1562896
LELTAVAAAPRTSGSPGLQEFVSPLEKSALCR

SEQ ID NO: 77891 - DNA, 995 bp, Zea mays
  misc_feature: Ceres CLONE 1562897
  misc_feature: Encodes the peptide sequence at SEQ ID NO. 77892
  misc_feature (377)..(377): n is a, c, t, g, unknown, or other
  misc_feature (384)..(384): n is a, c, t, g, unknown, or other
tctgaactagtggatcccccgggctgcaggaattcgtctcacccctagaaaaattcgaacaccggcgaggttcaaaatgtgaagctcatccgcgacaagaattcaagacagcttcagggctatggttttgttgaatttacaagccgtgcagctgcagagcgagttcttcacacatataatggacaaatgatgccaaatgttgacttgacatttcggctgaactgggccactgctggtgaaaagcgtgatgatactcctgactatactattttcgttggtgatttggctgcagatgttacagattacttgttacaagacacattcagggttcattatccctcagtgaagggtgcaaaagttgtgactttttaacccancccaccnaccaagggttatggatttgtgaaatttggcgatcctacaaagcaagctcgtgcaatgactgaaatgaatggaatgccttgttctttccaggacttaattcataatgggtcctggcagcatattacaaaaaaatgcaaagtgggtgttggttccaatagagaaggattacccaccggggctctaattccgttatagggggatctttgggaaactgaacacttcaccctggccaaatggcaatattccttgggtaataaacgggttgtgggcccctctcaattttatctaaagccaaagattcctttcagagggggacattaaattctttgaagaaatgggtttccttaaccaaattaccacctttctctttttgtttgggtaggggcttttggaccccccaaatggttcactgtgaaaatttttctctaagaaaaagggatttttttttcctttgttgttcaaaaagacttccccagtttaaaagatatcccttgttttggaaaaaaaaggggggtcttggttgtaagttttgtatacctaaacttttttccctcaagcagggcactgttttatggttttagggggtgtctgttattttgttccagaaaatt

SEQ ID NO: 77892 - protein, 61 aa, Zea mays
  misc_feature: Ceres CLONE 1562897
MMPNVDLTFRLNWATAGEKRDDTPDYTIFVGDLAADVTDYLLQDTFRVHYPSVKGAKVVTF

SEQ ID NO: 77893 - DNA, 822 bp, Zea mays
  misc_feature: Ceres CLONE 1562898
  misc_feature (571)..(571): n is a, c, t, g, unknown, or other
  misc_feature (793)..(793): n is a, c, t, g, unknown, or other
ggagctccccgcggtggcggccgctctagaactagtggatcccccgggctgcaggaattcgtctcacccctagaaaaagggttggaaccctaaccgatcgtcatttcttcctggcggcggcgcccaaggccatgacggcgcgacctcacgttgatgcgcttcggccaggcgtggcgtcagcgtgtggccagactcgtcgtcgtcgcggcccccacggcgttgctccggctccttccccggcggcggcgcacggccccaagcccaagcttcaccggcaggcacgcaggctcggccggtgggcaccggagcgaccccagcggcacggcgtaggccggcggcccggcacatgagcgcggccctcgcgcgggcgcacagccgatggcgcggccgcggctcggcggcgcgggcacagcctcgcgcgcggcactcagtcagcgtcccccgcggcggtgtgggcggcgaagcccctcggtgcacgcgggcgagcctccggcgggtggcgcgtggccctccggcccctcggtagctcggtgcagactggcgcgggcccgtggcactcacggcggcacangcgtcccggcgcggcagcggccctgcgtgctgcctggcgcggtcaaggcgcagccacagccgcgacaaggacgtggcctggccggcgcgctgcccccgacctcggcagcaggctagccccctccggtgcgccggcgcagcccttcgacagcgcaggtgccgcgtccccagccccagcacgacgctgggtgctgcggatccagccccgaccccggcgagaaangggggggtggggggtcccggccccctgcc

SEQ ID NO: 77894 - DNA, 835 bp, Zea mays
  misc_feature: Ceres CLONE 1562899
  misc_feature: Encodes the peptide sequence at SEQ ID NO. 77895
  misc_feature (539)..(539): n is a, c, t, g, unknown, or other
  misc_feature (540)..(540): n is a, c, t, g, unknown, or other
  misc_feature (580)..(580): n is a, c, t, g, unknown, or other
  misc_feature (581)..(581): n is a, c, t, g, unknown, or other
  misc_feature (770)..(770): n is a, c, t, g, unknown, or other
ccccgcggtggcggccgctctagaactagtggatcccccgggctgcaggaattcgtctcacccctagaaaaaaaaaaaaaggtccagtccaggtccgtaccagctgcgacgacgcttgtcagtaggtaggttgagctagctgcttgttgatcactgctatatatacgggtgccatggatccatgccttctccatcctcaagacatcagctagctagccttccctacagcaactgcttacatacaacacttccatcttcccgagctcgtattcgatcaattcccaattcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagctgctcgagcgcgtcaagaaagtgtgctccgactgctaccgcctccgggaggccgggttcaaggcgtcggagccggtgcgcacgctggaggcgctcgtccacnncgaacgcgcggcgaggttgtggcgcccgtggaccacctgnnaactggagacatcttctacatccacgaccgatgccagtggccgtccgacccgcccgcgtttcaaggagaccatgcgcgaagtaccgcgcctaagctgaggaaactcccccgaccccgtccttgaaggcattggacgaaaacctcggcctcccccagggggacccttaaaggggccccttttcccaccgngggccgggaaagaaaccctttctttggggacccagagggtaaccccattaacccgccggggccca

SEQ ID NO: 77895 - protein, 123 aa, Zea mays
  misc_feature: Ceres CLONE 1562899
  misc_feature: SWISSPROT Homolog: EC 1.14.17.4 Aminocyclopropanecarboxylate oxidase
  misc_feature (78)..(78): Xaa is any aa, unknown, or other
  misc_feature (91)..(91): Xaa is any aa, unknown, or other
  misc_feature (92)..(92): Xaa is any aa, unknown, or other
MVVPVIDFSKLDGAERAETLAQIANGCEEWGFFQLVNHGIPLELLERVKKVCSDCYRLREAGFKASEPVRTLEALVHXERAARLWRPWTTXXLETSSTSTTDASGRPTRPRFKETMREVPRLS

SEQ ID NO: 77896 - DNA, 820 bp, Zea mays
  misc_feature: Ceres CLONE 1562900
  misc_feature: Translation starting site: 158
  misc_feature: SWISSPROT Homolog: EC 1.11.1.11 L-ascorbate peroxidase
  misc_feature (491)..(491): n is a, c, t, g, unknown, or other
  misc_feature (720)..(720): n is a, c, t, g, unknown, or other
  misc_feature (722)..(722): n is a, c, t, g, unknown, or other
tggagctccccgcggtggcggccgctctagtctagtggatcccccgggctgcaggaattcgtctcacccctagaaaaagcagatcttgtgaccctccctcagccgcgtcgcgtcgcatcctacgatccaaagctctctctggtcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccactcgcgggagttgtggccgtggaggtcaccggtgggcctgnagattcccttccaccccggtagggagggacaagcctcagcccccacctgagggccgccttcctgatgccactaagggttctgaccacctggaggcaagtttttggcaagcagatgggcttgagcgatcaggacattgttgcccctctctggtggcccacccttgggaaggtgcacaaagagcggtcttggtttcgagggggcctggactacaaaccctttggtctttgncnactctgtactcaaggaacttctgagtgggggattaaggaggccttcttccagctccaagtgacaaaagcctgctgaatgaccctgtccttcgccctct

SEQ ID NO: 77897 - DNA, 805 bp, Zea mays
  misc_feature: Ceres CLONE 1562901
  misc_feature: Encodes the peptide sequence at SEQ ID NO. 77898
  misc_feature (576)..(576): n is a, c, t, g, unknown, or other
  misc_feature (593)..(593): n is a, c, t, g, unknown, or other
ggagctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcnggctgacaggcgtgtcngtgtgggaggcgctggtgctggagatcgtgatgaccttcgggctggtgtacacagtgtacgccacgggcggtggatcccgaagaagggcagccctgggcaccatcgcccccattgccatcgggctcatcgtgggggcaacatcccgggggggggcggggccttcgaacggcgcgtccatggaacccccgccgtggtctttcggcccccccct

SEQ ID NO: 77898 - protein, 209 aa, Zea mays
  misc_feature: Ceres CLONE 1562901
  misc_feature (13)..(208): Pfam Name: MIP Pfam Description: Major intrinsic protein
  misc_feature (134)..(134): Xaa is any aa, unknown, or other
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTGGQATGTFXLTGVSVWEALVLEIVMTFGLVYTVYATGGGSRRRAALGTIAPIAIGLIVGATSRGGAGPSNGASMEPPPWSFGPP

SEQ ID NO: 77899 - DNA, 799 bp, Zea mays
  misc_feature: Ceres CLONE 1562902
  misc_feature: Encodes the peptide sequence at SEQ ID NO. 77900
ctcaccgcggtggcggccgctctagaactagtggatcccccgggctgcaggaattcgtctcacccctagaaaaaactggcactgccattcccgtttcctcgctcgaacaccaccgaagagagagacagagcgagagaggatggcgtccctggcgcagcacgtcgcgggcctaccgtgcccccctctatccggtgcgtcgcgccgtcgccccgcggcgcagaggcggcctccgtcggcgcttgtgtgcggtacctatgcgctgaccaaggacgagcgggagcgggagcggatgcgccaggtgttcgacgacgcctccgagcgctgccgcaccgcgcccatggagggcgtcgccttctcccccgacgacctcgacaccgccgtcgagtccaccgacatagacacggagatcggctcgctcattaaaggaacagtatttatgactacctcaaatggtgcatatatcgacatccaatccaagtctactgctttttttgcccttagatgaagcatgccctcctggatatcgattatggtgaagaggctgggcattcgtcccggggttagtagaagaattcctggaaaatggatggagaccccggggggaggaaactttggatcctaaattttccaagcaatttcacaaaaaattgcctggggaaaaaggccccggcactttccggccccaaaaattgcctttccccggggaaaaaatatatggggggagaaaaaaagaggggggggggcccccctgggggaaggggccaaaagggtttcccctccccttttttcccaagaggat

SEQ ID NO: 77900 - protein, 121 aa, Zea mays
  misc_feature: Ceres CLONE 1562902
MASLAQHVAGLPCPPLSGASRRRPAAQRRPPSALVCGTYALTKDERERERMRQVFDDASERCRTAPMEGVAFSPDDLDTAVESTDIDTEIGSLIKGTVFMTTSNGAYIDIQSKSTAFFALR

SEQ ID NO: 77901 - DNA, 820 bp, Zea mays
  misc_feature: Ceres CLONE 1562903
ggagctccccgcggtggcggccgctctagaactagtggatcccccgggctgcaggaattcgtctcacccctagaaaaatgactgaattgcacaattatgcgacaacaacgacataagccttttattcccaagcaagttcggggtaggatagagttgaaacccaacgagatgtcaccgaaaagagaaagccagagaaacgggaggggaaaaagcttttgagagcactaaaagggaaaaagcctaatcacggctcgggcacatggatagattttttctaagcagtactatccgaacatagatctattgggatatttcattccttcgagacgctttatgattgtctcatctcgtgccaaggtagactaggaatctacctctcttcgaattattgtcccgtcttataatccccaatgggatgactccttcctcccagtccgttattgaatatggtcatttgctgcaagggggcgaagatttaattttgagaagctattcctgcctggggtgattattgatccggacaaaagggtagtccctttgtttgcaagacaattgagacccaaggttctgaaactaaactgggctttctcatgggggaaaatggtctttaaccggggattttcagacaaaaaagaaaaaaggttcctctccttgggaaaaataaaagggttttccacaccccccgggagttgccccccatttttgggggaaaattgggggcggttaaacctaaaaaaaggggggctctccctgtttgggggggttgaaaaaaaaactctcctaaaaaaacccttgggaggggagggggagaacacttttt

SEQ ID NO: 77902 - DNA, 791 bp, Zea mays
  misc_feature: Ceres CLONE 1562905
  misc_feature: Encodes the peptide sequence at SEQ ID NO. 77903
ctcaccgcggtggcggccgctctagaactagtggatcccccgggctgcaggaattcgtctcacccctagaaaaagtgtcacttttactgatccgttgttgcgcataaagctgcccgcgtggacagccccctcctcctgccccgtgacctccactgcgcgcgcgggcaccaatggcggccgcgtcgctcaagttcgcctcccccaaacccttggcctccgcaccgtccgcgctcctttgcgggcgtagcgcccaagcgcggcccctcccagcaagtcgcctccctccgcctacccgcgtcgccgtgcagccccccgccgcgccggtcgcgacgcgcatcggctcctttgacaaggtgctggaggcgctgatcggcgggaccgacttctccgaggaggatgcggaggcgacgctgaggctgctgctggacgagaaggacgaggcgcgcatctccgccttcctcgtcctcctcagggccaagggcgagaccttcgaagagatcgtggggcttgcgaaggcgatgttgagctgctgcatccgagtcgatggtctggacgacgccgtcgacattgtcgggacaggcggcgacggcgcagacaccgtcaacatctccaccgggtccaccatcctcgccgccgcggccgggcgccaaggtcgctaagcaaaggagcagggctagcttcgtcggcgtgcggaaacgccgatgtgctggaaggcgctccgggtcaaacatcgagcttgaaccccgagggtattaaacgatgtgtcaatgaagggggggggttgggaaatt

SEQ ID NO: 77903 - protein, 162 aa, Zea mays
  misc_feature: Ceres CLONE 1562905
  misc_feature (58)..(122): Pfam Name: Glycos_trans_3N Pfam Description: Glycosyl transferase family, helical bundle domain
  misc_feature: SWISSPROT Homolog: EC 2.4.2.18 Anthranilate phosphoribosyltransferase
MAAASLKFASPKPLASAPSALLCGRSAQARPLPASRLPPPTRVAVQPPAAPVATRIGSFDKVLEALIGGTDFSEEDAEATLRLLLDEKDEARISAFLVLLRAKGETFEEIVGLAKAMLSCCIRVDGLDDAVDIVGTGGDGADTVNISTGSTILAAAAGRQGR

SEQ ID NO: 77904 - DNA, 823 bp, Zea mays
  misc_feature: Ceres CLONE 1562906
  misc_feature: Encodes the peptide sequence at SEQ ID NO. 77905
  misc_feature (701)..(701): n is a, c, t, g, unknown, or other
  misc_feature (720)..(720): n is a, c, t, g, unknown, or other
  misc_feature (777)..(777): n is a, c, t, g, unknown, or other
  misc_feature (778)..(778): n is a, c, t, g, unknown, or other
  misc_feature (783)..(783): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (813)..(813): n is a, c, t, g, unknown, or other
  misc_feature (814)..(814): n is a, c, t, g, unknown, or other
tggagctccccgcggtggcggccgcctctagaactagtggaacccccgggctgcaggaattcgtctcacccctagaaaaaacgcagcacgctgtcgtcttgcggctctcgcccgtctccccacggagccccgaaaccaaagccgagccgagagcccgagccccgaccagcccgacctcatcttctcctcgtcggcttcacccctccaccacctccatggggtcgtcggaggccgacgaggaccagctcctcaagagcttcctcgcggaggtcagcgaggccgagcgggacaacgaagtgctcaggatacttggttgcttcaagttaaaccccttcgagcatcttaagttgtcttttgattcatcaccagatgaggtgaaaaagcaatataggaagttgtcattgctggtccatcctgataaatgcaagcatcctcaggcacaagaagcttttgcagctctggcgaaagcacaacagctcctgcttgatccacaggaaagaggctacattcttgaccaagttactgctgcaaaagaagaattgagggcaaagcggaaaaaggagctgaagaaagacagtgcgtccaagataaaatctcttgtagatgagggaaaaatatgaagagcagtttgaacgaatcggatggatttcagcagcaattaataatttaaagtacgtgaaaattttgacccgacaaagaantgggcgtaggagaaaaatngcaaatgaggatatccagaagaaagaaggaagaactttagaaaggatgaaggagaannacaanagagtgaagnnnnnnnnnnnnnnnnnnnannacccttaaa

SEQ ID NO: 77905 - protein, 134 aa, Zea mays
  misc_feature: Ceres CLONE 1562906
  misc_feature (38)..(98): Pfam Name: DnaJ Pfam Description: DnaJ domain
MGSSEADEDQLLKSFLAEVSEAERDNEVLRILGCFKLNPFEHLKLSFDSSPDEVKKQYRKLSLLVHPDKCKHPQAQEAFAALAKAQQLLLDPQERGYILDQVTAAKEELRAKRKKELKKDSASKIKSLVDEGKI

SEQ ID NO: 77906 - DNA, 814 bp, Zea mays
  misc_feature: Ceres CLONE 1562908
  misc_feature: Translation starting site: 504
  misc_feature (734)..(734): n is a, c, t, g, unknown, or other
  misc_feature (758)..(758): n is a, c, t, g, unknown, or other
  misc_feature (790)..(790): n is a, c, t, g, unknown, or other
ctggagctccccgcggtggcggccgctctagaacagtggatcccccgggctgcaggaattcgtctcacccctagaaaaatgctcatcctaggtggagctttgcgcgtgtgccatgtgttgctggtggtgctgctgccgctgcctggagtgcatccataacatcgtccctcccctcagcagccttcccttcctccgcttctccggcccagctctcccaggtggaggtggaggtggagcagcggcggcggtggtggcttctccacctgtagtctccatggcgtccatctcggtccccagcccggcccccttccgcgaccgaagacgccgaaaacatcaggaaagcagtgcaaggatggggcacggacgagaaggcgctgatcgagatactgggccaccggacggcggcgcagcgcgcggagatcgccgtggcctacgagggcctctacaacgaacccatcatcgacagactccactccgagctctccggcgacttccggagcgcgatgatgctgtggacggtggacccggcggcgcgtgacgccaagctcgcccacaaggccatgaagaagcgggcgagcggtacgtgtgggtgctcatcgaggtcgcctgcgcgtccgcgccggaacacctcgtcgccgtcaggtaggcctaccgcgatgcctactccgcctccctgggaggaagaacgtcgccgcgtgcccgctctacaaggaccgctccctcagcagttcttnggtgcgctcgtgagctcgtaccgntactccggcgagctcgtccatgacaactggcnaaggcggaaggccgcgactgcacc

SEQ ID NO: 77907 - DNA, 834 bp, Zea mays
  misc_feature: Ceres CLONE 1562910
  misc_feature: Encodes the peptide sequence at SEQ ID NO. 77908
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (791)..(791): n is a, c, t, g, unknown, or other
  misc_feature (792)..(792): n is a, c, t, g, unknown, or other
  misc_feature (811)..(811): n is a, c, t, g, unknown, or other
ctccccgcggtggcggccgctctagaactagtggatcccccgggctgcaggaattcgtctcacccctagaaaaaacgagccacagcccacaggtaagcgtcgtcggttcacgccgcgttcccatactctgcactacacttcattacagttacagtcacggcgcgtccgccgccttgcatataccggttctcaccgcctgtccgcgctgcccgtcgccagcaggctagctctctagccagtccagtccacgcagcgcagggatggcgtcgttcgccgtggcaacggccccgtcgctagcggccccggcagccaagaggaggcccgccgccggcgtcacgtacgtggagggcatgaaagcctacagcggcctcaaggggctcaacaaggtgaaccatgctcggggtgcgcaagaccgccgactactccttcgccaaggtcgtggcatcgctcagcctcgcgggcaggaagcggcgcggaggagcgttcggcgcccagatgaggttttacgcttacacagtgggtgacggtttgcaccatcgtgagcgagcgcagcgaagccaacacaactgccggcgggacaagtgtccccatgagacgagatccatggcggagcgcccggaagaccgtctccctccgtgctgtttgcttcggcgcgcgccggggaggggaaaatggcagcagtgagctcggtctctattcttgccctcgcgtcgctgagggctctcccgttgagctgctgctagatgtgagnnnnnnnnnnnnnnnnnnnnnnnnnnnnnnnnggnnnntcnncccccccccccccccccantaattatggctctgtggccccac

SEQ ID NO: 77908 - protein, 87 aa, Zea mays
  misc_feature: Ceres CLONE 1562910
MASFAVATAPSLAAPAAKRRPAAGVTYVEGMKAYSGLKGLNKVNHARGAQDRRLLLRQGRGIAQPRGQEAARRSVRRPDEVLRLHSG

SEQ ID NO: 77909 - DNA, 871 bp, Zea mays
  misc_feature: Ceres CLONE 1562911
  misc_feature: Encodes the peptide sequence at SEQ ID NO. 77910
  misc_feature (629)..(629): n is a, c, t, g, unknown, or other
  misc_feature (647)..(647): n is a, c, t, g, unknown, or other
  misc_feature (741)..(741): n is a, c, t, g, unknown, or other
  misc_feature (778)..(778): n is a, c, t, g, unknown, or other
agctccccgcggtggcggccgctctagaactagtggatcccccgggctgcaggaattcgtctcacccctagaaaaagctagtgaaagaaggatatatattcgtgtcctccgaattagtccttcctgcagtgtcctcgccgacagggaaagccgtgttgcaagaaggggaattccgctgcgagatccgtgaacggttcagagatggcacagacggtgttcaccccctctttggaagcgatgaagcatgtcaaggcagagaacggagtcattctcaccaagcccttccttgatgtctgcaagcaaatattgcctgtcctcgataaatttggagctgctatggcaattgtaaagagtgatatcggcggcaatatcacaagactggaaaacaagtatacttcagaaccatcaaagtatgaacacttgtacagcatgattcaggaagaagttcaaaacaagaccgcaaaaggttcctcaagctgcacaaatgggcttctgtggctgacgagggccatggacttccttgttgagttgtttcgtaacctgcttgagcatccagactgggcccatgagtcatcttgcactgattcatacaccaagactttgaggaaaattcatggctggcttgccangtctagttttacggtggncatgaagcttgctccctatagagagaaatttatggaggtcattagtggaaccggtgacatccatgcagatattgagaaattttgcacgaccttnctctcctttttctcaaagaaaaccacactttctggcnagcgtcgggtcttgatgatcttgagggcttcatagatccatcttccaggctgattacaaacaaaataagcatgtcttacggaaccttcaagtt

SEQ ID NO: 77910 - protein, 203 aa, Zea mays
  misc_feature: Ceres CLONE 1562911
  misc_feature (10)..(192): Pfam Name: GLTP Pfam Description: Glycolipid transfer protein (GLTP)
  misc_feature (143)..(143): Xaa is any aa, unknown, or other
  misc_feature (149)..(149): Xaa is any aa, unknown, or other
  misc_feature (180)..(180): Xaa is any aa, unknown, or other
  misc_feature (193)..(193): Xaa is any aa, unknown, or other
MAQTVFTPSLEAMKHVKAENGVILTKPFLDVCKQILPVLDKFGAAMAIVKSDIGGNITRLENKYTSEPSKYEHLYSMIQEEVQNKTAKGSSSCTNGLLWLTRAMDFLVELFRNLLEHPDWAHESSCTDSYTKTLRKIHGWLAXSSFTVXMKLAPYREKFMEVISGTGDIHADIEKFCTTXLSFFSKKTTLSGXRRVLMILRAS

SEQ ID NO: 77911 - DNA, 814 bp, Zea mays
  misc_feature: Ceres CLONE 1562912
  misc_feature: Encodes the peptide sequence at SEQ ID NO. 77912
  misc_feature (628)..(628): n is a, c, t, g, unknown, or other
  misc_feature (638)..(638): n is a, c, t, g, unknown, or other
  misc_feature (646)..(646): n is a, c, t, g, unknown, or other
  misc_feature (779)..(779): n is a, c, t, g, unknown, or other
ctggagctcaccgcggtggcggccgctctagaactagtggatcccccgggctgcaggaattcgtctcacccctagaaaaagtctctctaggttttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctgggaggatgctgtccngcagtgtccnagatgganggggtctgacttggggagcatcaaagccttgtgccctgttggatacggcatcaagaagattgactatcatgttgacatttgggcggaacgatcctggtgtcccatcgacactcctaattggaggaccaccttnacggcagaccccattcaatgagttaacgtccagat

SEQ ID NO: 77912 - protein, 162 aa, Zea mays
  misc_feature: Ceres CLONE 1562912
  misc_feature (158)..(158): Xaa is any aa, unknown, or other
  misc_feature (160)..(160): Xaa is any aa, unknown, or other
MAVFSDLHTADGLKSLEAHLAGKTYVSGDSITKDDIKVFAAVPSKPGAEFPNAARWYETVSAAVASRFPGKAVGVNLPAGSAPAAAAPADEAEDDDDLDLFGDETEEDKKAADERAAAAKASSKKKESGKSSVLMDVKPWDDETDMKKLGGCCPAVSXMXGV

SEQ ID NO: 77913 - DNA, 773 bp, Zea mays
  misc_feature: Ceres CLONE 1562914
  misc_feature: Encodes the peptide sequence at SEQ ID NO. 77914
ggagctccccgcggtggcggccgctctagaatagtggatcccccgggctgcaggaattcgtctcacccctagaaaaaggccgttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcggggtggtggtcgccaccgtcgtcgggttcctcggttccgcgtttggcaccgtcggcggcgtcggcggaagcgggatcttcgtgcccatgctcaacctcgtcgtcggcttcgacaccaaatccgccgccgcgctctcaaatgcatgatcatggggggctcggcgtcatccgtttggtacaacctcaggtgtcgcacccgacaaaggagcgcccgtcatcgactacaagctcgcgttgctcctcccagccaagcttatgcctcgcataaacatcggcgtagaagtcagcgtcatctttccatactgggctaaccactggcctcattataatcctcctcctaggcaacctcgtccagaatcctcctacaagggattctgaaggggg

SEQ ID NO: 77914 - protein, 70 aa, Zea mays
  misc_feature: Ceres CLONE 1562914
MARASACPRAHRASGPTSRSTGGVVVATVVGFLGSAFGTVGGVGGSGIFVPMLNLVVGFDTKSAAALSNA

SEQ ID NO: 77915 - DNA, 814 bp, Zea mays
  misc_feature: Ceres CLONE 1562915
  misc_feature: Encodes the peptide sequence at SEQ ID NO. 77916
  misc_feature (520)..(520): n is a, c, t, g, unknown, or other
  misc_feature (534)..(534): n is a, c, t, g, unknown, or other
  misc_feature (585)..(585): n is a, c, t, g, unknown, or other
ggagctccccgcggtggcggccgctctagaactagtggatcccccgggctgcaggaattcgtctcacccctagaaaaactaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaagggtacctgtacccgaaaccgacacaggtgggtaggtagagaatacctaggggcgcgagacaactctctctaaggaactcggcaaaatagccccgtaacttcgggagaaggaacgcccatctgcacgggccacgcgaagcgttcgagctcctcccacggcagccatggtcaccgccaccacctccccgctcttctcctctnctccctccgcgctncccctcccttcccccaccgaattcacacgtctctctcgctccgagccctcntcccacgtgcccgtctctctgcctccctccctttcgcctccccactcgtttcagggcgggtacgggacctgggcgggcactttcagtgttcccccccggaaaagttaaaaaccggggggccttgaaagtggggttctaaaggcccccaagtgggggggggggcccggacttcttttaaaaaaaaagggggggccccaaaaaaaaaaaaccccctccccaaaaaaacccc

SEQ ID NO: 77916 - protein, 69 aa, Zea mays
  misc_feature: Ceres CLONE 1562915
  misc_feature (13)..(13): Xaa is any aa, unknown, or other
MVTATTSPLFSSXPSALPLPSPTEFTRLSRSEPSSHVPVSLPPSLSPPHSFQGGYGTWAGTFSVPPRKS

SEQ ID NO: 77917 - DNA, 879 bp, Zea mays
  misc_feature: Ceres CLONE 1562918
  misc_feature: Encodes the peptide sequence at SEQ ID NO. 77918
  misc_feature (337)..(337): n is a, c, t, g, unknown, or other
  misc_feature (356)..(356): n is a, c, t, g, unknown, or other
  misc_feature (534)..(534): n is a, c, t, g, unknown, or other
  misc_feature (583)..(583): n is a, c, t, g, unknown, or other
  misc_feature (634)..(634): n is a, c, t, g, unknown, or other
  misc_feature (637)..(637): n is a, c, t, g, unknown, or other
agctccccgcggtggcggccgctctagaactagtggatcccccgggctgcaggaattcgtctcacccctagaaaaaaaaacgggcggggccgcaccgaccgaacctaaccgagagcacgagcatacccgtcccgactccgactgcagagcatcagccgaggagaaaagtcgggagaaacgcgcgtgacgtctgcccgcgtcgtatgcgccgcgctgccgtcgccgcgacgacgacgacgaccaggatggcagccgaggagatgagacgggcctccgcctcaacggccacggcggagatgccggcgtcgccggcgccggcgcaagcggggtcgaggtngggcgcgggtgtggccgcngcgcgctccggtggatccccacctccacggaccgcatcatcgccgccgagaagcgactcctcacgatagtcaaaactggatactgtccagaacgagtcaacattggctcctgctccacctgggtcaaaaagtaagattggtttagggtcagcaagtgattgaaaccaggtttcattantacctgtaaacattttgataggcaaggagaaatgccccccacccctggnttatgggtccatgggctatggagcttttccacaggggggttcttcctttcnaancttttgatgccccccttggcagccccgttttttaggggtgatttgccattgatcagcctcgggcctgggggtggtttcaggcagaccctgacttcccccttgtaaagtacccgaggaaactgagggctgggtttcatagatcccttttccagggatggcgcaaggcccaggaacctccggtaattttaatattgcttggtcacctccttttttggaagatatgttgctgcaatatgcgctaa

SEQ ID NO: 77918 - protein, 58 aa, Zea mays
  misc_feature: Ceres CLONE 1562918
  misc_feature (24)..(24): Xaa is any aa, unknown, or other
MPPTPGLWVHGLWSFSTGGFFLSXLLMPPLAAPFFRGDLPLISLGPGGGFRQTLTSPL

SEQ ID NO: 77919 - DNA, 811 bp, Zea mays
  misc_feature: Ceres CLONE 1562919
  misc_feature: Encodes the peptide sequence at SEQ ID NO. 77920
  misc_feature (665)..(665): n is a, c, t, g, unknown, or other
  misc_feature (779)..(779): n is a, c, t, g, unknown, or other
ctccccgcggtggcggccgctctagaacagtggatcccccgggctgcaggaattcgtctcacccctagaaaaactcttcacgacgaactccgctgggccaccagctttgaccgccgcctcccttcccctccgctactgctactccccaccccactcccccgcaggagcggcggaggcggctgcgacgtcgtaccccacatcggcgagcggcggcggcaccgcctgacgcaaaggctagatgttcgggcgcgcgccgaagaaaagcgaccaccccgagatactacgagatactcggggtgcccaactccgcgtcccagaactatctcaagaaagcctaccgcaaggctgctatcaataaccaccccgactagggcggtgaccccgacaagtctaggagctcgcacaagcctatgaggttctgagtgatccagagaaacgtagagattcatgatcagtatggcgaagatgccctgaatgaaggaatgggcggtggaggatcccatgctgatccatgtgacatcgtctcagcattttttggacctcttgtgggaggacgtggtggcagcagcaggggaaccaggcagaggaagggagaagaatggaggtcacccacatcctagtttcgctggaagatcttgacaatggctcgctcatagacgctctcntctttcgagcaatgtcactccgctcccagtgcaaggggaatgggctcgaaatctagtagcctcaatgaaggcgccccgagttggcaaggcgccctgcctgaaagtcacaattcntggcactggggcccgatcacgaatcagcgaaa

SEQ ID NO: 77920 - protein, 45 aa, Zea mays
  misc_feature: Ceres CLONE 1562919
MGGGGSHADPCDIVSAFFGPLVGGRGGSSRGTRQRKGEEWRSPTS

SEQ ID NO: 77921 - DNA, 868 bp, Zea mays
  misc_feature: Ceres CLONE 1562922
  misc_feature: Encodes the peptide sequence at SEQ ID NO. 77922
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (649)..(649): n is a, c, t, g, unknown, or other
  misc_feature (656)..(656): n is a, c, t, g, unknown, or other
  misc_feature (708)..(708): n is a, c, t, g, unknown, or other
  misc_feature (836)..(836): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnggggtgcaagctggagctccccgcggtggcggccgctctagaatagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacacccgccaggctgtccgccgaccccgagaccttcgccaagaaccgcgagctgggtagtgatccactcccgctgggccattgctcggcgcgctcgggctgcgtctttccccgtagctgctctgcccgcaacgggcgtcatagttcgagcgaggccagtctgggttcaaggccggggctcccagatncttcagncgagggccgggcttgggaactaccttggcaaacccccatgcctggatccacngcgcagaagcatccctcgcccatctgagcccgtgcccaggtcgtggctcatggggcgcccgttcgaagagctaaccgtaatttggccggcgggccgcctccgggcgaagggtcgtcgacccccgctgntacccctgggcggcaggcttcgtacccccctt

SEQ ID NO: 77922 - protein, 90 aa, Zea mays
  misc_feature: Ceres CLONE 1562922
MAISSTAMAGTPIKVGSFGEGRITMRKTVGKPKVAASGSPWYGPDRVKYLGPFSGEPPSYLTGEFPGDYGWDTRQAVRRPRDLRQEPRAG

SEQ ID NO: 77923 - DNA, 778 bp, Zea mays
  misc_feature: Ceres CLONE 1562923
  misc_feature (339)..(339): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (717)..(717): n is a, c, t, g, unknown, or other
ctccccgcggtggcggccgctctagaactagtggatcccccgggctgcaggaattcgtctcacccctagaaaaagtgtcgggcgggctcgtgcccgatcttgtctggtcctgtcttggctccccgccaggaatagcgcaccgagatcccttgcgcgcacggaccagcagatcgcgcgcgggagtgagagggcgacagggcgtggccgcgaggtgggcatgggatcggagggacgggtctggaatggcgcgggcgtggccgccggcagcggctatggcggcagcgtcgaaaggcgaaagcgaccacctgcggcgcccgcgggaacgttcccacggtcggncgggctcccgtcgacatcttcgctgccggtttcccccggaaaaaaggtcccccctccccaactccaaagggcctctttcccaagggaatttgggttcaaaaagggggggggccccccccaaatttagacaagatttttggggtttttttctccatccaaaaaaaacccccgtgttttttgggggggggaccccctccccccaatttttttttttgcttccaaagggggtttttctttttgttctcaagaggggggaaaaaaaaaaaacaaggggggggggaaaaaaaaagaaggtttttctcttttttttttaaaaaaaaaaaaaaannnnnnnnngggtttttttttggggggccccccccccccacaaaaaaaaangtgcaaaagggggggggggggggtggttttccccccccctcaaaaaaagaagggggtgttt

SEQ ID NO: 77924 - DNA, 724 bp, Zea mays
  misc_feature: Ceres CLONE 1562926
  misc_feature: Encodes the peptide sequence at SEQ ID NO. 77925
  misc_feature (540)..(540): n is a, c, t, g, unknown, or other
  misc_feature (656)..(656): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (681)..(681): n is a, c, t, g, unknown, or other
ataagctggagctccccgcggtggcggccgctctagaactagtggatcccccgggctgcaggaattcgtctcacccctagaaaaaagtcaaggcgcatatccattccatggatctcgcgcccctgctccttctctcccagctgctgctgcttccggtggtggcggttgtctccggcgagaccgccgcgcacccgggctacacacacgctgaggaggcatgcagcggtgtgctagaggcagaggcggagaaagcaacggtgctggtgcctgcgccagagcggcgcgaagagttcgacggggggcggatcgtggacatcagccactactaccgcgaggacatgccggagtgggagtcatcagagggctccggcgagttcctgcagctggcgcggtccatgcgcaacggctccgacatcgctaacttctcggaagctccggctcactgggcacttcgggaccccacttgaaacccccggggaaaatttttttaaaaactttttttaaacccccggtttttttttttttaaaaacccccccccncaccccccccccccgtgggtctccttcaaaaaaaaaaaaaaaacgcggggtggtggtgggcccccccccaaaaaaaaaaaaaaaaaaaaccccccccccctttttttttttttttntnnncccgggccccccccccccaanacaaaaaaagaaaaggggggggggggggggcgggccgccccct

SEQ ID NO: 77925 - protein, 119 aa, Zea mays
  misc_feature: Ceres CLONE 1562926
MDLAPLLLLSQLLLLPVVAVVSGETAAHPGYTHAEEACSGVLEAEAEKATVLVPAPERREEFDGGRIVDISHYYREDMPEWESSEGSGEFLQLARSMRNGSDIANFSEAPAHWALRDPT

SEQ ID NO: 77926 - DNA, 820 bp, Zea mays
  misc_feature: Ceres CLONE 1562928
  misc_feature: Encodes the peptide sequence at SEQ ID NO. 77927
  misc_feature (670)..(670): n is a, c, t, g, unknown, or other
catagctggagctccccgcggtggcggccgctctagaactagtggatcccccgggctgcaggaattcgtctcacccctagaaaaagtcacaccttccctcggtcccttccatcttctagccgccgccgccgccgccgctgcccaaaaccctacctaccctcttcttccccctcactctcctttcatctccattctaatggcggcccaacccgtccggcgaggctgctagtgcttgtatctactatcttcatcaggtacttcgccatcctactgaagtattccccgccgccgctgccatggccaccctcaaccctttcgaactcctcggcgccgacgacaacgacgacccgacgcagctgattgcggcggcggcggctgctgctcagaaagccgaggcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcagaggtggacggggatatggccagaaccgtggcttcagtggtgacaatggcaatgagttccagggaggttatgggtggcgagcctattgggggaatggtgctgaaacctggtngatcctgaaggaaaaaaaggggagaagagagactcgtccccccgtacccgtggcggaggcagaacgtggtgggttacaggaaatggttgaagtttgctgatgactctgaagaggccaccacgggagaaactatgtagcgcccacagcggg

SEQ ID NO: 77927 - protein, 157 aa, Zea mays
  misc_feature: Ceres CLONE 1562928
  misc_feature (125)..(125): Xaa is any aa, unknown, or other
MATLNPFELLGADDNDDPTQLIAAAAAAAQKAEAKKSAVAPAGKAAQPAATTKFPTKPAPPSQTVRDARGGGSSARGGFGRGERGRGRGGRGYGQNRGFSGDNGNEFQGGYGWRAYWGNGAETWXILKEKKGRRETRPPVPVAEAERGGLQEMVEVC

SEQ ID NO: 77928 - DNA, 875 bp, Zea mays
  misc_feature: Ceres CLONE 1562929
  misc_feature: Encodes the peptide sequence at SEQ ID NO. 77929
  misc_feature (563)..(563): n is a, c, t, g, unknown, or other
gagctccccgcggtggcggccgctctagaactagtggatcccccgggctgcaggaattcgtctcacccctagaaaaaaccgcgcgcaatcggccgctcatcccctcttcctatcgcccgccgccgccgccgccgccgcccgtccgcttcagtacgacgtcgagcaaggggaggtaaaagttcgtttggcgtgcgccatgtttaagaagttctcttcagaagatatatctggacagaatcaagttaaggcttctgtacaacgaaagattcggcaaagtatcgctgatgagtaccccagccttgaacctttgctagatgacttgctcccaaaaaagtcacctatgattgttgttaaatgccaaaatcatcttaatcttgtagtggtgaataatgttcctctatttttcaatatacgtgatggtccttacatgccaaccctgcgtcttcttcatcagtatcctgatatcatgaaaaagttccaagtggatagaggtgctatcaaatttgttctatctggcgcaaacataatgtgtcctgggttgacttcaactggtggtgccttanaccacgaagtcgaggaaggaacaccagtggctataatggctgaaggaaaccaaccccccctggccatttggatttccaagaaggtccgccaaagacataagggccctctcacaaaagaaattgggggttgacaaatttgcccctttctaaaagaagggcccctttgggaaaaaagaaccggcctccaaaaaaaataaaatttttcctggaagggggttttaaaatttggggggggaaaatttttttttggggggaaatttaaaaaaacccgcgggggggcccccttttttttttccccccttgtgtgttttt

SEQ ID NO: 77929 - protein, 165 aa, Zea mays
  misc_feature: Ceres CLONE 1562929
  misc_feature (123)..(123): Xaa is any aa, unknown, or other
MFKKFSSEDISGQNQVKASVQRKIRQSIADEYPSLEPLLDDLLPKKSPMIVVKCQNHLNLVVVNNVPLFFNIRDGPYMPTLRLLHQYPDIMKKFQVDRGAIKFVLSGANIMCPGLTSTGGALXHEVEEGTPVAIMAEGNQPPLAIWISKKVRQRHKGPLTKEIGG

SEQ ID NO: 77930 - DNA, 886 bp, Zea mays
  misc_feature: Ceres CLONE 1562930
  misc_feature: Encodes the peptide sequence at SEQ ID NO. 77931
  misc_feature (861)..(861): n is a, c, t, g, unknown, or other
  misc_feature (868)..(868): n is a, c, t, g, unknown, or other
  misc_feature (869)..(869): n is a, c, t, g, unknown, or other
aaagctggagctcaccgcggtggcggccgctctagaactagtggattcccccgggctgcaggaattcgtctcacccctagaaaaaactgacgaaccgattcccagaaagctcgatctagcgcgcgcggctgcagagtgcagacgaacgacgtacaccatggcgcggcggtccctggccctgctgctcgcgtcgtcgctcgccctgatggcggccgccgtcgcatcggcggactcgtggctctacgacaagttcaacacggacggcaccgtccgcacccagtacgacgcgtcggggcaagaagtggcgatgctcagcctggaacgcagcttcggcggcggcttcaactccaagaagcagtacctgttccgcgagttcagcgtccagatgaagctcatccccgggaactccgcccgcacccgtctcgtggcttctacctctcggtcgggcgacagcgcacagggcaccaccagatccgacatgggagtttcatggggccacacgcagcggggcaccccggggggtgctgaaacaccaaaacgtgtgggggccaaacgggggacaggggaagaaaagaagacacccagggtcggcaccccctggggtttcgagccccctctcgcgcgaaatttccccaccctttcacccatttatttctgggaaaccggaacacaacatccttggttcccaaaggtggaacggggcaccctttgtatccgggtgccttcaaagcgcctacgccccgaccctggccgtaccccgaagcggcgagggcccccatggcgctgccaacgccacggctgtggggatcggcatgctactggggccaccgagaatgagcaaaagtggccgggtggactggntccgccnnggccctttcgtccgtcc

SEQ ID NO: 77931 - protein, 243 aa, Zea mays
  misc_feature: Ceres CLONE 1562930
  misc_feature: SWISSPROT Homolog: EC 2.4.1.207 Xyloglucan:xyloglucosyl transferase
  misc_feature (235)..(235): Xaa is any aa, unknown, or other
  misc_feature (238)..(238): Xaa is any aa, unknown, or other
MARRSLALLLASSLALMAAAVASADSWLYDKFNTDGTVRTQYDASGQEVAMLSLERSFGGGFNSKKQYLFREFSVQMKLIPGNSARTRLVASTSRSGDSAQGTTRSDMGVSWGHTQRGTPGGAETPKRVGAKRGTGEEKKTPRVGTPWGFEPPLARNFPTLSPIYFWETGTQHPWFPKVERGTLCIRVPSKRLRPDPGRTPKRRGPPWRCQRHGCGDRHATGATENEQKWPGGLXPPXPFRPS

SEQ ID NO: 77932 - DNA, 1013 bp, Zea mays
  misc_feature: Ceres CLONE 1562932
  misc_feature: Encodes the peptide sequence at SEQ ID NO. 77933
  misc_feature (213)..(213): n is a, c, t, g, unknown, or other
  misc_feature (223)..(223): n is a, c, t, g, unknown, or other
  misc_feature (522)..(522): n is a, c, t, g, unknown, or other
  misc_feature (635)..(635): n is a, c, t, g, unknown, or other
  misc_feature (756)..(756): n is a, c, t, g, unknown, or other
  misc_feature (788)..(788): n is a, c, t, g, unknown, or other
  misc_feature (799)..(799): n is a, c, t, g, unknown, or other
  misc_feature (800)..(800): n is a, c, t, g, unknown, or other
  misc_feature (824)..(824): n is a, c, t, g, unknown, or other
  misc_feature (826)..(826): n is a, c, t, g, unknown, or other
  misc_feature (830)..(830): n is a, c, t, g, unknown, or other
  misc_feature (831)..(831): n is a, c, t, g, unknown, or other
  misc_feature (835)..(835): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (866)..(866): n is a, c, t, g, unknown, or other
  misc_feature (867)..(867): n is a, c, t, g, unknown, or other
  misc_feature (875)..(875): n is a, c, t, g, unknown, or other
  misc_feature (885)..(885): n is a, c, t, g, unknown, or other
ggagctccccgcggtggcggccgctctagaactagtggatcccccgggctgcaggaattcgtctcacccctagaaaaaaaagcgccactactcacagacagtcacatacacatccaacgagcccgaccgccagagctcgccgccgtcctccgcagacaatccaccatggcgatggtgctgaggatggtgctggggaagatcccggtggagacncccaagcacnaggtcctccacaccagccccggctaccagaatccgcaggacccgcccagcttccccgcggagttgaccttcaatcccaggggatgaggggaaaccctgatgggggggttcaccggacccccccaaatatatggggggtggtggcccccccccttttaaacccccagcccctgaggggggttccccctgggaagggtccgggcgtctaacccccccaaaaaggggggagcggggggcgaaccggggaaaaaaaaaaatacccttataggaggccccccccgtttttcccccccccggggngggggggcggagggtcctctaaagcccccccccccagaaaaaacaccccccccccggccgggtggttttttggggtgaaatcatacacactgtgtgtccccccggcgtggggngaggggtagaacaattgaaaggtgtttttgtttgtgtgtgtgcgtccctcccggagaatatattgacccacccacacccccggaagaaaggggggttgttttttgatcccccccccgcccnattattgggggtggtggtggggtgtaaaaaangattggccggnnaaccctaaaaacccaaaaaaaaananaaannaaanaaannnnaaaaaaaaattaaagagggggggnnaaggttgntctctgcaantcagtatgctgtagtgtggtgtgtgaggttgaccacccacacacccgtagttttctcttcccgtccctcttcttttgttagagagaaggcgcccgcccctaccctccaggtgggggccttactgtttt

SEQ ID NO: 77933 - protein, 47 aa, Zea mays
  misc_feature: Ceres CLONE 1562932
  misc_feature (20)..(20): Xaa is any aa, unknown, or other
MAMVLRMVLGKIPVETPKHXVLHTSPGYQNPQDPPSFPAELTFNPRG

SEQ ID NO: 77934 - DNA, 808 bp, Zea mays
  misc_feature: Ceres CLONE 1562933
  misc_feature: Translation starting site: 189
  misc_feature: SWISSPROT Homolog: EC 3.4.21.92 Endopeptidase Clp
ctggagctcaccgcggtggcggccgctctagaactagtggatcccccgggctgcaggaattcgtctcacccctagaaaaaggccctctctccatccctgcccacgaccctccgccaccaggcaccagccatcgcctgcatcagatctcccgcccgtccgttacatcccagggcgacgcggccgcggccatgacgccatcctcagctctcgccctcgcgcaccacgccgcggtatccccgctcccgtcctccacgccgcggccctcccccaggtccagctctctgagcctgggcccgggctccgccgggctcgggccgcgccggctcgtcgcggcggcgcccccacgggcgttcttctcctcgtccccctaccagccgccccagccggagggggtctcgcagcaccgcgagtacggcctggtccccatggtcatcgagaccacctccccgggggagcgcgcctacgacatctttctcgcgctggctaaaggagcgcatcgtctggatccacggggccatcgccgacgaaccggcctcccctcgtcgtccggcaactgctctttcctcgaagtcggagaaacccgctaaaacccggccaccctcttaatttaaattcccccgggggggtcgtccccccgggggggttggccttttaaaaaaacccggggaggaaaaatcgcgtgggccccggttacaaccccctttttaatttgggccaggggggggccccccaggggggggtcgctccccctcccctccgggctgggggggcccccgggggtaaaaaaaggccccccccgctccccccc

SEQ ID NO: 77935 - DNA, 831 bp, Zea mays
  misc_feature: Ceres CLONE 1562934
  misc_feature: Encodes the peptide sequence at SEQ ID NO. 77936
  misc_feature (801)..(801): n is a, c, t, g, unknown, or other
tccccgcgggtggcggccgctctagaactagtggatcccccgggctgcaggaattcgtctcacccctagaaaaatcaagacctccgtcaagaacacggtgacccaggtggccaagaaggtgctgaccatgaacccctcgggggacctctccagcgcgcgcttcagcgagaaggagctcatcaccgccatcgaccgcgaggccgtgttcacgtacgcggaggacgcggccagcgccagcctgccgctgatgcagaagctgcgcgccgtgctggtggaccacgccctcagcagcggcgacgcggagcgcgagccctccgtcttctccaggatcaccaagttcgaggaggagctccgcgcggtgctgccccacgaggtggaggccgcccgcgtcgccgtcgccgagggcaccgcccccgtggccaaccggatcgcggacagccgctcgttcccgctgtaccgcttcgtgcgccaggaagctcggctgcgtgttcctcaccggcgagaagctcaagtccccccggcgaggagtgcaacaaggtgttcctcggcatcagccagggcaagctcgtcgaccccatgctcgagtgcctcaaggagtgggacggcaagccgctgcccatcaacatcaactaaaagacgccaggcgccgccatccatgctgccgcccgcgcatgggccggaggagaagaggaaaatacatgaaaaaataaaacttgtacacgtgtatgtctccagattgtgcccaccgtcgttctcgtcgttgacttttgggtgtattggcggatccatatggtgtgtgcnttgtgtggcggttgtcctttcctccttggg

SEQ ID NO: 77936 - protein, 234 aa, Zea mays
  misc_feature: Ceres CLONE 1562934
  misc_feature: SWISSPROT Homolog: EC 4.3.1.5 Phenylalanine ammonia-lyase
  misc_feature (225)..(225): Xaa is any aa, unknown, or other
MNPSGDLSSARFSEKELITAIDREAVFTYAEDAASASLPLMQKLRAVLVDHALSSGDAEREPSVFSRITKFEEELRAVLPHEVEAARVAVAEGTAPVANRIADSRSFPLYRFVRQEARLRVPHRREAQVPPARSATRCSSASARASSSTPCSSASRSGTASRCPSTSTKRRQAPPSMLPPAHGPEEKRKIHEKIKLVHVYVSRLCPPSFSSLTFGCIGGSIWCVXCVAVVLSSL

SEQ ID NO: 77937 - DNA, 944 bp, Zea mays
  misc_feature: Ceres CLONE 1562937
  misc_feature: SWISSPROT Homolog: EC 2.7.11.1 Non-specific serine/threonine protein kinase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (352)..(352): n is a, c, t, g, unknown, or other
  misc_feature (361)..(361): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnngggttgaaagctggaactcaccgcggtggcggccgctctagaatagtggatcccccgggctgcaggaattcgtctcacccctagaaaattttaatcagcgtctagaaattgcaattgacgtggctcatgcacttacttatcttcatctgtatgcagagaagactataattcatcgtgatgtgaagtcatcaaacatcctgctgacagatagctatcgggccaaggtgtctgaacttgggtttgcaagaagtgcccctagtgacacngagaagacncacatatcaacgaaagtgaaaagcacagctgggtacctggacccgaaatactggagaaataccagctacctccaagaaggatggcttcccatttgggaaattggcttgggaaaaattctttccggccccccaaacccctttaaacttaaaacccaacccccctaaaagaagggatcccccatccccaatggggcctttcccaaaaaattccccccgaaaggcggcacccccgggaaaaaattttggggggcccccttttgttgggaaaaaaaaacccccggggaacaaaacaaaaagggggccctttaaaaaaaaaaccccccctttaacccccgggggtttttttcaaaaaagggcccccgccccccccaaaacccgggggaagaaaacccgggggcgaacaacactctaaaaaaaaaatttttgggggaagaaaccacttttttggggggatataatgtgggaaaaaatttccccccacaaaaaaaggtttttttgaaaaaagggggggggagaaaaacaatttgcggaaaaaaaaaatttttctccccctgttttttcacaaaaaaattttcccccccgg

SEQ ID NO: 77938 - DNA, 799 bp, Zea mays
  misc_feature: Ceres CLONE 1562938
  misc_feature: Encodes the peptide sequence at SEQ ID NO. 77939
ctggagctccccgcggtggcggccgctctagaactagtggatcccccgggctgcaggaattcgtctcacccctagaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcgggcaggccacgtacctgggcgccccggtgccgtggggcacgctgccgaccatcctggtgatcgagttcgtggccatcgcctttcgcgagcaccagcgcaccatggagaatgaccccgagaagatgaagtaccccggcggcgccttcgacccgctcggcttctccaaggaccccgcctagtttcgaggagtacaaagctaagggagatcaaggacggcccgcctcgccatgctgggcctttcgtccggcttctgcgttccagcaggtcggcgtaccccgggcacccggt

SEQ ID NO: 77939 - protein, 183 aa, Zea mays
  misc_feature: Ceres CLONE 1562938
  misc_feature (54)..(184): Pfam Name: Chloroa_b-bind Pfam Description: Chlorophyll A-B binding protein
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGNWVKAQEWAAVPGGQATYLGAPVPWGTLPTILVIEFVAIAFREHQRTMENDPEKMKYPGGAFDPLGFSKDPA

SEQ ID NO: 77940 - DNA, 743 bp, Zea mays
  misc_feature: Ceres CLONE 1562939
  misc_feature: Encodes the peptide sequence at SEQ ID NO. 77941
agctccccgcggtggcggccgctctagaactagtggatcccccgggctgcaggaattcgtctcacccctagaaaaaagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttcggcttcgaccccctgggcctggccacggtgccggagaacttcgagcggttcaaggagtcggaggtgtaccactgccggtgggccatgctggccgtgccgggggtgctggtgccggaggcgctggggctgggcaactgggtgaaggcgcaggagtgggcggccgtccccggcgggcaggccacgtacctgggcgccccggtgccgtggggcacgctgccgaccatcctggcggtcgagttcgtggccatcgccttcgccgagcaccagcgcaccatgggagaaggaccccgtagaagaagaagtacccccggcggcgcccttcgaccccgctcggctttctccaggggacccccgccaaggctcgaaggagtacaagcctcaaagaagatccaa

SEQ ID NO: 77941 - protein, 202 aa, Zea mays
  misc_feature: Ceres CLONE 1562939
  misc_feature (58)..(198): Pfam Name: Chloroa_b-bind Pfam Description: Chlorophyll A-B binding protein
MAMASSSSGLRSCSALGVPSLLAPSTSSSSRSGRLPFCAHATTSGRVTMSAEWMPGQPRPAHLDGSSPGDFGFDPLGLATVPENFERFKESEVYHCRWAMLAVPGVLVPEALGLGNWVKAQEWAAVPGGQATYLGAPVPWGTLPTILAVEFVAIAFAEHQRTMGEGPRRRRSTPGGALRPRSAFSRGPPPRLEGVQASKKIQ

SEQ ID NO: 77942 - DNA, 810 bp, Zea mays
  misc_feature: Ceres CLONE 1562940
  misc_feature: Encodes the peptide sequence at SEQ ID NO. 77943
  misc_feature (445)..(445): n is a, c, t, g, unknown, or other
  misc_feature (494)..(494): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
ctggagctccccgcggtggcggccgctctagaactagtggatcccccgggctgcaggaattcgtctcacccctagaaaaaaacgcaaaaccacttttccttcacgcctcgcaacgcatctacacttcccaaaacgcagcagcacttcttctttcatccacttcccaaatcgcagaaggaccagggaacagagagacccttcgttttcagtccggaactggcgagaccaatggacgccgccggggaggcctcgtcgccgtcgtccccgtcgaagctgcgggacaagctgcggaccacggtgtgctgttgcttcggcgcggtcggcggcccggagaggacgaggtggcggcggcggggcgcggccgcgggcgagttccgctacgacgcgctcagctacgcgctcaacttcgacgagggcgacgacgacgacgcgtacgcggaccccngccgcggtcttccggtacaggaaactcaacgcgcgcctccccgtctcgncgggcgccgctgcccgcggtggggacccagcggcaaacacacacgggcatcgccctagacgtagaacgcgatggcctctcctggtaatttttttgggcgacttccggtaattttttttgggcccccttctggtaacgggtccgaatctactaacgaagcggaacgaatttcttaaaaaaaaaaaaaaaaannnnnnnngggtacccctgaaccctgcaagtaaaacgggccctgggctaccgggaaaaacccaaacccggaaccaaggtcccctgggtcccttaaccttgtcccccaaaggaaggggggcgacccc

SEQ ID NO: 77943 - protein, 107 aa, Zea mays
  misc_feature: Ceres CLONE 1562940
  misc_feature (73)..(73): Xaa is any aa, unknown, or other
  misc_feature (89)..(89): Xaa is any aa, unknown, or other
MDAAGEASSPSSPSKLRDKLRTTVCCCFGAVGGPERTRWRRRGAAAGEFRYDALSYALNFDEGDDDDAYADPXRGLPVQETQRAPPRLXGRRCPRWGPSGKHTRASP

SEQ ID NO: 77944 - DNA, 827 bp, Zea mays
  misc_feature: Ceres CLONE 1562942
  misc_feature: Encodes the peptide sequence at SEQ ID NO. 77945
aaaagctggagctcaccgcggtggcggccgctctagaactagtggatcccccgggctgcaggaattcgtctcacccctagaaaaaaccatcacagtacgcacgcacgcacacaccagcccagcagcagaagcgcccctcggccctcgctcccacaacaagctcaagccagccttctctctctgctccaatggcgcgcttccagctcgcagccgtggccatggccatgctctttcgcccgcggcggcggcgcaggccccgaccgccaccccgacgccggctcccaaggcgtcccccccgccggcgacgccgccgccgacccccgcgccggtgtctccgcccgtgccgcccccgaccatgcctcctccggcgcccgcgcccgcccccaaggccccggccccggcgcccgaggcccccaccccggcgcccacggccgaggctcccactcccgacgtgagctccccgccgatgcccacggagggccccgctccgacgccctccgcggaggctcccccagcccccagcgccgccgtcgccggcgcctccccctccagcaagtgggtcgccgccaccgcagcggtgggcgacaacggcgccgccttctaatgacaaaacgggaagatctggacagacccctgcctgaaagttatcgctatccgggctaaaccggaggagaacaatgtttggtggaacttccgtttcatacaaaatcccattccggcatttgaaaccactttgaactgacaaaaccgggtccaggtaactccaggggaggaaaaactgggctaagggaaaaatttggtttgtgcctggctggggtggggtgggt

SEQ ID NO: 77945 - protein, 200 aa, Zea mays
  misc_feature: Ceres CLONE 1562942
KAGAHRGGGRSRTSGSPGLQEFVSPLEKTITVRTHAHTSPAAEAPLGPRSHNKLKPAFSLCSNGALPARSRGHGHALSPAAAAQAPTATPTPAPKASPPPATPPPTPAPVSPPVPPPTMPPPAPAPAPKAPAPAPEAPTPAPTAEAPTPDVSSPPMPTEGPAPTPSAEAPPAPSAAVAGASPSSKWVAATAAVGDNGAAF

SEQ ID NO: 77946 - DNA, 807 bp, Zea mays
  misc_feature: Ceres CLONE 1562944
  misc_feature: Encodes the peptide sequence at SEQ ID NO. 77947
  misc_feature (724)..(724): n is a, c, t, g, unknown, or other
  misc_feature (748)..(748): n is a, c, t, g, unknown, or other
gctggagctcaccgcggtggcggccgctctagaactagtggatcccccgggctgcaggaattcgtctcacccctagaaaaaaaccaccacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagccccctcgcctccgccacccccggcgcgcgtcgcgctttccctgtacggctgctgctccaggcatctgcgctcgcgccgcgccggcgcgccttggccgtgaccgtgagggcccagagcgacgacgccgaggccgagccaaaggaggcggcggcggcggccaccaccccggcgccaaagtccaaggcggcggcggcggcgagccccgggctgtgggacgcgctggcgttcagcggcccggctcccgagcgcatcaacggccggctcgccatggtggggcttcgtgtcggcgctcgccgtcgaagcgtcccgcggcgggggcctcctctcgcaggcgggcagcgggtccgggctcgcctgtggttcgcggccacggctgcccgtgctgtccgtggccctcgctggtgccgctgctccaggggcgaccagcgcgaaggcaggaagccgcggccgtcatgaagcgcaacgccgagctcctggacggncgctttcgcatggctccggcctcntcgcgctcgccctttactggaatacctcacccggcgcaccgttcatcaaacgcgtaaaa

SEQ ID NO: 77947 - protein, 161 aa, Zea mays
  misc_feature: Ceres CLONE 1562944
MAATVMASMSPLASATPGARRAFPVRLLLQASALAPRRRALAVTVRAQSDDAEAEPKEAAAAATTPAPKSKAAAAASPGLWDALAFSGPAPERINGRLAMVGLRVGARRRSVPRRGPPLAGGQRVRARLWFAATAARAVRGPRWCRCSRGDQREGRKPRPS

SEQ ID NO: 77948 - DNA, 985 bp, Zea mays
  misc_feature: Ceres CLONE 1562945
  misc_feature: Encodes the peptide sequence at SEQ ID NO. 77949
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggttggcggggctcaccgcgtggcggccgctctagaactagtggatcccccgggctgcaggaattcgtctcacccctagaaaaaatctctcatggcactcggtgtctcctgatagctgctgcttcgatctactccacctaaccgaaagagcgtcctgtaaggtcttggattcttggtccagtgctgttggcctgtttcttgagatcgaagatccaggagatgatcctgcggcggagatcgaggtcgatgaacagcagcgccggcgcccagaggagccacgtccccgatcagtccgcgagatcgtcgaccagtccatgcgacggtgaaagtgggcgggacctgcgcccgccggcagcaagaatgcttacccgcgcctggccctgattcacttcccccgaggctgctgggactctttcttgcccttgcccacccagcacccgttcccccatgcacctaaaaggcccccgcgcccggtaaagcccgaagccccccagaaagggcctttcttcccattgatccccggaaccttcccatggcttgccaaccccgtacccgggcggggccttcccccggccgggggggaacgggggaacgggggcccccgggcaaaaaaggtcccgaccccctcccttttggaacagggccccccggggaaaccaaacaaacggggccctcccccgggaaacccccccctgggaaacctgtttgggcggaacccaaaccaacccagccaaggcaaggcagccactccagggaaacccggaatcccttcccttccgggagagccgaaaaccccctttccgtttcttgggctcccaaa

SEQ ID NO: 77949 - protein, 54 aa, Zea mays
  misc_feature: Ceres CLONE 1562945
MILRRRSRSMNSSAGAQRSHVPDQSARSSTSPCDGESGRDLRPPAARMLTRAWP

SEQ ID NO: 77950 - DNA, 778 bp, Zea mays
  misc_feature: Ceres CLONE 1562950
  misc_feature: Translation starting site: 657
  misc_feature (605)..(605): n is a, c, t, g, unknown, or other
  misc_feature (763)..(763): n is a, c, t, g, unknown, or other
ctcaccgcggtggcggccgctctagaactagtggatcccccgggctgcaggaattcgtctcacccctagaaaaaaagtttttgtccattccgttccgtaggatcccacgagtcgactctgtctgaaaccggtagttggactagctgctggagtgtggaggaagacttggggaggctgccttcatatagcggctagttggagcccaacgctcgccattgcaagccttcccggttacttgttcactagcaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagactcacatctcgatccgggacctggacgccaagcacgggcgcaacggcctgctgctcctccgcatcggcgccgtgccctaccctgttcgtgtcctcgcccagcgccgccngacgccgtcctgcgcacccaggaccacatcttcgcgtcgcggccgccgtccatggctgccgagatcatccgctacgggccctcggacagtcgcgttcgtgcccctacggcgagtactggcggcaggggcagaaactccctcaccacgcacatgctcangcaccaagaaaggtg

SEQ ID NO: 77951 - DNA, 755 bp, Zea mays
  misc_feature: Ceres CLONE 1562951
  misc_feature: Encodes the peptide sequence at SEQ ID NO. 77952
ctggagctcaccgcggtggcggccgctctagaactagtggatcccccgggctgcaggaattcgtctcacccctagaaaaagctggctcccaccgaattcattccacccccgtctcctccgatcggaccaccgggccagcagcggggcggatcgtgacgtcagcaggcatggtgaaggcctaccccacggtgaacgaggactacctcaaggcggtcgacaaggccaagcgcaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccccgggaggcaggacaagcctgaggctccaccggaaggccgccttcctgatgccaccccaaggttctgatcacctccaggcaggttttctccacaccagatggggtttgagcgaccaggacatttgttgccgcttttctgggtggtcacacccctggggaagatgccacaaaggaccaggtctgggattttgaggggagcctgggacgtcccaacccctttggatcttttgaacaactct

SEQ ID NO: 77952 - protein, 138 aa, Zea mays
  misc_feature: Ceres CLONE 1562951
  misc_feature (19)..(139): Pfam Name: peroxidase Pfam Description: Peroxidase
  misc_feature: SWISSPROT Homolog: EC 1.11.1.11 L-ascorbate peroxidase
MVKAYPTVNEDYLKAVDKAKRKLRGLIAEKNCAPLMLRLAWHSAGTFDVATKTGGPFGTMKNPAEQAHGANAGLEIAIRLLEPIKEQFPILSYADFYQLAGVVAVEVTGGPDVPFHPGRQDKPEAPPEGRLPDATPRF

SEQ ID NO: 77953 - DNA, 757 bp, Zea mays
  misc_feature: Ceres CLONE 1562952
  misc_feature: Encodes the peptide sequence at SEQ ID NO. 77954
  misc_feature (610)..(610): n is a, c, t, g, unknown, or other
ctcaccgcggtggcggccgctctagaactagtggatcccccgggctgcaggaattcgtctcacccctagaaaaatttatggacctccctttattgttccgaccaaaggaaatggtgaagaacggtgagtttatctacaagtttgattctacaaagaaaggtcgttttggtattctcccccgctatgcaaaggatgacaaactcatcagatggtttcaactccctaattgtttcatattccataatgctaatgcttgggaagagggtgatgaagttgttctcattacctgccgccttgagaatccagatttggacaaggtgaatggatatcaaagtgacaagctcgaaaacttcgggaatgagctgtacgagatgagattcaacatgaaaacgggtgctgcttcacaaaagcaattgtctgtttctgctgtggattttcctcgtgttaatgagagctatactggcagaaagcagcggtatgtctactgcactatacttgacagcattgcgaaggtgactggcatcataaagtttgatctgcatgctgaaccggaaagtggtgtgaaggaacttgaagtggggaggaaatgtacaaggcatatatgaccctnggacctgggtagatttggttcagagggcgattttttgttccaagccatcccaggtgtgtctgggagaaagaagatgaacggctatttggaatattcttttggacaccaacgaggaccccaggggaaaatcttgaaagtaaattggtc

SEQ ID NO: 77954 - protein, 200 aa, Zea mays
  misc_feature: Ceres CLONE 1562952
  misc_feature (1)..(199): Pfam Name: RPE65 Pfam Description: Retinal pigment epithelial membrane protein
  misc_feature: SWISSPROT Homolog: EC 1.13.11.51 9-cis-epoxycarotenoid dioxygenase
HRGGGRSRTSGSPGLQEFVSPLEKFMDLPLLFRPKEMVKNGEFIYKFDSTKKGRFGILPRYAKDDKLIRWFQLPNCFIFHNANAWEEGDEVVLITCRLENPDLDKVNGYQSDKLENFGNELYEMRFNMKTGAASQKQLSVSAVDFPRVNESYTGRKQRYVYCTILDSIAKVTGIIKFDLHAEPESGVKELEVGRKCTRHI

SEQ ID NO: 77955 - DNA, 800 bp, Zea mays
  misc_feature: Ceres CLONE 1562953
  misc_feature: Encodes the peptide sequence at SEQ ID NO. 77956
ctggagctcaccgcggtggcggccgctctagaactagtggatcccccgggctgcaggaattcgtctcacccctagaaaaactcactggccatcttgagaactatactagtgactacaccctacaggtgttggtaggttattgcgctgtgtacatcttcatgcagaccttcatgatcccagggacaatattcatgtcactgcttgctggtgctctatttgggcaactgcgtggccttgcactggtggtctttgctgccactgcaggtgcttcttcgtgctatttcctgtcaaagatgattgggaagccactggtgttcacactgtggccagataagctcagcttcttccagagacaggttgctaaaagaagagagaagttgttgaattacatgcttttcctcagggtgaccccaacattgccaaataccttcatcaacttagcttcacccatagtagatgtcccctaccatatattcttactgggaactctcattggtcttatcccagctgcttatgtcactgtcagggctggaattgctcttggagagttaacttcgctgagtgacctttacgacacccagtcgatagcactgctattccctgatcgggggttgtttcagtcacaccaagcatggctggggcaaggatgaaggcccaagaagaaaccaccagaaaatggcggttaagcggcgtccttgattcccaaaagccccctaacgggggtccaccttccacctgtttataaatgtcaaacattccagcaatgccagtgggccttcccttaagttccggaatccaac

SEQ ID NO: 77956 - protein, 215 aa, Zea mays
  misc_feature: Ceres CLONE 1562953
  misc_feature (58)..(179): Pfam Name: SNARE_assoc Pfam Description: SNARE associated Golgi protein
GAHRGGGRSRTSGSPGLQEFVSPLEKLTGHLENYTSDYTLQVLVGYCAVYIFMQTFMIPGTIFMSLLAGALFGQLRGLALVVFAATAGASSCYFLSKMIGKPLVFTLWPDKLSFFQRQVAKRREKLLNYMLFLRVTPTLPNTFINLASPIVDVPYHIFLLGTLIGLIPAAYVTVRAGIALGELTSLSDLYDTQSIALLFPDRGLFQSHQAWLGQG

SEQ ID NO: 77957 - DNA, 791 bp, Zea mays
  misc_feature: Ceres CLONE 1562956
  misc_feature: Translation starting site: 153
  misc_feature (752)..(752): n is a, c, t, g, unknown, or other
ctcaccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgagggcggtgtggttcaaggccggcgcgcagatcttctcggaaggcgggctggactacctggggaacccctacctggtgcacgcacagagcatcctggccatctgggcgttgcaggtggtgctcatgggcttcgtcgaggggctaccgcgtcggcgggcgcccgctcggggaaaggctcgaccaggtggacccccggcggcgcccttcgaccccgctgggcctcggcgacgaacccngaacaacgcgcccgaccccaaggtgtatggagctccaga

SEQ ID NO: 77958 - DNA, 784 bp, Zea mays
  misc_feature: Ceres CLONE 1562957
  misc_feature: Encodes the peptide sequence at SEQ ID NO. 77959
ctcaccgcggtggcggccgctctagaactagtggatcccccgggctgcaggaattcgtctcacccctagaaaaaaccacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgccgccgagggctcgtgggtgcccgaccccgtcacgggccactaccgccccgccaactgggccgccgccgtcgaccccgccgacctccgcgccgcgcacctcgcccgcacctacgcccgggcctgagcggccccggctcccttcaccctgctccgcctcgtctcgtatgacatacgcgcaccgtaccagggtgagacgaggtgggggctggggggttcgtgtggcgtacggcgtgttgagccacgcgcgcgtgcgggcgcgctctgcgacgccccgtacgttcttgggagagcgcgagcgaggtcttctgtcttctcgggtgcgggtcctgtggcatgagatgtgacgcctggtccgttttgggccgaccaacgggagaatagcggcctttggtcggtggcccccccccgtgggtggggctggaa

SEQ ID NO: 77959 - protein, 95 aa, Zea mays; identical to SEQ ID NO: 58232
  misc_feature: Ceres CLONE 1562957
  misc_feature (1)..(89): Pfam Name: LEA_3 Pfam Description: Late embryogenesis abundant protein

SEQ ID NO: 77960 - DNA, 756 bp, Zea mays
  misc_feature: Ceres CLONE 1562958
  misc_feature: Encodes the peptide sequence at SEQ ID NO. 77961
ctcaccgcggtggcggccgctctagaactagtggatcccccgggctgcaggaattcgtctcacccctagaaaaatcttctcgaccagatccggaagttctgtgggtagaggactagagactgcagatcgagggtctggcagcgggccgtggcagttgggtgattacgacgaagagagatgggcctcctcgacaagctgtgggacgacaccgtcgcaggcccgcgcccggacaccgggctcggccgcctccgcaagcagcctgtgcgtcccgccgccgtcaagatcagtgatccggccggggacgctgcggcgttcgtgccgccctcgccggcttcgggtagcgaggagacgccggtgaaggtgacgcgcagcatcatgatcaagcgccccgcggggtacccgtcgtcgccgaggagcgcggcaagcacgccaccggcctcgccactggggactacgccgcccatctcgccgtttgccggcgccggtggtcggttcagaaggaaatcatcgtccgacgcatacgagagggcgaccccgccagggacgaccagccaccctcctcccttcgacgtgtgaactgaccgcaccctccccacttgtttttgctccttcacaggcttcatctacggttaaacagggagggaccggaagagaaaaaacttccagaggggggaacgggggatgatcttagttccccgggttggtccttaccccctaccgggggaatataatttaaatttgggaaaaataaaacct

SEQ ID NO: 77961 - protein, 132 aa, Zea mays
  misc_feature: Ceres CLONE 1562958
  misc_feature (7)..(128): Pfam Name: Auxin_repressed Pfam Description: Dormancy/auxin associated protein
MGLLDKLWDDTVAGPRPDTGLGRLRKQPVRPAAVKISDPAGDAAAFVPPSPASGSEETPVKVTRSIMIKRPAGYPSSPRSAASTPPASPLGTTPPISPFAGAGGRFRRKSSSDAYERATPPGTTSHPPPFDV

SEQ ID NO: 77962 - DNA, 784 bp, Zea mays
  misc_feature: Ceres CLONE 1562959
  misc_feature: Encodes the peptide sequence at SEQ ID NO. 77963
  misc_feature (535)..(535): n is a, c, t, g, unknown, or other
  misc_feature (621)..(621): n is a, c, t, g, unknown, or other
tggagctcaccgcggtggcggccgctctagaatagtggatcccccgggctgcaggaattcgtctcacccctagaaaaaccctcgccatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggaccctctcaccggcctcaccacccgccgcttcgtcggccacgagaaggacgtcatctccgtcgccttctccgtcgacaaccngcagatcgtctccgcgtcccgcgacaagaccatcaagctctggaacactctcggcgagtgcaagtacaccatcggcggcgacctcnggcggcggcgaagggccacaacgggtggggtctcctgccttaaggttctccccaaaaccccttccagcccaccattgtgctcccggatccctggggaccgcacccgtcaaagggctgggaaactttacccaactggcaaggctgcgcctggcattcctgggag

SEQ ID NO: 77963 - protein, 212 aa, Zea mays
  misc_feature: Ceres CLONE 1562959
  misc_feature (107)..(145): Pfam Name: WD40 Pfam Description: WD domain, G-beta repeat
  misc_feature (65)..(103): Pfam Name: WD40 Pfam Description: WD domain, G-beta repeat
  misc_feature (8)..(47): Pfam Name: WD40 Pfam Description: WD domain, G-beta repeat
  misc_feature: SWISSPROT Homolog: EC 2.7.11.7 [Myosin heavy-chain] kinase
  misc_feature (130)..(130): Xaa is any aa, unknown, or other
  misc_feature (159)..(159): Xaa is any aa, unknown, or other
MAGAQESLSLVGTMRGHNGEVTAIATPIDNSPFIVSSSRDKSVLVWDLTNPVHSTPESGVTADYGVPFRRLTGHSHFVQDVVLSSDGQFALSGSWDGELRLWDPLTGLTTRRFVGHEKDVISVAFSVDNXQIVSASRDKTIKLWNTLGECKYTIGGDLXRRRRATTGGVSCLKVLPKTPSSPPLCSRIPGDRTRQRAGKLYPTGKAAPGIPG

SEQ ID NO: 77964 - DNA, 816 bp, Zea mays
  misc_feature: Ceres CLONE 1562963
  misc_feature: Translation starting site: 153
  misc_feature: SWISSPROT Homolog: EC 1.10.99.1 Plastoquinol--plastocyanin reductase
  misc_feature (485)..(485): n is a, c, t, g, unknown, or other
  misc_feature (564)..(564): n is a, c, t, g, unknown, or other
  misc_feature (628)..(628): n is a, c, t, g, unknown, or other
  misc_feature (629)..(629): n is a, c, t, g, unknown, or other
  misc_feature (654)..(654): n is a, c, t, g, unknown, or other
  misc_feature (676)..(676): n is a, c, t, g, unknown, or other
  misc_feature (677)..(677): n is a, c, t, g, unknown, or other
  misc_feature (739)..(739): n is a, c, t, g, unknown, or other
  misc_feature (757)..(757): n is a, c, t, g, unknown, or other
  misc_feature (764)..(764): n is a, c, t, g, unknown, or other
  misc_feature (799)..(799): n is a, c, t, g, unknown, or other
ggagctccccgcggtggcggccgctctagaactagtggatcccccgggctgcaggaattcgtctcacccctagaaaaagtggacgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcaagccggtgaaggggcttggcttgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacnggtggaggcgtggctcaacacgcacggtcccaacgaccgcacgctcgcgcaggggctcaagggtgaccccacgtacctnggtggtggagcaggacaagacgctggccacctacgggaatcaacgccgtgtgcactcacctcgnngctgcgtcgtgccgtgggacggcgnctgagaacaagttcatctgccnnctgccacggatcccagtacaacaacccagggcaaaggtggtcccgtggtaccggcggcctcntgtcgcctggcccctggnttcacgnccgacgtcgacgtacggcaaaggtccctctttccntcccccgtggggtggaa

SEQ ID NO: 77965 - DNA, 740 bp, Zea mays
  misc_feature: Ceres CLONE 1562965
  misc_feature (552)..(552): n is a, c, t, g, unknown, or other
  misc_feature (553)..(553): n is a, c, t, g, unknown, or other
ctcaccgcggtggcggccgctctagactagtggatcccccgggctgcaggaattcgtctcacccctagaaaaagaggcgagtcggccggcgaagggggcggatggcgcgcgggctgcgcggcgtccgcgacgacctatccgagctggggcgccacctgctcgacatcgcttgcttcctgcacccgctcctcaacccggcccacaccgactccccgccgcccacccccacgggccgccgccgccgcgcgcgccgctccccgtccccgcaccccgccgcgccgccgtcaccgtcgctcctcgcgggcatcctctccgacctcgccgagatcggcggctccttccgcggcggcttctcccgctcctcgccggcgcccgaccaccccgcccccgacgtgctcgagtcacagcaggccgccctcgtccccgtccccgcgtcagcctcctcctgctgctgccgaccagatcgcagatgatgtcgtgggagcagcgcgtgccctcgccgcgcggcccgaggcgtggatcgacttccccgtgctcgccctagatgagggnntctgtatttctgggatccaaagggatcatattggaatccattgaaaaaactggtccccaaatttagcatcctctacgggggtagggtcctggcccttcttaacaggggaggaaaaaattttttcctgggaaaaaatttaaccttttaaggggttggccttgggagtcccaaaacccttaaatggggg

SEQ ID NO: 77966 - DNA, 825 bp, Zea mays
  misc_feature: Ceres CLONE 1562970
  misc_feature: Encodes the peptide sequence at SEQ ID NO. 77967
ggagctcaccgcggtggcggccgctctagaactagtggatcccccgggctgcaggaattcgtctcacccctagaaaaagtcgctcggtccaccacctcagctccgccgcttgcccgcttttgctctctccctcccggctctcggcttcttctacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccagctctatgagaagtacaaggaccaaggctttgaaatcctggctttcccatgcaaccagtttggtgggcaggaggcctggtaccaatgaggagattggtccagtttgcctgcacacgcttcaagggtggagtaccccatcttcgacaaggttgatgttcaacggtagcaatgcctgcgcccatctacaagttcttggaaacctagcaaaaggtgggccctttttcggcgaacagcattcaatgggaaacttttcccaaggttcctttggttgaaaaaggaaagggaccgtgtttgggggaattcccttttgggtccaaaaacaacttttccccccccgtgaaacattttgaaaaaagggaatttctcaaaaaaaacccctccctttgtggggacccccccttaaaaacccagtttaatccgggggg

SEQ ID NO: 77967 - protein, 82 aa, Zea mays
  misc_feature: Ceres CLONE 1562970
  misc_feature (10)..(81): Pfam Name: GSHPx Pfam Description: Glutathione peroxidase
  misc_feature: SWISSPROT Homolog: EC 1.11.1.12 Phospholipid-hydroperoxide glutathione peroxidase
MAASSTATSVHDFIVKDASGKDVDLSTYKGKVLLIVNVASQCGLTNSNYTELAQLYEKYKDQGFEILAFPCNQFGGQEAWYQ

SEQ ID NO: 77968 - DNA, 791 bp, Zea mays
  misc_feature: Ceres CLONE 1562974
  misc_feature: Encodes the peptide sequence at SEQ ID NO. 77969
  misc_feature (68)..(68): n is a, c, t, g, unknown, or other
ctcccgcggtggcggccgctctagaactagtggatcccccgggctgcaggaattcgtctcacccctangaaaaaacctagatcgccagtccaccaccgcttcccgtgcagcgccctccctctacgttcccccatttcctgtgttggcggcgatggcgcggcacttcgtgctcaacaccggcgccaagatcccctccgtgaggctcggcacctggcagtctgaccccggcgtcgttgggcacgctgtctacgccgccgtcaagggcggttaccgacatatcgattgtgccagaaagttacggcaacaaaaaggagatgggtttggcgcctgaaaaaactattttgaagagggtgtattgaaaacaagaaaatctgtttttcaccctcctagcctttggaatgatcttcctggcccccgaaaaaagggccctgaaggcctaaatgacaccccccaaaatgaattcccacccttgaaaaccccgggaactttaatcttttcccctggggcccttttttgaggccccaaaaagggggaaaaaattcccccccccccgggaaaaattttgtttaaaccccggaaattccccccccctaatttgggggggggggaaatagaaaaaaaattttttttttgtgggggggggaaacaaccccccccccccttgtgtggggggggaagaaaaaccctcccccccccccaaaaaaaaatataggggggggaaaatattctttttgtgtgaaaaaaaccccgggggaccaccccccccccccggggggtggtgtggggggagg

SEQ ID NO: 77969 - protein, 59 aa, Zea mays
  misc_feature: Ceres CLONE 1562974
  misc_feature: SWISSPROT Homolog: EC 1.1.1.21 Aldehyde reductase
MARHFVLNTGAKIPSVRLGTWQSDPGVVGHAVYAAVKGGYRHIDCARKLRQQKGDGFGA

SEQ ID NO: 77970 - DNA, 786 bp, Zea mays
  misc_feature: Ceres CLONE 1562975
  misc_feature: Encodes the peptide sequence at SEQ ID NO. 77971
ctccccgcggtggcggccgctctagaactagtggatcccccgggctgcaggaattcgtctcacccctagaaaaaacctcggtgacccctcacacttagtactgttagccaggaacaagcccctgcagcagcagccgcattggccgtggagaacggctgcgccgactaggcgtgccgctgtgaccatgaccttgaccggcgcccgcaccgtggcgccggccaagagccgctgcacgctcgccaccttcgacgtcgcctacttccaccttctactactaccctatagctgctcctgttccgcgccgcccccgtacttcccggacgccgtggagcgctggactgccgggctcgccgacgcgctcatcgtcttctagctgctcgccggccgcatccacctggactacggctgcgcgctggctgtctagggctactagggcgccgaggtcttctgagcctgagcccacagtgtcaccatctacaacctcgccggtaggaactgctccgaccatgctgagatagtcttgacgtacctcgtgcccacaccggcgtcgtgcacctgagggacctccacctcccgctttgtcgcagtcacattctccatgctatagtcggtctgggcgatagggtgcgccttcataccagagatgctggacggcagctacccgtgggacttcctgtccccgtggccagagtccgtccagtggtaccactgtctgtgaatacagtctggaactgccaccgtccctttcctgtggcgggaaggttaggggtttccttatccccctag

SEQ ID NO: 77971 - protein, 62 aa, Zea mays
  misc_feature: Ceres CLONE 1562975
MTLTGARTVAPAKSRCTLATFDVAYFHLLLLPYSCSCSAPPPYFPDAVERWTAGLADALIVF

SEQ ID NO: 77972 - DNA, 770 bp, Zea mays
  misc_feature: Ceres CLONE 1562976
  misc_feature: Encodes the peptide sequence at SEQ ID NO. 77973
  misc_feature (528)..(528): n is a, c, t, g, unknown, or other
ctccgcggtggcggccgctctagaactagtggatcccccgggctgcaggaattcgtctcacccctagaaaaatccctaattaagccaaaaggcactgaagccagtcaatagcgagttctagaactagtagatagcctgctgatctgttctgttgtttagttcgcaaagccttctgtttcggcgaccatggaggatgagaggaacacccagcagcaccagggcggtgaggcccagcaggacgctgccggtcaggtggaggtgaaggatagggggctcctggacagccttctcggcaggaagaagcacgacgacgaccaggagaagaagaagcagacggaggagctggcgaccggcatggagaaggtcacggtgtccgagcccgagaagcacgggcacaaggaggaggagcacgaggtcgtcggcgagaagaaggagggccttttcgccaagctgcaccgcaccagttccagctccagctcgtcgagcgacgaggaagaggaggcgatcgatgagaacggcgagattatncagaggaagaagaagaaggtggggcctcaaggagaagatcaagggagaagctgccgggccacaaggacggccaccacacgggccgcaccgttcccgggcgccggcggcccgcgcccgttggagacgcattgcccaccaccaaggaggaagcgcatcacaggcccgcacgttcttcccgggccccggcgccctccacccgcacggtggaaggacgcacgtcccaccagcaccaacccccgggc

SEQ ID NO: 77973 - protein, 194 aa, Zea mays
  misc_feature: Ceres CLONE 1562976
  misc_feature (114)..(114): Xaa is any aa, unknown, or other
MEDERNTQQHQGGEAQQDAAGQVEVKDRGLLDSLLGRKKHDDDQEKKKQTEELATGMEKVTVSEPEKHGHKEEEHEVVGEKKEGLFAKLHRTSSSSSSSSDEEEEAIDENGEIXQRKKKKVGPQGEDQGRSCRATRTATTRAAPFPGAGGPRPLETHCPPPRRKRITGPHVLPGPRRPPPARWKDARPTSTNPR

SEQ ID NO: 77974 - DNA, 723 bp, Zea mays
  misc_feature: Ceres CLONE 1562977
  misc_feature (423)..(423): n is a, c, t, g, unknown, or other
ctcaccgcggtggcggccgctctagaatagtggatcccccgggctgcaggaattcgtctcacccctagaaaaaatccgtccaatcaaccggggctgctctgctgcctctccggcgccattgacgagcaagagagtgctccgacacctggtccgtcgcgtgccgtgcccacccgctaaggccagggcgccccgactcgagctcaccgcgtcgaactcgaaccgctgctgttcctcggcagggggcagggtcgtcgaggatgccggagcactcagagaacgcggcggcggacctgatgggcaacatcatgggagacccatcgcggaagaaaccctcccccaagggccaaaaaaagtccccgtgggcggggtttttcaaaaaaaaaagggggggaaaagggggtccccccccccccactttccccnaaaaaaaggggggcccaaaaaaatttttttttccccgcgggggaaaaaaaaaaaaaaaaaattggcccccccccccggggtgggggggggggggaaaaatcccccacaaaatttgttttttgggggggggaaaaaaaaaaaaaaatttccccccccccggggtggggggggggggggcggacacccaaaagggggggggggggtggttttttttcccttgggggggggggggggggacacacaaaaatttttttttttcaccccccccccgttttttttttttggtgggggggggggggc

SEQ ID NO: 77975 - DNA, 825 bp, Zea mays
  misc_feature: Ceres CLONE 1562978
  misc_feature: Encodes the peptide sequence at SEQ ID NO. 77976
  misc_feature (590)..(590): n is a, c, t, g, unknown, or other
  misc_feature (591)..(591): n is a, c, t, g, unknown, or other
  misc_feature (600)..(600): n is a, c, t, g, unknown, or other
  misc_feature (610)..(610): n is a, c, t, g, unknown, or other
  misc_feature (641)..(641): n is a, c, t, g, unknown, or other
  misc_feature (642)..(642): n is a, c, t, g, unknown, or other
  misc_feature (649)..(649): n is a, c, t, g, unknown, or other
  misc_feature (657)..(657): n is a, c, t, g, unknown, or other
ctccccgcggtggcggccgctctagaactagtggatcccccgggctgcaggaattcgtctcacccctagaaaaaccttagcttgggcaggtcctcctccctagctagctagctcgcacgccaccatgcagctcgcggcgttgtgcactgaccccgtggtgctgtgcagcgccttcctctgcctcctcctccacgtggctctccgctcgctgctgcaccctccttctgccgcctcttcctccgggcgccgcgggcagctcccgccggggccaccgggcctgccgatcctcggcgcgctgccactcgtgggcccagccccgcacgccggcctggccgcgctggcgcgcaagtacggtcccatcatgtacctgaagatgggcacggccggcgtggtggtggcgtcgtccccgcgcgcggcgcggacgttcctcaaggcgctggacgcgcggtacgccaaccggccggccgtggcgagcgccgcggacatcacgtacgggcggcagaacatggtgttcgcggactacgggcccaagtggaagctgatgcggaagctcgccagcggcacctggcctcgggggcgcgcgcgctccnngaacttggncgtgcgtgcngcgcggcgaggccagccacgtgctgcacggnnttggggngaaaggcnggcgggcggccggcaaggccccgtcgtccgtgccaggaacctgcttcgtggtgcggccctccgcccaacatcggtcggggcaagatcacagtggaaccaaaagcggggtggtttcgaacgcccccagggggggaacgaactccgaacaagataccaagggggaccttg

SEQ ID NO: 77976 - protein, 233 aa, Zea mays
  misc_feature: Ceres CLONE 1562978
  misc_feature: SWISSPROT Homolog: EC 1.14.13.88 Flavonoid 3',5'-hydroxylase
  misc_feature (156)..(156): Xaa is any aa, unknown, or other
  misc_feature (159)..(159): Xaa is any aa, unknown, or other
  misc_feature (173)..(173): Xaa is any aa, unknown, or other
  misc_feature (178)..(178): Xaa is any aa, unknown, or other
MQLAALCTDPVVLCSAFLCLLLHVALRSLLHPPSAASSSGRRGQLPPGPPGLPILGALPLVGPAPHAGLAALARKYGPIMYLKMGTAGVVVASSPRAARTFLKALDARYANRPAVASAADITYGRQNMVFADYGPKWKLMRKLASGTWPRGRARSXNLXVRAARRGQPRAARXWGERXAGGRQGPVVRARNLLRGAALRPTSVGARSQWNQKRGGFERPQGGNELRTRYQGGP

SEQ ID NO: 77977 - DNA, 800 bp, Zea mays
  misc_feature: Ceres CLONE 1562979
  misc_feature: Encodes the peptide sequence at SEQ ID NO. 77978
  misc_feature (572)..(572): n is a, c, t, g, unknown, or other
  misc_feature (661)..(661): n is a, c, t, g, unknown, or other
ctccccgcggtggcggccgctctagaactagtggatcccccgggctgcaggaattcgtctcacccctagaaaaaaggttaaagcgacgccgccgccgcaagccgtccgccttgcccttcacgaaggcttggtcctcctccttgtatctccactccccccttcacagatccgttcctccagctagggttagcgttcctctgcagcgatggcgatcaagcggactaaggcggagaagaagatcgcgtacgacaagaagctgtgcagcctgctcgatgagtacaccaaggtgctcatcgccctggccgacaacgtcggttccaagcagctccaggacatccgccggggcctcaggggcgactcggtggtgctcatggggaagaacacgctcatcaggcgttgcatcaaggtgtacgccgagaagaccggtaaccacacctttgacccgctcatggacctcctggtcggcaacgtaggcctcatcttcaccaagggagacctcaaggaggtgcgcgaggaggtcgccaagtacaaggtgggggctcctgctcgtgttggtctggttgctccagttngatgttgttgtgccccctggcaacactggggctggatccgtcccagacctcttttcttcaggtgcttaacatccccaccaagattaacnaagggtaccgtgggaaattatcaccccctgtggagctgatcaagagggggtgaaaaaggtgggctcgtcccgagtctgccctgctcggcaaagcctgggtatccggccccctttctcgtacggccttccaggtcaccaa

SEQ ID NO: 77978 - protein, 164 aa, Zea mays
  misc_feature: Ceres CLONE 1562979
  misc_feature (6)..(110): Pfam Name: Ribosomal_L10 Pfam Description: Ribosomal protein L10
  misc_feature: SWISSPROT Homolog: EC 4.2.99.18 DNA-(apurinic or apyrimidinic site) lyase
  misc_feature (123)..(123): Xaa is any aa, unknown, or other
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEVREEVAKYKVGAPARVGLVAPVXCCCAPWQHWGWIRPRPLFFRCLTSPPRLTKGTVGNYHPLWS

SEQ ID NO: 77979 - DNA, 780 bp, Zea mays
  misc_feature: Ceres CLONE 1562980
  misc_feature: Translation starting site: 317
  misc_feature: SWISSPROT Homolog: EC 2.5.1.16 Spermidine synthase
  misc_feature (637)..(637): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
ctccccgcggtggcggccgctctagaactagtggatcccccgggctgcaggaattcgtctcacccctagaaaaagtttttcgccgccttttacttatcccatcttccctcgactgcgctctctctcccccttctctcgcgcggcaactgggccatcgccgccacccctacccaggtcttcgtcggtcgcttcgccagccgccaggtcttcgtcggcccatcccccggtcttcgtccttcaatcctccggcgacgagcacccaccagaggctgggaactccaaagaggaacagggtccatggctggaggcgcaggaaatggttcgaacgaggcggtgcaggcaaaggggaagtgggggtgatagctccgccgccaagccgctgcccccttgctgcgtcaaggcgagagcggcggcgcccgagtctgaggccaagtgccatgccaccgtggtttcgggatggttcaccgagccacgatcacactgcggtaaagccagcaaggttcagtattacaataacccaatgtggccaggagaggcccattccttgaaagtggagaacatattgtaccaggggaaatcaccataccaaggaagtcctggtctttgagtcgtcaacctatggggaaaagtcttgtgncttgatggtattgttcaattgactgataaggaatgaatgtgcgtaccaggaaatgattactcacctcccactctgttcaattcatcccctaaaaagctctgttatagtgtggggnnnnnaaaaaagaggttttcctcccaaaa

SEQ ID NO: 77980 - DNA, 760 bp, Zea mays
  misc_feature: Ceres CLONE 1562981
  misc_feature: Encodes the peptide sequence at SEQ ID NO. 77981
  misc_feature (371)..(371): n is a, c, t, g, unknown, or other
  misc_feature (738)..(738): n is a, c, t, g, unknown, or other
tggagctcaccgcggtggcggccgctctagaactagtggatcccccgggctgcaggaattcgtctcacccctagaaaaaatataaaacaggcgcagcgcaggagtaccctgcgtccctgccttcagcggctcagccccttctcctctcccaccccgcgcctcgccggagctcggccgccgcctccgccgccgctgtccggttccgcagcagcagacaccgacgcgtccgcacatccgtggaatgccctcagatacgccgccccgcgctgcgtcttcctgagggctcaggccgagaggctccgacgccgccgaaggccgaacccgtgcatcccacgggtccggaggaggagtaagggaagtagcggctgctncggcggccgctgaggaggatactaaggggatggggaccgcgatgggggctggcccgcgtgcggcgggaggcgctcgccgcgtgcatgacgtgcccgctttgccggggacttctcagggaggccaccgccataaccgtgtgcctccacacatttttgtcgggagtgcattttggagaaaataatgatgaggaaattgactgctgcccagtatgcaacattgatcttgggctgcgatcctgaagagaaactcaggcctgaccacaaccctgcagatatcagaaaataggtatttcccataaaaaagttaaatggtgattctccaaagctctaaacacattgccagcaaagagaaacagaggtcatttcntccctggtgggtgaacccccaa

SEQ ID NO: 77981 - protein, 51 aa, Zea mays
  misc_feature: Ceres CLONE 1562981
MTCPLCRGLLREATAITVCLHTFLSGVHFGENNDEEIDCCPVCNIDLGLRS

SEQ ID NO: 77982 - DNA, 891 bp, Zea mays
  misc_feature: Ceres CLONE 1562983
  misc_feature: Encodes the peptide sequence at SEQ ID NO. 77983
  misc_feature (10)..(10): n is a, c, t, g, unknown, or other
  misc_feature (11)..(11): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (447)..(447): n is a, c, t, g, unknown, or other
  misc_feature (473)..(473): n is a, c, t, g, unknown, or other
gggggggggnnggggggnnnnnnnnnnnnnnnnnnnnnnnnnnnnnnnngnngnnnnnnnnnnnnnnnnnnnnnnnnnnnntaaaagctggagctccccccggtggcggccgctctagaactagtggatcccccgggctgcaggaattcgtctcacccctagaaaaaagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacngctggggacaccgcccgggctgtccngccgaccccgaagaccttcgccaagaaccgcgagctgggaggtgatccactccccgctggggccatgctccggggcgcctcgggtgcttcttcccccggagctgctcttccccgaaaagggggttaaaatttcggcaaaagcccttctgggtttcaaaggccgggctccccaaaatttttaaacaaaagggcggggcttggaaaaaacctgggggaaaccccccaggccggatttcccagggccaaaagaaaatcccccccccaacctggggggcccttcccaagggttttggctccattgtggggccccccctccaaaagggggataccccttttttttccccgggggggggcccccccttgggggaaaaggggtttttcaaaacaccccccggttgttaacccccgcggggggggg

SEQ ID NO: 77983 - protein, 97 aa, Zea mays
  misc_feature: Ceres CLONE 1562983
  misc_feature (75)..(75): Xaa is any aa, unknown, or other
MAASTMAISSTAMAGTPIKVGSFGEGRITMRKTVGKPKVAASGSPWYGPDRVKYLGPFSGEPPSYLTGEFPGDYXWGHRPGCPADPEDLRQEPRAGR

SEQ ID NO: 77984 - DNA, 798 bp, Zea mays
  misc_feature: Ceres CLONE 1562984
  misc_feature: Encodes the peptide sequence at SEQ ID NO. 77985
  misc_feature (635)..(635): n is a, c, t, g, unknown, or other
  misc_feature (722)..(722): n is a, c, t, g, unknown, or other
  misc_feature (731)..(731): n is a, c, t, g, unknown, or other
  misc_feature (796)..(796): n is a, c, t, g, unknown, or other
ctggagctcaccgcggtggcggccgctctagaactagtggatcccccgggctgcaggaattcgtctcacccctagaaaaaaattacgacacgcctgccgccgccacgccgcccgaaatccggaggggaagctcctcgacgacgtagcggccagtggcagctcggacgatggcctcgtccaactccgccgccccggctcccgccgacgggggcgacgacctcgaccagctcctcgacagcgcgctcgacgacttcaccaacctcgatctctctgcctctgccgcccccaaaagctccggcgaggcatcggggtcaggatcgggaggcaaggggccagtgaaggggctggggctggggcttccggaccccaaggcgccgaagcggcgcgcggggaagcagccgccgccgaggggcgcgtgcgccaaagaggcgctcgaggagctgacgcgcgagacgcgggaggctgtgcgcggtctcgagacggccactgggagtgtcccgtcactggacgatgacgccatgatggaggagtttgtcaagcagttccaggagttcgcaggggcacaggatatggactccattgttgaaacaatgatgcagcaacttctgtccaaggagattcttcatgagcccatnaaggacattgtaagaaagtatccaaaatgggctggggaagataataaagattagataagccaaagaggaaattttgggcgtttatantaaatcagnctgggaacctcatgggtggaagccttaattgaggtctatgggaaaatgatccttgagaaacttgnac

SEQ ID NO: 77985 - protein, 173 aa, Zea mays
  misc_feature: Ceres CLONE 1562984
  misc_feature (156)..(156): Xaa is any aa, unknown, or other
MASSNSAAPAPADGGDDLDQLLDSALDDFTNLDLSASAAPKSSGEASGSGSGGKGPVKGLGLGLPDPKAPKRRAGKQPPPRGACAKEALEELTRETREAVRGLETATGSVPSLDDDAMMEEFVKQFQEFAGAQDMDSIVETMMQQLLSKEILHEPXKDIVRKYPKWAGEDNKD

SEQ ID NO: 77986 - DNA, 822 bp, Zea mays
  misc_feature: Ceres CLONE 1562985
  misc_feature: Encodes the peptide sequence at SEQ ID NO. 77987
  misc_feature (581)..(581): n is a, c, t, g, unknown, or other
ctccccgcggtggcggccgctctagaactagtggatcccccgggctgcaggaattcgtctcacccctagaaaaaaatccaacgaactgaccacaaccacctaagctaaaagctaaccaccagacccccggccatggcgctcgcgcccacttccgctgccgtgctcaagaccccgttcctcggggccaggcgcgcgctcgccaatgccgccgccaagcccgcgcctcgccgcgcgctggtcgtcgccgccgcggccgccgccaagaagtcgtggatcccggccatcaagagcgacgccgagatcgtgaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatgggggttgggtggagtcaaancgggtgggtggacttcttcaacccggaactccaggcccgtggagtgggccacgccatggtcccgcaccgccgagaacttcgctaacttcaccggcgagcagggctaccctgtcggcaagtcttcgacccgctcggcctcgtcggaacgtcaaagacggcgtctacatccccgacgtcgacaagctcgagcggctcaagctggccgagatcaagcacggcggcatcgccatgcttgccatgc

SEQ ID NO: 77987 - protein, 177 aa, Zea mays
  misc_feature: Ceres CLONE 1562985
  misc_feature (58)..(168): Pfam Name: Chloroa_b-bind Pfam Description: Chlorophyll A-B binding protein
  misc_feature (150)..(150): Xaa is any aa, unknown, or other
MALAPTSAAVLKTPFLGARRALANAAAKPAPRRALVVAAAAAAKKSWIPAIKSDAEIVNPPWLDGSLPGDFGFDPLGLGKDPAFLKWYREAELIHGRWAMAAVLGIFVGQAWSGIPWFEAGADPSAIAPFSFGSLLGTQLLLMGVGWSQXGWVDFFNPELQARGVGHAMVPHRRELR

SEQ ID NO: 77988 - DNA, 788 bp, Zea mays
  misc_feature: Ceres CLONE 1562986
  misc_feature: Translation starting site: 249
  misc_feature (583)..(583): n is a, c, t, g, unknown, or other
  misc_feature (593)..(593): n is a, c, t, g, unknown, or other
ctccccgcggtggcggccgctctagaactagtggatcccccgggctgcaggaattcgtctcacccctagaaaaatctctcccttccctcttctctctcccctcaactctcctcattcttcgcaggctgagcagcaaccgccccaatctgcagttcaagaaccgcccacgcagaacccctccgccctccgctccttccaacttgctctctacctgcaccagcctcgcccacccttcgctcgccgccgccatggggaggggaaagttcaagggaaagcccaccggccgccacagcgtctccacaccagaggagatcggtaacgacgcgcccgcccgccccatggtcccatttataggtcgaattcgatttcatatctggagcgtgccacagcgagcctagacgactgcttgatctgatgatttcaatgtgagctagttctgggacggggtttgcgtgatcgagcagaactcaaaccatttatttagtagcttgtcgcgagttgtcatttaaagtccctgtttttaagtctgtgctacgaaggttccatgggaatcattcgatgcttgggagaaacgatgatttgntccatctagntggtccaatttaaaggctcaatgataaagctcctttagaagcctaatacaagaaaataaatgctaccacttagctttctttttttcctaaatttccaacgggggggaaaaatggccaaaataaattgccccacctttatttggggcttggtttccgaaaaacttttaccccctaaaaaaatggcaactggctggt

SEQ ID NO: 77989 - DNA, 835 bp, Zea mays
  misc_feature: Ceres CLONE 1562987
  misc_feature: Encodes the peptide sequence at SEQ ID NO. 77990
  misc_feature (607)..(607): n is a, c, t, g, unknown, or other
  misc_feature (622)..(622): n is a, c, t, g, unknown, or other
  misc_feature (700)..(700): n is a, c, t, g, unknown, or other
  misc_feature (704)..(704): n is a, c, t, g, unknown, or other
  misc_feature (706)..(706): n is a, c, t, g, unknown, or other
agctccccgcggtggcggccgctctagaactagtggatcccccgggctgcaggaattcgtctcacccctagaaaaaagccgcctcatcctctagccgatctccttttttgtcgcctccgtgcgtgccccgggggccttgatcgcgcgcaccggtcagctcagcccgtctgattcgcgtgctgccagccctccgccgatcgtgaaacacaaccgtcggtggtttgcttgcttgatcgctgatcctcgcggacgctcacggtcatggcgcctcagcctttgcgcgctccgaggctgagcgcccccgctggccacgcggcgtgcaggtgctcggccgcgccgctattcgggaagcgggcgccccccgtcgtcgcgttcccccgcgcccgtagcggcggcgccgtcgcctcgtgctcggccgtgcaggagtcgtccacctccaccactgttagcaagaagaaggatgccgcggacggggccaaggaggccacagcggaggcggcgaagccggccgcggccgccaagccaaagaaggccgcggcgctgccgctgccggagatgatgcagcaggagatcatcccaccgctgaaggatgccttggaggcgggangacgacgtgtcccangtgcagctcgccttcaaaacacacggctggagggatcccttcataagaacgacgtccccttattattttttgggcttncttncnaaaggagacctcacaggaccgaaggctttggcgctatcgtccctacagcacgaagtgagcaccatcgagccctgtcctgatcgatgaagagagataacggcccaagtacctgggggggtctgggtctac

SEQ ID NO: 77990 - protein, 174 aa, Zea mays
  misc_feature: Ceres CLONE 1562987
  misc_feature (116)..(116): Xaa is any aa, unknown, or other
  misc_feature (121)..(121): Xaa is any aa, unknown, or other
  misc_feature (147)..(147): Xaa is any aa, unknown, or other
  misc_feature (148)..(148): Xaa is any aa, unknown, or other
  misc_feature (149)..(149): Xaa is any aa, unknown, or other
MAPQPLRAPRLSAPAGHAACRCSAAPLFGKRAPPVVAFPRARSGGAVASCSAVQESSTSTTVSKKKDAADGAKEATAEAAKPAAAAKPKKAAALPLPEMMQQEIIPPLKDALEAGXRRVPXAARLQNTRLEGSLHKNDVPLLFFGLXXXRRPHRTEGFGAIVPTARSEHHRALS

SEQ ID NO: 77991 - DNA, 786 bp, Zea mays
  misc_feature: Ceres CLONE 1562988
  misc_feature: Encodes the peptide sequence at SEQ ID NO. 77992
ctccccgcggtggcggccgctctagaactagtggatcccccgggctgcaggaattcgtctcacccctagaaaaaatcgaaacaaaccctccgtctccaaaagagagcccaatcctaaattcccaatccctcaaaggaaggaggattcttcagcgtctcgcttgccggccccgaatcgcagtcgccgcccggatccgaggaaacaagtcgtcgtcttgctccaccgtccgcccgccgccatgagcttcatcttcggcaagaagaagactcctgctgagctgctgcgggagaacaagcggatgctggacaagtccatccgggagattgagagggagaggcagggcctgcagacccaggagaagaagctcatcaacgagatcaagaaggtggccaagcaaggtcagatgggagctgtaaaaattatggcaaaggatcttatccgcacgagacaccaaatcacaaaattctatgcactcaagtcccagctacaaagtgtatctctacgtattcagactctgaaatcaacacaagccatgggtgaagccatgaagggtgtgacaaaagccatggggcagatgaaccgacagatgaatctgcctgccctgcagaaatcatgcgggcagtttgagatgcacaacgagaagatggagatgggttagtgaagtgatgaacgacaccttcgatgatgcctttggaggcgatgaggacgacgagagacagaggactggtttagtcaagtccctgtacgaattggcatcgatatcgactcagagcttgtcaggctccc

SEQ ID NO: 77992 - protein, 139 aa, Zea mays
  misc_feature: Ceres CLONE 1562988
  misc_feature (17)..(139): Pfam Name: Snf7 Pfam Description: Snf7
MSFIFGKKKTPAELLRENKRMLDKSIREIERERQGLQTQEKKLINEIKKVAKQGQMGAVKIMAKDLIRTRHQITKFYALKSQLQSVSLRIQTLKSTQAMGEAMKGVTKAMGQMNRQMNLPALQKSCGQFEMHNEKMEMG

SEQ ID NO: 77993 - DNA, 842 bp, Zea mays
  misc_feature: Ceres CLONE 1562991
  misc_feature: Translation starting site: 167
  misc_feature (462)..(462): n is a, c, t, g, unknown, or other
ctccccgcggtggcggccgctctagaactagtggatcccccgggctgcaggaattcgtctcacccctagaaaaagcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatgggctcgacccgctggggcctctcgaacccggagggcaccggggggcttcatcgaagcccagtggctgggctatggcgaagtgatcaacggncgctaccccatgctggggcgcgtggggcgccctcgccccccgaaaaccttccgcaaagatgggcattcatcccccccggaaacccggccctgcccttggtttaaagaagggggggttattcccgccccggggggaaccttaaaaaatacggggggccgaaatccctaaaaggcctctttgttttttaaaaatggggggcctatggggggttttcccccaaaaaccccgcccccccccccgaggaattggggaaaaacccccggggttcccctggggaaaaacaataacttcccccccggccccccaaaaaaatttcctcccccgggggcccgggggaaaccctcttcttaaacccccgggggggggccccctcttttaaa

SEQ ID NO: 77994 - DNA, 747 bp, Zea mays
  misc_feature: Ceres CLONE 1562994
  misc_feature: Translation starting site: 167
  misc_feature (626)..(626): n is a, c, t, g, unknown, or other
ctctccgcggtggcggccgctctagaactagtggatcccccgggctgcaggaattcgtctcacccctagaaaaactctctgtctctctaggttttttgattttagccgccgccgctgctcatctcacatccctcgagaatacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaggaagtggtaaatcctccgtccttatggatgtcaaaccatgggacgatgagactgatatgaagaagctggaggaagctgtccncagtgtccagaatggagggcctgacttggggagcatcaaagctttgtgcctggtgggatacggcttcaagaaaatgactatcatggttgacaattggccaacaaactttgggtccatccct

SEQ ID NO: 77995 - DNA, 805 bp, Zea mays
  misc_feature: Ceres CLONE 1562995
  misc_feature: Encodes the peptide sequence at SEQ ID NO. 77996
ctccccgcggtggcggccgctctagaactagtggatcccccgggctgcaggaattcgtctcacccctagaaaaaatcagaggaagcacaaagcaccaccatcgccatgagatgagagccaagcagagtagtagagagagaagaacaggggttagccgcgtcgtcgtgcgaactctggtcgtgcatgcagaagatgtccatggccttttcgtgagcaaacagagacgagagggccgaagattccttgccggtcactgacctcagcaaagctcgtagccataagccgctatgaccagctcatcgaaattcgagttccctctcgaactctaccgataacttcgacaacgaggttacaagtcacctaaagagcaagttggtacgtggaatctcaagtcccaggcaagttgtgcccttgatcacttctttttatccaatcatgctcttattaatcataatgatctgcataggttaattttgatgggacccaataggttaccctagtttgactatctttataccttgtttaccactgaattttttggtagtacctctagaaaaagctttgctatatgtggttttggggtatagaggtacacattattcatgatcctacttacattatcaatttgatatttactatgcatgataagatcattatgttaattggaacatggagaacacccgggaaacagtgctaccacgagggtggtatgggacgcccttggctgactaattatgaaagctagtgggagactaccttacccaaagggacagggccagtaggggagtgtccattattagaagtc

SEQ ID NO: 77996 - protein, 48 aa, Zea mays; identical to SEQ ID NO: 77553
  misc_feature: Ceres CLONE 1562995

SEQ ID NO: 77997 - DNA, 826 bp, Zea mays
  misc_feature: Ceres CLONE 1562998
  misc_feature: Encodes the peptide sequence at SEQ ID NO. 77998
  misc_feature (701)..(701): n is a, c, t, g, unknown, or other
  misc_feature (801)..(801): n is a, c, t, g, unknown, or other
  misc_feature (816)..(816): n is a, c, t, g, unknown, or other
ctccccgcggtggcggccgctctagaactagtggatcccccgggctgcaggaattcgtctcacccctagaaaaaccccaattcgaacgacggagcacgacgcacgcagagccgcacagatccgtcacactgcaagttttgaaaactgaactgtaagatggcatcagcagagctttcccgtgaggaaaatgtgtacatggcgaagctcgccgagcatgcagagaggtacgaggaaatggttgagttcatggagaaggtagcaaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcatgatgaagggtgactactacagataccttgctgagttcaagactggagctgagagaaaggacgctgctgagaacaccatggtggcatacaatgctgcccaggacattgctttggctgagcttgatccaactcaccctattaagcttggactggcacgcancttcgcagagttctactatgagatgctcaaatacccgatcgcgcctgcagtcttgcaaagcaagctttttgacgagcccatctcggactggacaccctgnacgaggagtcctacnaggaacgcct

SEQ ID NO: 77998 - protein, 223 aa, Zea mays
  misc_feature: Ceres CLONE 1562998
  misc_feature (8)..(220): Pfam Name: 14-3-3 Pfam Description: 14-3-3 protein
  misc_feature (182)..(182): Xaa is any aa, unknown, or other
  misc_feature (215)..(215): Xaa is any aa, unknown, or other
MASAELSREENVYMAKLAEHAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLMMKGDYYRYLAEFKTGAERKDAAENTMVAYNAAQDIALAELDPTHPIKLGLARXFAEFYYEMLKYPIAPAVLQSKLFDEPISDWTPXTRSPTRNA

SEQ ID NO: 77999 - DNA, 821 bp, Zea mays
  misc_feature: Ceres CLONE 1563000
tggagctcaccgcggtggcggccgctctagaactagtggatcccccgggctgcaggaattcgtctcacccctagaaaaaagcatctcaaggcaccatctaccttcaagtctcgctacgtatcattgcaataaaaaaagcagccgcaatggcgagcagcaccatggccctctcctccacggccttccccggctaggccgtgaacgtgccgtcgtcgtccgccttccgcgaggcccgcgtgacgatgcgcaagaccgcggctaacgccaagccaacgcccgcgtccgaggagcccgtggtactgcccccaccgcctgctgtacctgggcccactgtccggcgagccaccgagctacctgacgggcgagttcccgggccactacgactagcacaacaaccggctgtcggcggacccggagacgttcgccaacaaccgggagctggaggtgatccactcccgctgggtcatgctggacgcgctcagctgcgtcttccccaagctgctcgcccgcaactacgacaacttcggctaggacttgtggttcaaggcctgctcccagatcttcagcgagggcgggctggactacctcgtgaacaccagcctcatgcacgcgcagagcatccttgctatctgggactgccacgtcgtgctcatgagcgccgtctagggctacagcattgccggtagcccggtaggggaagtcatcgactcactctatcgcggacgcagatgcgaccgataagactctcccaacaccccgagggcctagccgaagcttacgtggatgtactatacaccgacccctccccatgttctccatgt

SEQ ID NO: 78000 - DNA, 787 bp, Zea mays
  misc_feature: Ceres CLONE 1563001
  misc_feature: Encodes the peptide sequence at SEQ ID NO. 78001
  misc_feature (719)..(719): n is a, c, t, g, unknown, or other
  misc_feature (773)..(773): n is a, c, t, g, unknown, or other
ggagctcaccgcggtggcggccgctctagaactagtggatcccccgggctgcaggaattcgtctcacccctagaaaaaaacgcgtctctctgtaaaccacagtccacagccaccaagatcgccgcgctctctccaacatctcctgaccaaagcgaatccagcatcaccggggtccaggaggcagcatggctgacgaccagcagccaccggcgcaacggtactggttcccgtactggaccgcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccagaggcgctggcggtggtgtccctgatccacctgcccagccgcagcccacgcggctgtccagcaggccatcgccgtcgccttcccgcgctcagccactgtcgcccattagagagcccaacgcttcaccggcaccggttgccaaagagcacaagcagccttctcctcttcatcatgaccgagcatggtgttcctaagcaaaaagacatcaccgttccgcaagagaaaaccatcccatgaaccgcttgtagcatccaagacacaaacaaagaccccagagaaagaaaaagacatgtaaaagggaaaggagaaggagaaggaaggcagccagctgcacaaggaaaaagatnaggagaagaaaagacaggagaaggaaaggaaatagataggaggaaggaggatcntaaaggataagaaa

SEQ ID NO: 78001 - protein, 126 aa, Zea mays
  misc_feature: Ceres CLONE 1563001
MADDQQPPAQRYWFPYWTAPAPRPVARPQLSRRETRPAPSPPATASPSRRPSHPQQAATPASRGAGGGVPDPPAQPQPTRLSSRPSPSPSRAQPLSPIREPNASPAPVAKEHKQPSPLHHDRAWCS

SEQ ID NO: 78002 - DNA, 767 bp, Zea mays
  misc_feature: Ceres CLONE 1563003
  misc_feature: Encodes the peptide sequence at SEQ ID NO. 78003
ggagctcaccgcggtggcggccgctctagaactagtggatcccccgggctgcaggaattcgtctcacccctagaaaaaatatggctgaacccaagtcaaataatggcggggcggacgcgacggcatcgatgatgctccacggccgcgtagccattgtcaccggtggtgccggcggcatcggctcggccgtgtcgaagcacctgtcgtcgctcggcgcgcgcgtcgtggtggggtacatcggcgacccggcacctgctctgacgctggtagccgccatcaactcctccgagcaccccggcgagagccagcagccgcgagccatcgcggtcgaggcggacgtgtccgacgcggcagccgtgaaggcgctgttcgacgcggccgccgcagccttcggcggggagctccacatcctggtaacgttggcggcggtgctggactactcctacccgccgctggcggagaccagcgaggcgacgttcgacgccgccttcagcgtcaacacacggggcaccttcctgtgctgccgcgagcggccaggcggctgggtgcgtgacggccgcggccgaatcgtgacgttctcttcgtcggggagttgggtctctgcgccctggctactcggcatacgcagcaagcaaggccgcggtgggaagtgaatgactaaaaatccgggcgcgcgagctgcgcgggcacggggatcacgggcccacggtgggtggcccccagggtccacggggtacccccccttgatgtacaccgggcaggacgga

SEQ ID NO: 78003 - protein, 190 aa, Zea mays
  misc_feature: Ceres CLONE 1563003
  misc_feature (22)..(187): Pfam Name: adh_short Pfam Description: short chain dehydrogenase
MAEPKSNNGGADATASMMLHGRVAIVTGGAGGIGSAVSKHLSSLGARVVVGYIGDPAPALTLVAAINSSEHPGESQQPRAIAVEADVSDAAAVKALFDAAAAAFGGELHILVTLAAVLDYSYPPLAETSEATFDAAFSVNTRGTFLCCRERPGGWVRDGRGRIVTFSSSGSWVSAPWLLGIRSKQGRGGK

SEQ ID NO: 78004 - DNA, 919 bp, Zea mays
  misc_feature: Ceres CLONE 1563004
  misc_feature: Encodes the peptide sequence at SEQ ID NO. 78005
  misc_feature (393)..(393): n is a, c, t, g, unknown, or other
  misc_feature (400)..(400): n is a, c, t, g, unknown, or other
ctcaccgcggtggcggccgctctagaactagtggatcccccgggctgcaggaattcgtctcacccctagaaaaaggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgaccccgctgggcctctcngaccccngaaggcacccgggggcttcatcgagcccaagttggctggccctatggggaggggaataaagggcccgctaacccctgcttggggcggggggggcgcccatcccccccggaaattttccggcaaaaatggcaattttcccccccgggaaacccccccttccctgggtttaaaaaaaggggtttttcccccccccggggggactcttaaaaaatgggggggcaaaaccccaacaccccttttttttttttaaaaaaggggcgcctagggggtttcccaaaaaaaacccccccccccctagaaggggtggaacaccccccgggccctgggggggaaaaaaaaattttcccccgcccccacaaaaaaattttcgcggggggcgggggggaaaccacctcataccccggggggggccgccccttttaaacacattgtgtttgttgaaaaaaaaaaaaaaaaaagaaaaagataaccccccccccccaagggaaaaaaaaagaaggggggggcctccctccctcc

SEQ ID NO: 78005 - protein, 161 aa, Zea mays
  misc_feature: Ceres CLONE 1563004
  misc_feature (77)..(77): Xaa is any aa, unknown, or other
  misc_feature (79)..(79): Xaa is any aa, unknown, or other
MAAQALLSGRQLLGRPVQSAVSRSSARKAPFVVRASSSPPAKQGADRQLWFASKQSLSYLDGTLPGDYGFDPAGPLXPXKAPGGFIEPKLAGPMGRGIKGPLTPAWGGGGAHPPRKFSGKNGNFPPRETPPSLGLKKGVFPPPGGTLKKWGGKTPTPLFFF

SEQ ID NO: 78006 - DNA, 838 bp, Zea mays
  misc_feature: Ceres CLONE 1563005
  misc_feature: Encodes the peptide sequence at SEQ ID NO. 78007
ccccgcggtggcggccgctctagaactagtggatcccccgggctgcaggaattcgtctcacccctagaaaaactcaaaccagagcgaggccgcactgcccgcgagtcctccactctgaccgcacgatggctgcgctgcgcctcgcctccttcaccctccgccccgccgctgcctcggcctccgcctcctccggcgcgaccccagccgcgtccggctccgtctccgtctccttcgcccgcgcggcgcgggggctgccctccctccgcctggccccgccccgccgccgcggggacctcgccaggccccgcgccgcggccgaggccgcggcggagagctacgcgtccgcgctgtcggaggtggccgtcgagaacggcaccctcgagcagacggtctccgacctggagaaactggagaaggtcttcgcgggacgaggccgtcccccgagttcttcgacaacccccacccgtcccgcgcggaggaagaaggccgaacctcattcgacgaaaatcccccaggttcgctccaagcttgcaggcccccacgtccttcaaatttcctccaaacgttcgtcggtcgaaaaccttccggggggggcccatcggggcccccaaaaaccttcccccccaagttccgaaaaaagttcttaaaaaaatcggcttcaagggggacccccaagggttccccaacccggtcacccccccggttcggtggcaactcccgaaacccccacaggaaccctggggccaaaaaaccgcgccgccgccccagtccccaaaataatataacccggggtcccccataaaaagtttccccaatacaaagaaaacccagtctctgc

SEQ ID NO: 78007 - protein, 173 aa, Zea mays
  misc_feature: Ceres CLONE 1563005
  misc_feature: SWISSPROT Homolog: EC 3.6.3.14 H(+)-transporting two-sector ATPase
MAALRLASFTLRPAAASASASSGATPAASGSVSVSFARAARGLPSLRLAPPRRRGDLARPRAAAEAAAESYASALSEVAVENGTLEQTVSDLEKLEKVFAGRGRPPSSSTTPTRPARRKKAEPHSTKIPQVRSKLAGPHVLQISSKRSSVENLPGGAHRGPQKPSPPSSEKSS

SEQ ID NO: 78008 - DNA, 838 bp, Zea mays
  misc_feature: Ceres CLONE 1563006
  misc_feature: Encodes the peptide sequence at SEQ ID NO. 78009
ctccccgcggtggcggccgctctagaactagtggatcccccgggctgcaggaattcgtctcacccctagaaaaaacacccccattccccacttgcctccgccggcgcatccctaaaccccagtttagggtttctcgcgcggcgctccgctccccgccctcctccgctccgcgcccgatcgcctcttcctctacctcctcaaagcttcgactgttccacacccccacccatatcaacccctttcccctttagctccctcccaccgatacgcccgccgcgtgaagcattcgttagccgagccgccgcaaccatgtcgtcgttctggggtgtggaagtgaagcccgggaagccctacactctcacccatggcgacttcgccggccgcctgcgcctcacccaggcgacgctaggggttgaggtcggcaagggggagaaggctaccggcgtgaagaggtgtgtgctacagtgcagtgccgagaacagagatcccgtttttctttgcgtcctcatgccggagcagtcggagacatgccacctggagctagaatttgaggaggaagtcaccttctcagtgattgggccaaggagcatccacctcgctggatactacatgactgatgtgtgtggggaagatagtggtgacagtgattctgggagcgattcacttcaaaagtcagatgaggatgggtttctggaagaagacgatgatggtaacatggttatgggatattcagacggtggagatgatgattccgagtctgatgaatgagagatggcatacaatcaggttaggggcaaaaagttcagttggttatggaagaaaatggaagaggatgaac

SEQ ID NO: 78009 - protein, 152 aa, Zea mays
  misc_feature: Ceres CLONE 1563006
MSSFWGVEVKPGKPYTLTHGDFAGRLRLTQATLGVEVGKGEKATGVKRCVLQCSAENRDPVFLCVLMPEQSETCHLELEFEEEVTFSVIGPRSIHLAGYYMTDVCGEDSGDSDSGSDSLQKSDEDGFLEEDDDGNMVMGYSDGGDDDSESDE

SEQ ID NO: 78010 - DNA, 769 bp, Zea mays
  misc_feature: Ceres CLONE 1563007
  misc_feature: Encodes the peptide sequence at SEQ ID NO. 78011
  misc_feature (459)..(459): n is a, c, t, g, unknown, or other
ctggagctcaccgcggtggcggccgctctagactagtggatcccccgggctgcaggaattcgtctcacccctagaaaaaaaaaaagacgcaatacacatacagcccctcttgcccacaccacctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgctacgccgccgagatccgcgaccctgccaagaaaagccgtgtgtggctcggcacgtacgacacggccgaggaggccgccaaggcgtacgattccgccgcccgcgagttccgaggcgccaaggccaagacgaacttcccgttccccctcccagtgctccgtcngcctccggttgcttgccgggtagcgcccagtaagcaaacagcccccgtggaattccaaaccggtggccgggaaaacgggctttgggcattccaaggggccctattgcaggccagggccgtttccctccgggttcttgaatttcgaaccttctttccatggggggggggcccccctgaaaaaccaatttcccccacccgggaagggggggtttttcccttttaaaagggggttttcccgtgttggcccccggggccccaaaaacccccccacaaagagggattccttttttttcttaccagagagagaggg

SEQ ID NO: 78011 - protein, 171 aa, Zea mays
  misc_feature: Ceres CLONE 1563007
  misc_feature (32)..(83): Pfam Name: AP2 Pfam Description: AP2 domain
  misc_feature (98)..(98): Xaa is any aa, unknown, or other
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPLPVLRXPPVACRVAPSKQTAPVEFQTGGRENGLWAFQGALLQARAVSLRVLEFRTFFPWGGGPPEKPISPTREGGVFPF

SEQ ID NO: 78012 - DNA, 748 bp, Zea mays
  misc_feature: Ceres CLONE 1563008
  misc_feature: Encodes the peptide sequence at SEQ ID NO. 78013
  misc_feature (418)..(418): n is a, c, t, g, unknown, or other
  misc_feature (485)..(485): n is a, c, t, g, unknown, or other
ctccccgcggtggcggccgctctagaatagtggatcccccgggctgcaggaattcgtctcacccctagaaaaattcctctgcgcctcccgtctggccgtcttccagacgtctccaatcggagctcccagcgtctcggagaagaggagcagcacggcacggcagctgtggcgaggaaggctcttgtcctgtcccatcccaacccagcagccgtccaaggaggaggagatccaatcggcgtgcaggcgtccaccgtccatccatcgatccaattccaatctgcaggcctctgcgtcgcggcttgttcgtggaggagaggttgctgtggaacccgccgccagttagccatgtcgtcctccgtgctgagggctgcggccgacagggctattcgcaggcaggccctcacgctgacggacgccngcggcgtccaggaatccggcagcttcttccagcccttcaggggaaggggggcctttttccttggggngggtccgggggtcaaaagcgggggggttaaaagggccccctgaaaccccctaaatttgcccaaaaaaaaggggaaatttttttaaaccttttggggaaaaaaaaggggggtaaagggggggtttataaccccccccaaggtggcttaataaaatgggtgttaagggcgcccccaaaaagggggggatctctttttagaaccccccccccccataaatacaacaaacaaaaaatgtggggttgtttttaaacaacaaaaacaaa

SEQ ID NO: 78013 - protein, 60 aa, Zea mays
  misc_feature: Ceres CLONE 1563008
  misc_feature (25)..(25): Xaa is any aa, unknown, or other
  misc_feature (47)..(47): Xaa is any aa, unknown, or other
MSSSVLRAAADRAIRRQALTLTDAXGVQESGSFFQPFRGRGAFFLGXGPGVKSGGVKRAP

SEQ ID NO: 78014 - DNA, 752 bp, Zea mays
  misc_feature: Ceres CLONE 1563009
  misc_feature: Encodes the peptide sequence at SEQ ID NO. 78015
tccccgcggtggcggccgctctagaactagtggatcccccgggctgcaggaattcgtctcacccctagaaaaaaaaagatatgattctacctacactcagcagagtggtgggcagcaagcatatggacatgatggctacactggttaccagacccaagggcagcagcagggctactctcagcagactggttatgatcagcagggttatggcacatctgcttatggatcagctgcaagctcgacccaggatgggtccaactatggtggtcctggaggggccagtcaggcatctccagggcagcaaacatcaaacccagctgctggaagccaacctggctataccagccaaccgcccactagtgctgcagcaacttacccacctcaagggtcagctccatctggatatggcgctccaccatcccagtctggctatggcacccaccaccacagcaagccggatatggtcagggcgcttatgggcagccctctccacagggccagaaacctcctgcattgtcactttatgacaggcctcgccctcctggttcggcccaggcttggttacgggcagtattggttacagccaaacctggtttacggtggcaccaaccagccttaccctggggggaccccatttggaaacccccccaaggggcttattggcccaacaaccaagtcttttttgggcgaaacgccctatttgggggaagggccaaaaccttttggggggaaacccctccccagacccttaa

SEQ ID NO: 78015 - protein, 250 aa, Zea mays
  misc_feature: Ceres CLONE 1563009
PRGGGRSRTSGSPGLQEFVSPLEKKRYDSTYTQQSGGQQAYGHDGYTGYQTQGQQQGYSQQTGYDQQGYGTSAYGSAASSTQDGSNYGGPGGASQASPGQQTSNPAAGSQPGYTSQPPTSAAATYPPQGSAPSGYGAPPSQSGYGTHHHSKPDMVRALMGSPLHRARNLLHCHFMTGLALLVRPRLGYGQYWLQPNLVYGGTNQPYPGGTPFGNPPKGLIGPTTKSFLGETPYLGEGPKPFGGKPLPRPL

SEQ ID NO: 78016 - DNA, 782 bp, Zea mays
  misc_feature: Ceres CLONE 1563010
  misc_feature: Encodes the peptide sequence at SEQ ID NO. 78017
ctccccgcggtggcggccgctctagaactagtggatcccccgggctgcaggaattcgtctcacccctagaaaaagcgctgcgctcgcgtctctcgtccccctcagatccaccgactcgctctgagtctctgaccgccccttccgtcgtccccgttcgaaggcgcggcaagcgagcgattcagccagattcgattcgacatgaatcccgagtacgactaccttttcaaacttctgcttattggtgattctggtgttgggaaatcatgcttgcttctcagatttgcggatgattcatatttggacagctacatcagcacaattggggttgattttaaaattcggacagtagagcaagatgggaagaccataaaacttcaaatttgggatactgctgggcaagagcgcttcaggaccatcactagcagctactaccgtggagctcatggaatcattattgtatatgacgtgacagaccaagaaaagcttcataatgtgaaagcatgggtaaatgaaattgaatcgttatggcaaggtgaacatgtttaacaagctcccttggtgggggaacaaaaagggaccctaacggggcaaaaaaaggtttgtgggcaaccggaaacaagccaaagggcctttttccctaataaaaaaggggcccccccccctttttgggggaaaaaaaggggccaaaaaacgcccccccaaagggggggaaaagggcccctttgggggtttggggggccccccccccccaaggggaagggggggggcccccccaccccgcc

SEQ ID NO: 78017 - protein, 115 aa, Zea mays
  misc_feature: Ceres CLONE 1563010
  misc_feature (10)..(116): Pfam Name: Ras Pfam Description: Ras family
  misc_feature: SWISSPROT Homolog: EC 2.7.11.1 Non-specific serine/threonine protein kinase
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQEKLHNVKAWVNEIESLWQGEHV

SEQ ID NO: 78018 - DNA, 762 bp, Zea mays
  misc_feature: Ceres CLONE 1563014
  misc_feature: Encodes the peptide sequence at SEQ ID NO. 78019
ggagctccccgcggtggcggccgctctagaactagtggatcccccgggctgcaggaattcgtctcacccctagaaaaaatccccccgcgtagaggagaggagaggaagaagaagaacccagccaaatcctcagtcctcaggctgctcacagctcgtgccgtccactctcccccgagccagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtgacccccgcgtcgccgtctggcaagaagaccctccgcaagggcacagcggtcatcaccggcgcgtcgtccggcctcggcctcgccacggcgaaggccctcgcggagacaggcaagtggcacgtcatcatggcctgccgcgacttcctcaaggcgtcgcgcgcggccaaggcggccggcatggactaagacagcttcaccgtcgtgcacctggacctcgcctccctggacagcgtccgccagtccgtcaggtacgtgcgccagctggaatgcccatccaacgtggtggtctgcaaacgccccccggttaccagcccaccgcccaaggagccgtccttaccccgccgacggtc

SEQ ID NO: 78019 - protein, 131 aa, Zea mays
  misc_feature: Ceres CLONE 1563014
  misc_feature: SWISSPROT Homolog: EC 1.3.1.33 Protochlorophyllide reductase
MALQAATSFLPSALSARKEGSVKDSASFLGVRLAADGLKLDTTALGLRTVRVSRSADIRAQTAAVSSPSVTPASPSGKKTLRKGTAVITGASSGLGLATAKALAETGKWHVIMACRDFLKASRAAKAAGMD

SEQ ID NO: 78020 - DNA, 772 bp, Zea mays
  misc_feature: Ceres CLONE 1563016
  misc_feature: Translation starting site: 146
  misc_feature (742)..(742): n is a, c, t, g, unknown, or other
ctcaccgcggtggcggccgctctagaactagtggatcccccgggctgcaggaattcgtctcacccctagaaaaagctccctctccacggttccacgaacgttggcgcgcaagctcgtggtgtgagcggtcactgtctcccatcccatggctccggcgctgagcgggactctgggcgcgtcgtcggtggcggcgctgcggccctgcgcggggaggagggcgccgtccgccgcgagctcggttgcgccgcgcgggagcggggtggtgaggtgctccagagggctcaggtgggacgcccacagaagcagggggaggttgctcagggtgaggtgcgatgcggccgtcgcggagaagcccgccgaggaggaggcggctggggagaagttcgagtaccaggcggaggtgagccgcttaatggacttgatcgtccatagtctgtacagtcataaggaggtatttctcccgggagcttgttagcaatgcgagtgatgcgctggataagctgaggttcctcggcgtcactgattcttctttgcttgctgatggcggcgagctagaaaatagaattaagcctgaccttgatgctggaacgattactatcactgacactgggtggttggtatgactaaagatgagctcaaggactgcctttggtacatttggctccagagtggcacctccaaaatttctgaaggccctcaaagaaaaacaaagaccctggggcggacaatgggtctattgggncagtttgggggggttggatttttactccac

SEQ ID NO: 78021 - DNA, 795 bp, Zea mays
  misc_feature: Ceres CLONE 1563017
  misc_feature: Encodes the peptide sequence at SEQ ID NO. 78022
  misc_feature (565)..(565): n is a, c, t, g, unknown, or other
ctggagctcaccgcggtggcggccgctctagaatagtggatcccccgggctgcaggaattcgtctcacccctagaaaaaaaccccaatcgtagggaactgggaacccggacccagatctcccctagatcctcaatcccaatctgccctccgccgtatcgatcatacctcccgatgcgaccccaagtctggtcgatgcgagtagcggcggcgatttagcgaactgcgcgttcgctagggttagggtttcgagggtttgcgctagggtttgggcgcacgatggggcggtcgcgaggggtgcagaattccggcgacgacgacaccgtacacaggtcgaagcggaggagggtcgcatcgggcggggatgcgacggactccgtttccgctggcatcgggggagctggagaaggagggggcaagaaagcgctctaccactgcaattactgcaacaaggacatctctgggaagatacggatcaaatgctccaagtgccctgacttcgacctttgcgtggagtgcttctctgttggcgctgaagtcaccccacatcgcagcaaccatccttancaagtcatggacaacctgtctttcccacttatttgcccagattggaatgcagacgaagaaattctcctccttgagggaaattgaaatgtatgggtctgggaaactgggcttgaagttgcagaagcatgttgggtaccaagtctaaagttacaggtgtattggatcatttacacaacagcatacatgaaactcaccttggttatccccctaacgggatatgttctccatgt

SEQ ID NO: 78022 - protein, 123 aa, Zea mays
  misc_feature: Ceres CLONE 1563017
  misc_feature (47)..(92): Pfam Name: ZZ Pfam Description: Zinc finger, ZZ type
  misc_feature: SWISSPROT Homolog: EC 2.3.1.48 Histone acetyltransferase
  misc_feature: The sequence is a functional homolog of SEQ ID NO 106 in the 10/286,264 US patent application
  misc_feature: The sequence is a functional homolog of SEQ ID NO 206 in the 10/412,699 US patent application
  misc_feature: The sequence is a functional homolog of SEQ ID NO 425 in the 11/479,226 US patent application
  misc_feature (96)..(96): Xaa is any aa, unknown, or other
MGRSRGVQNSGDDDTVHRSKRRRVASGGDATDSVSAGIGGAGEGGGKKALYHCNYCNKDISGKIRIKCSKCPDFDLCVECFSVGAEVTPHRSNHPXQVMDNLSFPLICPDWNADEEILLLEGN

SEQ ID NO: 78023 - DNA, 789 bp, Zea mays
  misc_feature: Ceres CLONE 1563021
  misc_feature: Translation starting site: 182
  misc_feature: SWISSPROT Homolog: EC 1.11.1.11 L-ascorbate peroxidase
  misc_feature: SWISSPROT Homolog: EC 1.11.1.5 Cytochrome-c peroxidase
  misc_feature (42)..(42): n is a, c, t, g, unknown, or other
  misc_feature (322)..(322): n is a, c, t, g, unknown, or other
ctccccgcggtggcggccgctctagaactagtggatcccccngggctgcaggaattcgtctcacccctagaaaaaggggagcgtggcgaccatttgcccccagcagatcttgtgaccctccctcagccgcgtcgcgtcgcatcctacgatccaaagctctctctggtcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttncgacgtgtcgtcgaggaccggcggtccattcggcacgatgaagcatcagtcggaattggctcacggcgctaacgcggggctggacatcgcggtgcggctgctcgagcccatcagggagagttcccaatcctctcttacgccgatttctaccagctcgcggggagttgtgggcccgtggaggtcaccgggtgggcttgaaattcccttcccacccccggtaggaagggacaaagcctcagccccccacctgaagggccgcccttccctgatgcccactaaaggttttctgaccaacctgaaggcaaattttttgggcaaaccaaagggccttttaacccaataaggaaaattgggttcccccccctccggggggcccaacaccctgggggaaggggggcccacaaaaaaaacgggtccttgggtttttcaaggggggggccctgagaattaaaaaaacccccttttgg

SEQ ID NO: 78024 - DNA, 849 bp, Zea mays
  misc_feature: Ceres CLONE 1563023
  misc_feature: Encodes the peptide sequence at SEQ ID NO. 78025
tccccgcggtggcggccgctctagaactagtggatcccccgggctgcaggaattcgtctcacccctagaaaaagcacaacacctcggttttagtactcttccgtctttgcactcgcattatcacactcgaatcgccaggcctagatagctgcctgcctgccttggcttgcttgctacgtcgtgtacacagagagaggaaggacacgaccaagaaaagaaagaagagagagagagagagagagtcctttcctttcctcgaacttattccatggagacctcttctcacaagcgggagcaggaggcggtcgatatcgacaccgccgccgccgccgacagagaggccgtgtggccggagtccgacgcaaagaggctgcggccgcaggacctgctcgacatgctcgatgacgacaccgacgcggcggccgccggcgacctggcgtccgtcatgctgagcctgtatgaggacatacctgcttcaacgaggccgcggaggcggcgccgtcgcagcatccagagcatgggttcctgcacaaggcctcagacgaagatcttgggctagcgcccgccggatccgccgccgcctcatatgaggaagacgggctcccccggccaactgtataccgcaaactcctcagacgtccaggcttttaatgtggaattatagagccttaaaaaaacaaaatcttatggaaggctctcagggcgccacaccccccaaaagattgcaacccgctaaattcctataaaaaaaaagggggggaaaaaaaaaaaatgtttttgatgcacggaaatattggggcatttatagaaaaccaaacgccggggcgggtgcctctctcataattccaa

SEQ ID NO: 78025 - protein, 96 aa, Zea mays
  misc_feature: Ceres CLONE 1563023
METSSHKREQEAVDIDTAAAADREAVWPESDAKRLRPQDLLDMLDDDTDAAAAGDLASVMLSLYEDIPASTRPRRRRRRSIQSMGSCTRPQTKILG

SEQ ID NO: 78026 - DNA, 837 bp, Zea mays
  misc_feature: Ceres CLONE 1563024
  misc_feature: Encodes the peptide sequence at SEQ ID NO. 78027
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (510)..(510): n is a, c, t, g, unknown, or other
  misc_feature (709)..(709): n is a, c, t, g, unknown, or other
  misc_feature (721)..(721): n is a, c, t, g, unknown, or other
ctccccgcggtggcggccgctctagaactagtggatcccccgggctgcaggaattcgtctcacccctagaaaaagtcacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcnnntggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccgggcctacgcaccgccgtgagcccgctgctgcggggcgtcnaggtcggcctcgcgcacggctacctcctcgtggggcccttcgcgctcacgggcccgctccgcaacacgcccgtgcacgggcagggcgggggcgctcggcgccgcccggctccgtcgccatcctcagggtcggcctcaccatgtacgggggccccctccttcaacgaggggggacccggtcacggggggccctcgcttangctcaccggggngggaagaaagaaggccaacaagcttgcaaacactccgaagggtgggggccaatttcaccggggggattccttctttggggggggatcttcggggggtggttttgggggcttctttt

SEQ ID NO: 78027 - protein, 199 aa, Zea mays
  misc_feature: Ceres CLONE 1563024
  misc_feature (44)..(196): Pfam Name: PsaL Pfam Description: Photosystem I reaction centre subunit XI
  misc_feature (91)..(91): Xaa is any aa, unknown, or other
  misc_feature (157)..(157): Xaa is any aa, unknown, or other
  misc_feature (161)..(161): Xaa is any aa, unknown, or other
MASQVMKSSLVVHSRPRGLSGAAALTRRPGRFTVKAIQPEKATYQVVQPINGDPFIGSLETPVTSSPLVAWYLSNLPGLRTAVSPLLRGVXVGLAHGYLLVGPFALTGPLRNTPVHGQGGGARRRPAPSPSSGSASPCTGAPSFNEGGPGHGGPSLXLTGXGRKKANKLANTPKGGGQFHRGDSFFGGGSSGGGFGGFF

SEQ ID NO: 78028 - DNA, 783 bp, Zea mays
  misc_feature: Ceres CLONE 1563025
  misc_feature: Encodes the peptide sequence at SEQ ID NO. 78029
  misc_feature (656)..(656): n is a, c, t, g, unknown, or other
ggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgatgccgtctggttcaaggccggctcccagatcttcagcgatggcgggctggactacctcggcaaccccagcctgatccacgcgcagagcatcctcgccatctgggcctgcccagtcgtgctcatgggtgccgtcgagggctaccgcattgccggcngggcgctccggcgagggcgtcgaccccgctgtaccctggcggcagctttcgaacccctcggcctgggcgaacaacccggaggccttcccccaagctcaaggtgaaagagctcaagaaccgccccccc

SEQ ID NO: 78029 - protein, 209 aa, Zea mays
  misc_feature: Ceres CLONE 1563025
  misc_feature (61)..(200): Pfam Name: Chloroa_b-bind Pfam Description: Chlorophyll A-B binding protein
  misc_feature (176)..(176): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGDAVWFKAGSQIFSDGGLDYLGNPSLIHAQSILAIWACPVVLMGAVEGYRIAGXALRRGRRPRCTLAAAFEPLGLGEQPGGLPPSSR

SEQ ID NO: 78030 - DNA, 761 bp, Zea mays
  misc_feature: Ceres CLONE 1563027
  misc_feature: Encodes the peptide sequence at SEQ ID NO. 78031
  misc_feature (467)..(467): n is a, c, t, g, unknown, or other
ctccccgcggtggcggccgctctagaactagtggatcccccgggctgcaggaattcgtctcacccctagaaaaatccgcatccgcagcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacnaggacaaggctgctgcacatctcaagggtggtgccaagaaagttgttatctctgcccccagcaagatgcacccatgtttgttgttggtgtcaatgaggacaagacacctcggatggtaacattggttccaatgctagctgcaccacaaactggcttggctccccttgctaaggtcattcatgacaacttcggcattggtggagggttgaatgaaaacgggtcatgccctccctgccaccccaaaaaacgggttgacgggacccctcacccaagaacttggaaagggggccaggg

SEQ ID NO: 78031 - protein, 145 aa, Zea mays
  misc_feature: Ceres CLONE 1563027
  misc_feature (4)..(132): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (107)..(107): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDXDKAAAHLKGGAKKVVISAPSKMHPCLLLVSMRTRHLGW

SEQ ID NO: 78032 - DNA, 827 bp, Zea mays
  misc_feature: Ceres CLONE 1563028
  misc_feature: Encodes the peptide sequence at SEQ ID NO. 78033
  misc_feature (646)..(646): n is a, c, t, g, unknown, or other
  misc_feature (813)..(813): n is a, c, t, g, unknown, or other
ctccccgcggtggcggccgctctagaactagtggatcccccgggctgcaggaattcgtctcacccctagaaaaagcgcctccgcccgccgtccgccgccctaacactgccgacctgtcgactgccgtctgctcagccggccagccactatccgccgagcgcccgacggcccgagcaggcgagcagctccgcatcgcgcgacgtcccaagcaggtgagcaaccaggggcagtaaaggcgttcgcgcgacgtccaacagtgcacctgcgcgcgcgacgtctcgctgctttctccaactcctgttcggtatcgccgtttctcgcttggaggttgtcctgtagcggggacgaccgcccattccggcgcccgctcttctgctcctcctcgccttcctgtttctgctgcggggagttcttccgccgcgagccgggacaccgtcgccgccggccgcccgctgtccgacgcgcagagcctcgtgtccaagcgtggcaagttcaagctcggattcttccgtccagggtttggctcgagatggggaaagcaaagagcaagggccctaaattcgcggcggtgaaagagattatcaccaagaaaacccatcataaatacaagggagatgtgctgaaccacagaagaaggacgtggacnaggagaactccgccgggaatgtgcggcagtttcgtcggcgttgtcttcagctacacacagcattggggccgccgtatccggtgattgggataccaactcatcatttctcgatacagaataactggatttgagaagggatgatggatgccttatgcaaatgtacccangtgtccggactggt

SEQ ID NO: 78033 - protein, 66 aa, Zea mays
  misc_feature: Ceres CLONE 1563028
MGKAKSKGPKFAAVKEIITKKTHHKYKGDVLNHRRRTWTRRTPPGMCGSFVGVVFSYTQHWGRRIR

SEQ ID NO: 78034 - DNA, 813 bp, Zea mays
  misc_feature: Ceres CLONE 1563029
  misc_feature: Encodes the peptide sequence at SEQ ID NO. 78035
  misc_feature (433)..(433): n is a, c, t, g, unknown, or other
ctccccgcggtggcggccgctctagaactagtggatcccccgggctgcaggaattcgtctcacccctagaaaaagtctctctaggttttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctgggtaggctgttggtgtaaatctgcctgcgggatcagctcctgcggcagctgctcctgcggatgangctgaggatgatgatgaccttgatctttttggtgatgaaactgaggaggacagaaggcagctgatgagcgtgccgccgctgccaaggccctcttctaaaaagaaaaaaaggggaaatcccccccccccttttggaggtcaaaccctggggaccattgagacttgatttgaaaaacctggggggagggcgtcccccatggtccaaaattgggagggcctgaattttggggaaccccaaaaccttggggcccggtgggaatccgggcctccagaaaaaaaaccttttctgggtgacaaaattttggcgaacaaattttttgggtcccccccgcacccccttatttttggggagacccccttttttccagaaaaagccccctt

SEQ ID NO: 78035 - protein, 70 aa, Zea mays
  misc_feature: Ceres CLONE 1563029
MAVFSDLHTADGLKSLEAHLAGKTYVSGDSITKDDIKVFAAVPSKPGAEFPNAARWYETVSAAVASRFPG

SEQ ID NO: 78036 - DNA, 696 bp, Zea mays
  misc_feature: Ceres CLONE 1563030
  misc_feature: Encodes the peptide sequence at SEQ ID NO. 78037
  misc_feature (533)..(533): n is a, c, t, g, unknown, or other
ctccccgcggtggcggccgctctagaactagtggatcccccgggctgcaggaattcgtctcacccctagaaaaagcgacgaactcatcactgcactggtggtgcccgtggtgctccacagagtgaagcgatagccaggagaggcgacgatgcgcaagtgggcgctctcctccgcgctcctcctcctctttctcctcaccacactccccgacccagctaagaagctacaagtgaatgccgaggagagcagcgatgacttggctaacccaccgaaggtagaggagaagtttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttctcctactgataaagaangtctaggtgaaaggggacactgcaaagcttgagattccgattaaagtgggacaaaaaaaagaaaatcctcccccttccgggaaagggggtatggggtttgacccagggaaaatctttttttagaaaccttggaaaccgatggctaaattctggcaccttccac

SEQ ID NO: 78037 - protein, 138 aa, Zea mays
  misc_feature: Ceres CLONE 1563030
  misc_feature (129)..(129): Xaa is any aa, unknown, or other
MRKWALSSALLLLFLLTTLPDPAKKLQVNAEESSDDLANPPKVEEKFGAVPHGLSTDSEVAQREAESISRKTLRSSAEKFEFQAEVSRLMDIIINSLYSNKDIFLRELISNASDALDKIRFLSPTDKEXLGERGHCKA

SEQ ID NO: 78038 - DNA, 776 bp, Zea mays
  misc_feature: Ceres CLONE 1563032
  misc_feature: Translation starting site: 166
  misc_feature (489)..(489): n is a, c, t, g, unknown, or other
  misc_feature (643)..(643): n is a, c, t, g, unknown, or other
ctccccgcggtggcggccgctctagaatagtggatcccccgggctgcaggaattcgtctcacccctagaaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggancagaaggcagctgatgagcgtgctgccgctgccaaggcctcttctaaaaaaaaagaaagtggtaaatcctcccgtccctatggatgtaaaaccatgggacgatgagactgatatgaagaagctggaggaagctgtcccccgtgtccaaatggangggctgacttggggagcatcaaagcttgtgccctgttggataccggcatcaagagatggactttcatgttggacaattggcgaacgatccttggtgtccctcgacccctctaatttgaagacccacctttccc

SEQ ID NO: 78039 - DNA, 783 bp, Zea mays
  misc_feature: Ceres CLONE 1563033
  misc_feature: Encodes the peptide sequence at SEQ ID NO. 78040
  misc_feature (625)..(625): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (698)..(698): n is a, c, t, g, unknown, or other
  misc_feature (699)..(699): n is a, c, t, g, unknown, or other
tggagctccccgcggtggcggccgctctagaactagtggatcccccgggctgcaggaattcgtctcacccctagaaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgccacagtcaagggcggcttggttgcagtcaagatggggaaggacagagaatctgccaagctgaaggaggagaaggggtccaaggatgagatccatatgaaggtcaagagcaagggcgagccgtccggcgaggaagacggcaaggaggaggtcgaggtagagattgaggccaagtttgttgagaaggaagaggtcacaggctcgggtgacggtgcgggaaggaaagggtaccaagaagaaggatacaaaggagaaagacagaaaaagaaggaaggtggtgacgattcagggaaggcagaggaagacaataagggtaaagcgaaggattcggagggcaagggccaagtgaagaaggaaaagaaggatggtgnctggggacgacggaggcgaggagaagggaannnaaaagaaagataagaaggacaaggggtgagaagaatgacnngggagaagaaagagaagaagaaagaccagggcgcccatgagatgaccgaccgatccccgtgaagctcagagaaaaagctgggaa

SEQ ID NO: 78040 - protein, 127 aa, Zea mays
  misc_feature: Ceres CLONE 1563033
  misc_feature (113)..(113): Xaa is any aa, unknown, or other
  misc_feature (123)..(123): Xaa is any aa, unknown, or other
  misc_feature (124)..(124): Xaa is any aa, unknown, or other
MGKDRESAKLKEEKGSKDEIHMKVKSKGEPSGEEDGKEEVEVEIEAKFVEKEEVTGSGDGAGRKGYQEEGYKGERQKKKEGGDDSGKAEEDNKGKAKDSEGKGQVKKEKKDGXWGRRRRGEGXXKER

SEQ ID NO: 78041 - DNA, 786 bp, Zea mays
  misc_feature: Ceres CLONE 1563034
  misc_feature (525)..(525): n is a, c, t, g, unknown, or other
  misc_feature (664)..(664): n is a, c, t, g, unknown, or other
ctcaccgcggtggcggccgctctagaactagtggatcccccgggctgcaggaattcgtctcacccctagaaaaaaaaaagtacgtgctgtctacagtacaagtgagtagttaagcaagtgcccgtaaaccaagcttgcttgcgacttgctagacaacacacaacacaacacccatggcagtggtagacaggtgggcgggcctgggttcagcgctccccagcttcctcttcctctggtccatggtgcacagacacatgcccgtcaccatcatccaccgcgtcaccacctgtgccaacaagctcgtctcctacttcgacccctacatatagatcaccatctccgagcacggcaccgagcgcttccgccgaagcgacttcttcctcgacgccgaggcctacctgtccgatgcctgcgcgcccctcgccctctagctcaaggccgagatcggcaagaacatcatcaacctccaggtctccgtctgcgactaccacgaggtcaccgatgccttccacgtagccactgtcntagtggtacatcgtctagaatgtgcccaggtccaacgtcatcagcttgtactcctaccaatgcgacccacgcacctgacgatgtcatcttccacgagcaccaccacgaacatcgtcgtctgctagtacctgacgcaacntcatcaacgaaaggacgctcccgtcgacgtgcagcaaccgtcagtgcctgcatacttaccatacaatctcagtccgtcagtggcctatgggaaaggtgcaacattctggaaacccacgaccc

SEQ ID NO: 78042 - DNA, 795 bp, Zea mays
  misc_feature: Ceres CLONE 1563035
  misc_feature: Encodes the peptide sequence at SEQ ID NO. 78043
tggagctccccgcggtggcggccgctctagaactagtggatcccccgggctgcaggaattcgtctcacccctagaaaaaactcacgcgttctccacctactgctggcgctcctgtgaggcgacgccggaccggccaccccgcatgcgaacagcgcacggaccggccaccggtgtgacccctccatccaaggcttcagctccagaccgagccgccccgccaatcgccgtccgccgaaccgcctaggaatttgttttcctcatctaaagttactgcattgtattccatagaaatggctatggggttgattaatgctaatcctataatccatgagaaaaaagaaagacgcatccgacaggcaccagagaccacagatgaaaatgcggtagagtccatagaccagctggaaatatttgatcacattagagatataaaggatccagagcacccatactcactggaacagcttaatgtggtgactgaagactcaattgaactcaatgatgaaagcaatcatgtcagggttattttcaccccaacagtggagcactgcagtatggcaactattattggccttttgcatacgtgtgaaacttgtacggagtctccctccttattacaaggtggacataagggttgcccctggatcacacgcaactggaagctgctgtggataagcaactgaatggacaaagaacgtgttgcggctgcattggaaaacccaaccctactgacatggtttgaagagtgctttatcacccacattcgatttgaggtctcaatttatgcacgtctgg

SEQ ID NO: 78043 - protein, 130 aa, Zea mays
  misc_feature: Ceres CLONE 1563035
  misc_feature (36)..(108): Pfam Name: DUF59 Pfam Description: Domain of unknown function DUF59
MAMGLINANPIIHEKKERRIRQAPETTDENAVESIDQLEIFDHIRDIKDPEHPYSLEQLNVVTEDSIELNDESNHVRVIFTPTVEHCSMATIIGLLHTCETCTESPSLLQGGHKGCPWITRNWKLLWISN

SEQ ID NO: 78044 - DNA, 829 bp, Zea mays
  misc_feature: Ceres CLONE 1563036
  misc_feature: Encodes the peptide sequence at SEQ ID NO. 78045
  misc_feature (277)..(277): n is a, c, t, g, unknown, or other
  misc_feature (692)..(692): n is a, c, t, g, unknown, or other
  misc_feature (708)..(708): n is a, c, t, g, unknown, or other
  misc_feature (734)..(734): n is a, c, t, g, unknown, or other
acccgcggtggcggccgctctagaactagtggatcccccgggctgcaggaattcgtctcacccctagaaaaaacaccaagaacaaccagagaggcaagcaggggagaatcgcggaggtctgggaaacaccatcctgcagagatgacagtgctgctctccccgagctcctccctgttcctcgccaaaccttctgccgtcgccaagggcagggcggcggctgtgacgtgcttcagcgggccctccctgtcagtggggcgtgaagatcaggagggtgtangcagtggtggtggggaggcgtgcgttggcttccgcagcagctgtcgcctcagtgcttgggtttgcaggccgtggtctggcggccaaccagggcctgctcgccgggagggtccccggcttgtctgaacctgacgaaaatggttggagaacgtaccgcaggccagacgacaagtccggtggccacggagttggctggagccccatcatcccgtacagcttcaaagttccagacggctgggatgaggtcccggtgtccattgctgatctgggcggcacggagatcgacctgcgcttcgcaaccccaaggaaggccggctgttcgtcatcgtggccccagttcgccggttcgcagatgacctggacgacgcgaccatcgagaagatcggagcccgggagaaggtgatcaccgccttccngtccggaggtcatccngagaagacgtgggaagggatggtccntgtcctcggagaacggcggcgcatttcggggagaaacttactacccagttcgagctggaacccgcccccatgtgtttcatcaccggccacgggat

SEQ ID NO: 78045 - protein, 86 aa, Zea mays
  misc_feature: Ceres CLONE 1563036
  misc_feature (46)..(46): Xaa is any aa, unknown, or other
MTVLLSPSSSLFLAKPSAVAKGRAAAVTCFSGPSLSVGREDQEGVXSGGGEACVGFRSSCRLSAWVCRPWSGGQPGPARREGPRLV

SEQ ID NO: 78046 - DNA, 787 bp, Zea mays
  misc_feature: Ceres CLONE 1563037
  misc_feature: Encodes the peptide sequence at SEQ ID NO. 78047
ctcaccgcggtggcggccgctctagaactagtggatcccccgggctgcaggaattcgtctcacccctagaaaaaaagaccaccgacgcgtagcacagtccattattgccgtctcccttttgcgtgagcaaagaaagagagcgagaagagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggaaaagaaggacaagaaaaagaagaagcacggcgagggccacgaccacgacggcggccacagtagcagcagcagcgacagcgactgagatctggtgtcgcagcacaggtgcaacacatgtatgcttgctggatggaggattcataccagctgatgctgatgtagtgtttcactggtgtcatgcatgtatcgtgctattataatcaaaaagaaaaaagaataaccagtcagggatggttttgtttgccaaaaaaaaaaaaaaaataccacagcatccgcagttccccgaccacaccgttcctccgagccccagagcagccccgcgccagggaggaagtttgttcttttaacaatatgtcgaaggggagaagaagctccccttggggggcgaccacaagattagggagggagaccc

SEQ ID NO: 78047 - protein, 100 aa, Zea mays; identical to SEQ ID NO: 77178
  misc_feature: Ceres CLONE 1563037
  misc_feature (2)..(100): Pfam Name: Dehydrin Pfam Description: Dehydrin

SEQ ID NO: 78048 - DNA, 820 bp, Zea mays
  misc_feature: Ceres CLONE 1563038
  misc_feature: Encodes the peptide sequence at SEQ ID NO. 78049
  misc_feature (716)..(716): n is a, c, t, g, unknown, or other
  misc_feature (721)..(721): n is a, c, t, g, unknown, or other
  misc_feature (750)..(750): n is a, c, t, g, unknown, or other
ctccccgcggtggcggccgctctagaactagtggatcccccgggctgcaggaattcgtctcacccctagaaaaaatggagaagcttccttcagtgagtcctccctttccgtttaaggcagcaagcaggagcagacaggaggcgccgagagcccagcgtcggagatctccgccgccatggagacgctggccagcgccatgcggcgcgagaaccgccggtccaaggccccgccctcctcctctgcttcctccgccctcgcctcgggcagggtccctctcgtcatggccttcctctcctgcctcgcctggctctacgtcgccggccgtttgtggcaggacgcgcagacccgggcgatcctgtccggcctcctcgagaagagctctaccagcgtcccgaaggtgctctcggtggaggacaagcttaggaaccttgggtgcaaggcgattggaaggaaaattgttgaggcggagatggacctgaccaaggccaagagcgaggggtacctgtgggggaacaggactgcagctgtggactccgacaagaagcagcagcttcttgccgtcattggagtttacactgggtttggctcccgtctcaagaggaacgtcttccgtggctcctggatgccaagaggtgatgctctgaaagaagctgaggaaagggtgtagctattcgttttgtaatttggtcggagtgcaaatcgaagtgatagctggnaccgntaaatattgatgatgaaaatcggcagacnaaggactttcttgatctctgaaagccatgaagaggctgcagaagaattaccgagcaagcaaaattttctt

SEQ ID NO: 78049 - protein, 163 aa, Zea mays
  misc_feature: Ceres CLONE 1563038
METLASAMRRENRRSKAPPSSSASSALASGRVPLVMAFLSCLAWLYVAGRLWQDAQTRAILSGLLEKSSTSVPKVLSVEDKLRNLGCKAIGRKIVEAEMDLTKAKSEGYLWGNRTAAVDSDKKQQLLAVIGVYTGFGSRLKRNVFRGSWMPRGDALKEAEERV

SEQ ID NO: 78050 - DNA, 767 bp, Zea mays
  misc_feature: Ceres CLONE 1563039
  misc_feature: Encodes the peptide sequence at SEQ ID NO. 78051
ctggagctcaccgcggtggcggccgctctagaactagtggatcccccgggctgcaggaattcgtctcacccctagaaaaaaatttttgactctattccccgcttcccgattcaagtcagcggtttttagggttcgagatctcggcatcgtgtcgcggaagccatggcgacaagcatgcttagtaccgtgaaggtgagcaatgtatcgctgaaagcagcacaacgtgatataaaggaattcttttccttttctggtgacattgtgcatgttgaaatgcagagtttggatgagctttctcaagttgcctacattactttttaagacaaacaaggagcggagacggcaatgcttctcacggggggccaccatagtttgatatgggctgtaatccgtcaccaccagcaaaatgatttatggagcctaccatccttcctgtttttaagtttggctcctggaagcccaaagaaaccaaaaaaccttcttgcccctttcaaaagggccgaaggaacttggtttgggaacccttgctggccaaaagggaatttattccctcggggaagggaatgcgccctgggaacaaaaaccaaaaaacctttttggaaatagaaaaaacattcccccctaaacccccccacacgggccccccccccttaaaagaattccctctcctcttcccaaaaaaaaaaaaaaacccgccccttaatggggaaaaaaaaaaatacaggggggggtgggccaccctcttcctttttggaaaaaaacaaaaa

SEQ ID NO: 78051 - protein, 52 aa, Zea mays
  misc_feature: Ceres CLONE 1563039
MATSMLSTVKVSNVSLKAAQRDIKEFFSFSGDIVHVEMQSLDELSQVAYITF

SEQ ID NO: 78052 - DNA, 794 bp, Zea mays
  misc_feature: Ceres CLONE 1563041
  misc_feature: Encodes the peptide sequence at SEQ ID NO. 78053
  misc_feature (662)..(662): n is a, c, t, g, unknown, or other
gtggagctcaccgcggtggcggccgctctagaatagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttggttgttggtgtcaatgaggacaagtacacctcggaatgtaacattgttttccatgctagctgcaccacaaactgccttggctccccttgctaaggtcattcatgancactttccgcattgtttgagggtttgatgacaactggtcatgccatcactggcaccccagaaaactggttgacgggaccctccagcaagggactgggaaaagtggggcagggctgcccagcttttaacatca

SEQ ID NO: 78053 - protein, 138 aa, Zea mays
  misc_feature: Ceres CLONE 1563041
  misc_feature (4)..(135): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFGCWCQ

SEQ ID NO: 78054 - DNA, 1290 bp, Zea mays
  misc_feature: Ceres CLONE 1563043
  misc_feature (19)..(19): n is a, c, t, g, unknown, or other
  misc_feature (20)..(20): n is a, c, t, g, unknown, or other
  misc_feature (909)..(909): n is a, c, t, g, unknown, or other
  misc_feature (964)..(964): n is a, c, t, g, unknown, or other
ggtttgggggttttttttnngggggcaacaccttgagggggagtgggggggggtagaaaattaatgacgaaaaaagaggagggctcccggcggtggcggccgctctagaactgtggatcccccgggctgcaggaattcgtctcacccctagaaaaaagaggcggagcgcaagagctatcgacctcggctcaccgagccgcggccagtacctagcgcatcgaacccgggtgaatgccagctggcggcggaggctcccctctcctggtctgggtctcctggtgctcctccctcttcctctctgtcctcatgaacctccttttgccaagcctcctccgatgccttggctccacacgccgccgtcgggacgaaggcggccgtcggcggcctccgcgcgctgcgcgccgagggggccaccctccccgtgctctccttcaccggatagaagatcgagggagagaacgcgtgacctcaaatcgggggcacccctgctaccgggctcctcttatggagcaaccgcggctaccacataccgcacccggcctggaaccgtcgcgcccggaggctagggtcgctgccaccgcctgcacaaggtcttattaagggtcaagaaggatgagtaagtaaaaatgatatccctcttattaatgcttggagagagaggaacggggggggagagggcaccacggaactgtaggtggggtcccggcaaaacggatgagggctggcggccttttgggagtgtgcccccgccacacgagggatgtagtgctctggttcacagggaggatgttgctttgagaggggtggcccaatagaggggcccctccctctgggacgactgtccgtgcggagaggtgtcttgacaattttctcatagtcgtaaattctcacatatcctacgatgtgaanggcgagggagatatagaagtgcgcggccccaagattgcgaccgcagaggcacgantccaggatgaggagggcctcaagagtcgcactgtttataacagaccccccccgagctcgagatgcggggaggcgcggccacttggaggtgcttggtggttcgctggaatggatagggtgtggatcaaaagtgagatggcgccatatggcctcccggctcgtgtggagatccccaatatagatcgccctctgtggtatatcttgtgtgggtgggcctacaactagatataagaaacaatatttgtagtgagatggagtggactggcccggtgtatggtgttgagaagatggccatggggtttgccttgtgaagaacagagtgaccgg

SEQ ID NO: 78055 - DNA, 844 bp, Zea mays
  misc_feature: Ceres CLONE 1563044
  misc_feature (216)..(216): n is a, c, t, g, unknown, or other
  misc_feature (591)..(591): n is a, c, t, g, unknown, or other
  misc_feature (595)..(595): n is a, c, t, g, unknown, or other
  misc_feature (596)..(596): n is a, c, t, g, unknown, or other
  misc_feature (610)..(610): n is a, c, t, g, unknown, or other
  misc_feature (632)..(632): n is a, c, t, g, unknown, or other
  misc_feature (652)..(652): n is a, c, t, g, unknown, or other
  misc_feature (676)..(676): n is a, c, t, g, unknown, or other
  misc_feature (678)..(678): n is a, c, t, g, unknown, or other
  misc_feature (770)..(770): n is a, c, t, g, unknown, or other
tggagctccccgcggtggcggccgctctagaactagtggatcccccgggctgcaggaattcgtctcacccctagaaaaaagacacagacacacacacacacacacactcaacagcaacagctaagcctctcccacaagacagcaacatggctgaggaggaggccaagaaggtggaggtggaggtcaccaaggagcccgaggcggcggcgtaagagnacgtagccgatgacaaggccgtcatccccgcgaccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaagctgctaagaaagtatccgctattctttcatgggaaaacacaaagaaagcaaacatagaagctgaactgaagaagattgaggaacaactggaaaagagaaagctgaatatgcagagaagatgaagacnaggnntgcatgatacacanggaagccgaagagaagcgagcngatggtgggagcaaaacgcnggtgaagaaggtcctgaaagcccnangagatggcctgccaagtacccgggccaccggcccacgctccctagaaagctccttcggtggccttcggaaccctaagaaaacctccaagtcnaacccgggcagaaagggaaaaaacgccagcccagtggatggctgggcccctcgccccattaaaggtgggggagg

SEQ ID NO: 78056 - DNA, 836 bp, Zea mays
  misc_feature: Ceres CLONE 1563048
  misc_feature: Encodes the peptide sequence at SEQ ID NO. 78057
ctccccgcggtggcggccgctctagaactagtggatcccccgggctgcaggaattcgtctcacccctagaaaaaagaccgcaccgcggccacagcctcgcgtcgtcgccccacagccacgcgagccttcgccgatccgcgagcgcagatcgccgaagccaggcggcggagagggagctcgaggcggcggaggaaggcgttcgccacagtcgctgatttccctggggaagagatggggctctcctttggtaagctgttcagccgcctcttcgccaagaaggagatgaggattctcatggtcgggctcgatgccgccggtaagaccaccatcctctacaagctcaagctcggcgagatcgtcaccaccatccccactatcggattcaatgttgaaactgttgagtataagaacattagcttcactgtttgggatgttggtggccaggacaagatcaggcccctgtggaggcactactttcagaacacacagggacttattttgttgtagacagcaacgacagggaacgtgttgttgaggctagagatgagctccacaggatgctgaatgaggatgagctgcgtgacgctgtgctgcttgtatttgcaaacaaacaagatcttcccaatgctatgaatgctgctgaaattactgacaaagcttggtctgcattccctgcgacagcggcactggtacatccagagcacttgtgctacatcttggtgaaggggtggtatgaaggggctggaactggctttccagcaacatcttccagcaggtctttgaagctttttcggcagggctcctaagcgagaagatgtcctgaccaaccttatggc

SEQ ID NO: 78057 - protein, 91 aa, Zea mays; identical to SEQ ID NO: 77239
  misc_feature: Ceres CLONE 1563048
  misc_feature (1)..(91): Pfam Name: Arf Pfam Description: ADP-ribosylation factor family

SEQ ID NO: 78058 - DNA, 820 bp, Zea mays
  misc_feature: Ceres CLONE 1563049
  misc_feature: Encodes the peptide sequence at SEQ ID NO. 78059
  misc_feature (591)..(591): n is a, c, t, g, unknown, or other
  misc_feature (645)..(645): n is a, c, t, g, unknown, or other
  misc_feature (654)..(654): n is a, c, t, g, unknown, or other
  misc_feature (726)..(726): n is a, c, t, g, unknown, or other
ctccccgcggtggcggccgctctagaactagtggatcccccgggctgcaggaattcgtctcacccctagaaaaaccttagcttgggcaggtcctcctccctagctagctagctcgcacgccaccatgcagctcgcggcgttgtgcactgaccccgtggtgctgtgcagcgccttcctctgcctcctcctccacgtggctctccgctcgctgctgcaccctccttctgccgcctcttcctccgggcgccgcgggcagctcccgccggggccaccgggcctgccgatcctcggcgcgctgccactcgtgggcccagccccgcacgccggcctggccgcgctggcgcgcaagtacggtcccatcatgtacctgaagatgggcacggccggcgtggtggtggcgtcgtccccgcgcgcggcgcggacgttcctcaaggcgctggacgcgcggtacgccaaccggccggccgtggcgagcgccgcggacatcacgtacgggcggcagaacatggtgttcgcggactacgggcccaagtggaagctgatgcggaagctcgccaggtgcacctggctcgggggcgcgcgccgctcccnaaacttgggccttgcttgcgggcgcggcaatgcccggccacttgcctgcgcggnctttggccngaaagccggcggcgccccggaaagggcccgtcgtccttgccgggaaaactgctcggttgtgcgcccctccgnccaacaattcggtcggggcaaatccacagtggaggcccaaagcggggtgttcccaaacccccccaggggggaacgaactccaaaacagatacca

SEQ ID NO: 78059 - protein, 232 aa, Zea mays
  misc_feature: Ceres CLONE 1563049
  misc_feature: SWISSPROT Homolog: EC 1.14.13.88 Flavonoid 3',5'-hydroxylase
  misc_feature (156)..(156): Xaa is any aa, unknown, or other
  misc_feature (174)..(174): Xaa is any aa, unknown, or other
  misc_feature (177)..(177): Xaa is any aa, unknown, or other
  misc_feature (201)..(201): Xaa is any aa, unknown, or other
MQLAALCTDPVVLCSAFLCLLLHVALRSLLHPPSAASSSGRRGQLPPGPPGLPILGALPLVGPAPHAGLAALARKYGPIMYLKMGTAGVVVASSPRAARTFLKALDARYANRPAVASAADITYGRQNMVFADYGPKWKLMRKLARCTWLGGARRSXNLGLACGRGNARPLACAXFGXKAGGAPERARRPCRENCSVVRPSXQQFGRGKSTVEAQSGVFPNPPRGERTPKQIP

SEQ ID NO: 78060 - DNA, 853 bp, Zea mays
  misc_feature: Ceres CLONE 1563050
  misc_feature: Translation starting site: 236
  misc_feature (590)..(590): n is a, c, t, g, unknown, or other
  misc_feature (612)..(612): n is a, c, t, g, unknown, or other
ctccccgcggtggcggccgctctagaactagtggatcccccgggctgcaggaattcgtctcacccctagaaaaagcattagcacagaagacgagccgtgccttccgcccttcccttggctacctctgtctgtctgtgtcttgtccagtccgggtctccagggctccggcaccggcaggcagagagctaccaaaccccaccaccacgaacggccgccgccgacgagacgggggcgcatggcgactgcatcctccttcaccgccatcttcttcagcagcgccttcgcggcctgcttcgcggagccaaagtgcggctccagctgcaaaggaaggcaccactaccgtcgccaccagtggctgcagcagctgctgctggaggcacgctagccacaatcatgtgcatcgccagggaaggaaggggttgccgcgctctggaagggcgtcatccccggcctccaccgtcagttcctctatggcggcctccgcatcggcttgtatgagcctgtgaaggctttcttcgtcggaggcgctgtttgtgggtgatgtcagtttactaagcaagatccttgctgcacttaccacaggtgtgatnagcgattgttgtggcaaatccnactgatcttgtcaaagttaggttgcaagctgatggaaaagctacactatcaagaggagttattctggagcccttaatgcatacgctacaatatcagaccagaaaggtttggaagctttgttggatgggccttggtcccaatgtcgcacgccatggccttaataacaccctcccaagtggcccaccttttataagttcaaaaccgatgttttctaaaaacttcccgggttttacggaaaaag

SEQ ID NO: 78061 - DNA, 731 bp, Zea mays
  misc_feature: Ceres CLONE 1563051
  misc_feature: Encodes the peptide sequence at SEQ ID NO. 78062
ctcaccgcggtggcggccgctctagaatagtggatcccccgggctgcaggaattcgtctcacccctagaaaaatggtcggtcgtcaatcggccacgattcccagtcatcaccaattattactgtctttcgtccacagctactcatcaatgtgatcgacatgaacctcgcgtccgcggtgcgagtgttcttgtcctactgcctgctgctccaccggtggatggggtccgagcaggccggaggcgtgttcgatcaggggggccatagcgtcagcctcacccgcctcgacgaagcaagggctccgccgaggtgcgccgtgcagtcgtccctgtccagcgcggccagcctgccgccgaagccgctgctcgtcgccgcgccgcgcgagactggggagtacccggtgatcctgttcctacacggctacctcgccgtcaactccttctactcccagctgttcgagcacgtcgcctcccatggctttatcgtcgtcggacctcaggtaggtagtagttatgtaagcagtagttccgacttcagatccaccaaagtttagcttagttcacatctgcctcgtcaatcgcgcatgcagctgtacaccatacccggggccgaacccaacccgaaggaaatccaattcaggcgggggggcccgtcattcaatgggggtttagcccacccggggttgggccgttaaattcttggccactcgggggtcccgcggggaaactaaaca

SEQ ID NO: 78062 - protein, 130 aa, Zea mays
  misc_feature: Ceres CLONE 1563051
  misc_feature: SWISSPROT Homolog: EC 3.1.1.14 Chlorophyllase
MNLASAVRVFLSYCLLLHRWMGSEQAGGVFDQGGHSVSLTRLDEARAPPRCAVQSSLSSAASLPPKPLLVAAPRETGEYPVILFLHGYLAVNSFYSQLFEHVASHGFIVVGPQVGSSYVSSSSDFRSTKV

SEQ ID NO: 78063 - DNA, 836 bp, Zea mays
  misc_feature: Ceres CLONE 1563052
  misc_feature: Encodes the peptide sequence at SEQ ID NO. 78064
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
tggagctcaccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttggtggtggtggttgaacaataataagcgaggccgagctggctgccatacataggtattgtgtggtgtgtgtgaaaagagagagaaacagagttcttcagtttgctatctctctctgcatgtttggcgtcagtctttgtgctcatgtacgtacgtgtgtctacctgcatgtttggttgatccgattgcatctgctgtaacccatatattaattggtcnnnnnnnnnnnnnnnnnnnnnnnnnnaaannnnaaaaagggtcgcgccgccgcccgcgccgccaatgccagcccccctccgcgacgtcgccgccgccgctgctggcgggcccgatcacatggggcaaacgacctgtggtacggcccggaccccgtcaagtacctggggcccttctccgccaagacgcccc

SEQ ID NO: 78064 - protein, 76 aa, Zea mays; identical to SEQ ID NO: 8464
  misc_feature: Ceres CLONE 1563052
  misc_feature (1)..(76): Pfam Name: Metallothio_2 Pfam Description: Metallothionein

SEQ ID NO: 78065 - DNA, 789 bp, Zea mays
  misc_feature: Ceres CLONE 1563053
  misc_feature: Encodes the peptide sequence at SEQ ID NO. 78066
  misc_feature (588)..(588): n is a, c, t, g, unknown, or other
  misc_feature (693)..(693): n is a, c, t, g, unknown, or other
  misc_feature (725)..(725): n is a, c, t, g, unknown, or other
ggagctccccgcggtggcggccgctctagaactagtggatcccccgggctgcaggaattcgtctcacccctagaaaaagccaaaaccctagcccttgcgccgccgcctcctccgccacccagcgctcgagctcctcgcgtcctgcgagcgcgcgccgcaacgccaccatgaagttcaacatcgcgaacccttccaccgggtgccaaaagaagctggaaatcgatgacgaccagaagctgcgtgccttttatgaccgaaggatatcccaggaggtcagtggtgatgctctgggtgaggagttcaagggttatgtcttcaagatcatgggtggatgtgacaagcaaggcttcccaatgaagcaaggagttttgacttctggtcgtgttcgtcttctgctccataggggcactccctgcttccgtggttatggcaggcgtaatggtgagcgcaggaggaagtctgtccgtggttgcatcgtgagccaagacctatctgttatcaacttggtgattgtgaagaaaggtgagaatgatctgcctggtctgactgacactgagaagccagggatgagggggcccaagagggccntcaagatcagaaagctgttcaaccttaacaaggatgatgatgtaccgcagtacgttgacacataccgcaggaaattcactaccaagaacggcaagaaaggcagcnagggcaccttagatcccacgggcttgtgacancccttgaccctccaaaaaggaagcgtgctagaatcgctgaccaggaagaagaagataacttaaa

SEQ ID NO: 78066 - protein, 184 aa, Zea mays
  misc_feature: Ceres CLONE 1563053
  misc_feature (1)..(129): Pfam Name: Ribosomal_S6e Pfam Description: Ribosomal protein S6e
  misc_feature (141)..(141): Xaa is any aa, unknown, or other
  misc_feature (176)..(176): Xaa is any aa, unknown, or other
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPGMRGPKRAXKIRKLFNLNKDDDVPQYVDTYRRKFTTKNGKKGSXGTLDPTGL

SEQ ID NO: 78067 - DNA, 795 bp, Zea mays
  misc_feature: Ceres CLONE 1563057
  misc_feature: Encodes the peptide sequence at SEQ ID NO. 78068
ctccccgcggtggcggccgctctagaactagtggatcccccgggctgcaggaattcgtctcacccctagaaaaaacaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaagttggagctggtgggacggggtcctcctacctgggccaggccgctgccgttctccatctcgacgctcatcctggatcgagggtgctccgtgaatcggcctacatcggagttcccagcgcaacgcccgagctcgaccccgggagaagaaagctgttcccccgggcggct

SEQ ID NO: 78068 - protein, 225 aa, Zea mays
  misc_feature: Ceres CLONE 1563057
  misc_feature (63)..(189): Pfam Name: Chloroa_b-bind Pfam Description: Chlorophyll A-B binding protein
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKLELVGRGPPTWARPLPFSISTLILDRGCSVNRPTSEFPAQRPSSTPGEESCSPGR

SEQ ID NO: 78069 - DNA, 764 bp, Zea mays
  misc_feature: Ceres CLONE 1563058
  misc_feature: Encodes the peptide sequence at SEQ ID NO. 78070
  misc_feature (686)..(686): n is a, c, t, g, unknown, or other
  misc_feature (697)..(697): n is a, c, t, g, unknown, or other
  misc_feature (760)..(760): n is a, c, t, g, unknown, or other
ctcaccgcggtggcggccgctctagaactagtggatcccccgggctgcaggaattcgtctcacccctagaaaatccccagtccccaccacctccctgtatccctcctccccttctggccgacgaaaccctacgcgcgcgcgctgccaagacctcgccgccgacgcctactccgactccgacgccgcagtcgtgatgtacgccgacaggacctcgggcaggaaacgctctgtaatggaccgcctcggctcgggcggcggctcgcgctcgcggtccgacgacgcaaaaaggttttgccaggatgatgggacatggagacgtgagctttataaggattctagaggaactcagacttcatctgaacctacttccagaaatctggaatcgaacaaaaaatcccaagtgcagcaaaaggttgtgaagaaattaccagtttcagatcttcgtggaaagttatctggtgtcgcgagccagcgccctcaacttagcagtactgttcaggtcccaaaacctgtaaaagaggttattaagagcaacaaacctgttcaaaagagagaccccgctccaactactgcccctcctgacatcaagaaacccagtgcacctgcacccgtaccagcaccatctgcactaccaaagcaatcccagaacaagattgatgcttcgcttgacagtttactgaagtctnctgatctagangagtatttgataaatttcagggctgaagaggtgatatgaaaagcattggtgtacatgaacgangaaa

SEQ ID NO: 78070 - protein, 180 aa, Zea mays
  misc_feature: Ceres CLONE 1563058
  misc_feature (165)..(165): Xaa is any aa, unknown, or other
  misc_feature (168)..(168): Xaa is any aa, unknown, or other
MYADRTSGRKRSVMDRLGSGGGSRSRSDDAKRFCQDDGTWRRELYKDSRGTQTSSEPTSRNLESNKKSQVQQKVVKKLPVSDLRGKLSGVASQRPQLSSTVQVPKPVKEVIKSNKPVQKRDPAPTTAPPDIKKPSAPAPVPAPSALPKQSQNKIDASLDSLLKSXDLXEYLINFRAEEVI

SEQ ID NO: 78071 - DNA, 838 bp, Zea mays
  misc_feature: Ceres CLONE 1563061
  misc_feature: Translation starting site: 165
  misc_feature (640)..(640): n is a, c, t, g, unknown, or other
ccccgcggtggcggccgctctagaactagtggatcccccgggctgcaggaattcgtctcacccctagaaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgctgccgctgccaaggcctcttctaaaagaaagaaagtggtaaatcctccgtccttatggatgtaaaaccatgggacgatgagactgatatgaagaagctggaggaggctgtccgcagtgtccagaatganggtctgacttggggagcatcaaagcttggtgcctgttggatacggcatcaagaagatgactatcatgttgacattttgtcgacgatctttgtgtcatcgacactctaattgaggaccaccttacgcagagccccatcatgagtacgtccagagttgccgacattgtggcttcaaccagatctagagttcaatttctgt

SEQ ID NO: 78072 - DNA, 765 bp, Zea mays
  misc_feature: Ceres CLONE 1563064
  misc_feature: Encodes the peptide sequence at SEQ ID NO. 78073
  misc_feature (554)..(554): n is a, c, t, g, unknown, or other
  misc_feature (683)..(683): n is a, c, t, g, unknown, or other
ctccccgcggtggcggccgctctagaactagtggatcccccgggctgcaggaattcgtctcacccctagaaaaagaggagactttttaactttcacggaaatttcccctctcttggtctcttctcttgcgcgttcctcttcttcctagtcctaggctactttcttcgatcccaactccgagtcgcctgtcatctctctctaccagattagattggggatctcatctcatccgaatccttcatagtattacacaaccagcaaggccgcccgcttgccggcaacatgaagaagatcttcggcgccaagaagaacaaggatccgccgcccacaatccaggacgcaaccgacagaatcaccaagcgcggcgacaccgtcgatgaaaagatcaagaagctcgacgccgagctcgcgcgctacaaggagcagatcaagaagacgcgcccaggccccgctcaggaggccgtcaaggcacgagccatgagggtcctcaagcagcgcaggatgtacgaagggcagcgtgacatgctctacaaccaaacatataaccttgaccnagttgcttttgcggcagagggacttaaagatgctcagcaaactatgactgcgatgaaggctgccaataaagagctcaaagggatgatggaaactgtcaagctcgaagatattgatagtatgcaagatgnagatgatggatcctttatgggatgtggagcactgaaattccaagaaactccttggcagaaagctaacaacgtccccagatga

SEQ ID NO: 78073 - protein, 160 aa, Zea mays
  misc_feature: Ceres CLONE 1563064
  misc_feature (12)..(161): Pfam Name: Snf7 Pfam Description: Snf7
  misc_feature (91)..(91): Xaa is any aa, unknown, or other
  misc_feature (134)..(134): Xaa is any aa, unknown, or other
MKKIFGAKKNKDPPPTIQDATDRITKRGDTVDEKIKKLDAELARYKEQIKKTRPGPAQEAVKARAMRVLKQRRMYEGQRDMLYNQTYNLDXVAFAAEGLKDAQQTMTAMKAANKELKGMMETVKLEDIDSMQDXDDGSFMGCGALKFQETPWQKANNVPR

SEQ ID NO: 78074 - DNA, 725 bp, Zea mays
  misc_feature: Ceres CLONE 1563065
  misc_feature: Encodes the peptide sequence at SEQ ID NO. 78075
tggagctccccgcggtggcggccgctctagaactagtggatcccccgggctgcaggaattcgtctcacccctagaaaaagctgccatgaggcccgaacagttgaagctactagcgtgtagctagggaagagaagcgcgcgagtagctagcagacgtacgtaggcagaagcctagctgggtttgaagggccccgatcgatgatcccctacgcgactgcggcggaggcggagggagcactggggcgcaccatgacgtgggctgagacagcatggtacgagtactcggcggtgatgccagattcctggctgcactgccacaccacatttatcctgttcgtcatctacagcatcgccccgctgcccctgctactcctagagcagttcgctccgtccgtcgtgctgccgtacaagctgcagcccccgggtacggctgcccccggcagcctccctcagctgctacatggacgcggcctgcatctttccgctcgccgttggcccttcagttcgtctcctatcctgcggtcgccaagatactaaggacccgaatgggactgcccgttgccgtcggtgagggaagacatcgcgcagctagtcgtatactctccaagtggaagattaccctcagctactggaatggcaccgtctgctgcaacaacccagggggtgctacgaagaaagatccaacgcggtcccaccacgaggtcaccggggtccttaaaggttttc

SEQ ID NO: 78075 - protein, 112 aa, Zea mays
  misc_feature: Ceres CLONE 1563065
MIPYATAAEAEGALGRTMTWAETAWYEYSAVMPDSWLHCHTTFILFVIYSIAPLPLLLLEQFAPSVVLPYKLQPPGTAAPGSLPQLLHGRGLHLSARRWPFSSSPILRSPRY

SEQ ID NO: 78076 - DNA, 821 bp, Zea mays
  misc_feature: Ceres CLONE 1563066
  misc_feature (392)..(392): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (398)..(398): n is a, c, t, g, unknown, or other
  misc_feature (400)..(400): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (497)..(497): n is a, c, t, g, unknown, or other
  misc_feature (507)..(507): n is a, c, t, g, unknown, or other
  misc_feature (508)..(508): n is a, c, t, g, unknown, or other
ctccccgcggtggcggccgctctagaactagtggatcccccgggctgcaggaattcgtctcacccctagaaaaagttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctatntnnnananannannnnnnaaaaaaaaaaaaaaaaaaaaaaaaaagaaaaaaaaaaaaaataaaaaaaaaaaaaaaaaaaaaaaaaaaaaaaaaagaaaaaaaaanaaaaaaaaanngggggggggccccctctgttttccccaaaaaaaaatcgaaccccgggattttgggcccccttagggccccctggggaaaacccattttttgcccccccccttttcccaagcccaaatgttttaggggttgcctccccctaagggcaaaaaccaaaaagggtcgggggccacctcccccaaagaaaggggccccaatataaaacaaaggggccaggggcttttttttttccccaaaaggggggcggggaacccgcctcgggggggcccccccctggggccttttgagaaaaaaccttttccccggggggggccc

SEQ ID NO: 78077 - DNA, 799 bp, Zea mays
  misc_feature: Ceres CLONE 1563067
  misc_feature: Encodes the peptide sequence at SEQ ID NO. 78078
  misc_feature (771)..(771): n is a, c, t, g, unknown, or other
  misc_feature (772)..(772): n is a, c, t, g, unknown, or other
  misc_feature (775)..(775): n is a, c, t, g, unknown, or other
ccccgcggtggcggccgctctagaactagtggatcccccgggctgcaggaattcgtctcacccctagaaaaatccgttcggatccgagtgtcctgcagagcccatcctgttcctgtccccctcgagcaatcgagctcagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgccccgccactggctgctgggggccacggacatcgtccctggctgacgggcaggaggaggccaagaccctggaggccaggctcacccaggtcagcgaggagaaccggcggctcaccgagatcatcgcctacatgtacgccagccaggtcgccgcgcagcggagtcccgacggcaggaagaggagcagggacagcctggagccgtcgaattcgagcgacgccaacgctgccgtcgagagcgccgccctcagcgacgaaggcacgtgcaggcggatcaagctcacccaggtctgcaccaagatcgacccctccgacaccacgctcgccgtcaaagacggctaccagtgggcgcaagtacgggcaagaagtgtacgcgcgactacccgtcccccgagagcctacttccgctgcgcatacgcaaccatcctggcccgttcaagaaataagtgcaaanngancgcggaggacaaccccccgtgctg

SEQ ID NO: 78078 - protein, 203 aa, Zea mays
  misc_feature: Ceres CLONE 1563067
  misc_feature (195)..(195): Xaa is any aa, unknown, or other
  misc_feature (196)..(196): Xaa is any aa, unknown, or other
MMLLMDSGSRGDCSPVCLDLSVGLSPPSPGSGPETTADAERLDRPATGCWGPRTSSLADGQEEAKTLEARLTQVSEENRRLTEIIAYMYASQVAAQRSPDGRKRSRDSLEPSNSSDANAAVESAALSDEGTCRRIKLTQVCTKIDPSDTTLAVKDGYQWAQVRARSVRATTRPPRAYFRCAYATILARSRNKCKXXAEDNPPC

SEQ ID NO: 78079 - DNA, 866 bp, Zea mays
  misc_feature: Ceres CLONE 1563068
  misc_feature: Encodes the peptide sequence at SEQ ID NO. 78080
  misc_feature (477)..(477): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
ctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttggtggtggtggttgaacaataataagcgaggccgagctggctgcatacatangtattgtgtggtgtgtgtgaaaaaaaaaaaaacannnagtctcagtttgctatctctctctgcatgtttggcgtcagtctttgtgctcatgtacgtacgtgtgtctacctgcatgttggtttgatccaattgcatctgctgtaaccattttataaattgggcaaaannnnnnnnnnnnnnnnaaaaaaaaannnaaaaaggggccgccccccccccccccccccaatgccagccccccccccgaaattccccccccccccttgttgggggccggaacccctggggcaaaaaaccgtggggaacgccccgaaaccccttaaaatccttgggccccttttcccccccaaaaaccccttttacctgatacggggaattccccggggaaaatc

SEQ ID NO: 78080 - protein, 76 aa, Zea mays; identical to SEQ ID NO: 8464
  misc_feature: Ceres CLONE 1563068
  misc_feature (1)..(76): Pfam Name: Metallothio_2 Pfam Description: Metallothionein

SEQ ID NO: 78081 - DNA, 835 bp, Zea mays
  misc_feature: Ceres CLONE 1563070
  misc_feature: Encodes the peptide sequence at SEQ ID NO. 78082
  misc_feature (335)..(335): n is a, c, t, g, unknown, or other
  misc_feature (595)..(595): n is a, c, t, g, unknown, or other
tccccgcggtggcggccgctctagaactagtggatcccccgggctgcaggaattcgtctcacccctagaaaaaactcccatccccgcacttcaccggcctcctcctccttcccgtccatcgccgtcgccggggcgccctacaacttcaaaatggcggctaccgccaccgccatggctatagcaactatctcccccgccgctccgatcccatccgcgcccttcccatccctccccctcggcctccgcctccgccctcaacccctccttttcgctgcttcccgccgccgcctcctccatgttcccaaagccgcctcctgggacgaatcccgtccccngaggaaatggtggagaatgcggaggaaatccgttgcccgctgggggacgacgatgtacgagtgacgagaaagccgcggccccgagcccggtgtccctcctcccgaagttccaagttcgccgccggcaacccgaagggctaacgtcgaaccccgcggccgttttgacaaaccttaccgcccggattccccacaaaagaacttgggccggggcggcccttacaaaattctcctcttaaggggggcccgggcccttttctcgngggccaaaaaaacattgggctgggggaaaaaaaagtggcctcctccaaaagagcaaaaagggggggtcaaacaccccccctttcataaatttggggaacccggggggaagacaaaagccccccccacaaaacaaaaaaataaattttctcccccccaaacacccgcccctccctttgtggaaaaggggtataaaaccccgcggggttaaccaacaaagagggggcccgcccaaaaagagg

SEQ ID NO: 78082 - protein, 82 aa, Zea mays
  misc_feature: Ceres CLONE 1563070
  misc_feature (62)..(62): Xaa is any aa, unknown, or other
MAATATAMAIATISPAAPIPSAPFPSLPLGLRLRPQPLLFAASRRRLLHVPKAASWDESRPXRKWWRMRRKSVARWGTTMYE

SEQ ID NO: 78083 - DNA, 776 bp, Zea mays
  misc_feature: Ceres CLONE 1563072
  misc_feature: Encodes the peptide sequence at SEQ ID NO. 78084
  misc_feature (556)..(556): n is a, c, t, g, unknown, or other
ctccccgcggtggcggccgctctagaactagtggatcccccgggctgcaggaattcgtctcacccctagaaaaatgaggtcttcactgagtataaactcccaaagtgaggtgacatggatgacatgggcagcacttgaggaggaacagggggatccagttcgagctgaagaaattcggaacctttactttcagcagcgtactgaagttgtggatgatgcatcctgggtcataggcttcctcgacatcatcgaccctgccctagacagcgtgaagaggctactaaacctggatcagccttctagaccggcgaggcaagatgatgttaaaagcacaacagaaccgtgtcctcccactgccaagtcttcagaaacttctgcgggcaatgatgctcgtaacaacgggagcgaagcaatggggactctaacaagtgatttcgatttggatgctttcattaagaagaggctggccctcgacccatcggagctggatgccgtgctcgagggctctgacccgaggggtgttgtttctcagaggaggaaacagcggctgcccagnaagccactccctcttctccctgtcccgtaaattttccagatcggtctgtctcatttccattccaccggtaaaatcataaggggctagtttgtttgagactccattttttttccaaagtgtaaaaaataaaatcccctgaaaaaaatgaggttatcaaactagccctaaaatcctaactgtagcagcctgcatacgtggaatatggtgaggactaaaggaa

SEQ ID NO: 78084 - protein, 170 aa, Zea mays
  misc_feature: Ceres CLONE 1563072
  misc_feature (161)..(161): Xaa is any aa, unknown, or other
MRSSLSINSQSEVTWMTWAALEEEQGDPVRAEEIRNLYFQQRTEVVDDASWVIGFLDIIDPALDSVKRLLNLDQPSRPARQDDVKSTTEPCPPTAKSSETSAGNDARNNGSEAMGTLTSDFDLDAFIKKRLALDPSELDAVLEGSDPRGVVSQRRKQRLPXKPLPLLPVP

SEQ ID NO: 78085 - DNA, 757 bp, Zea mays
  misc_feature: Ceres CLONE 1563074
  misc_feature: Encodes the peptide sequence at SEQ ID NO. 78086
ctccccgcggtggcggccgctctagaactagtggatcccccgggctgcaggaattcgtctcacccctagaaaaacccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaacaaggacatttgagatagaattggcgatgttgtcaagtgctcaccatgtggagatgacccccagtgatgctggctttcaggacaggtatgttgttcaggaggtcatcaaagagatggcgaagaacaggccaattgatgccaaaggcaagagagcatttaaagtccttgtgttgaatgaggtcgacaagctctcacgagaagcccagcattccctccgcaggactatggaatagtatagctcatcatgtagactgatcctatgctgtaacagcctcctcaaagtgacagaagctgtaagatcccgtttgcttaaatgtgcgaggtaatgcacccagccgagatcagatttgtcccaatttct

SEQ ID NO: 78086 - protein, 155 aa, Zea mays
  misc_feature: Ceres CLONE 1563074
  misc_feature: SWISSPROT Homolog: EC 2.1.2.11 3-methyl-2-oxobutanoate hydroxymethyltransferase
MLWVDKYRPKTLDKVTVHDQVAQNLRKFVSEQDCPHLLFYGPSGSGKKTLILALIKQMFGAGAEKVKLENKTWKIDTGTRTFEIELAMLSSAHHVEMTPSDAGFQDRYVVQEVIKEMAKNRPIDAKGKRAFKVLVLNEVDKLSREAQHSLRRTME

SEQ ID NO: 78087 - DNA, 834 bp, Zea mays
  misc_feature: Ceres CLONE 1563075
  misc_feature: Encodes the peptide sequence at SEQ ID NO. 78088
  misc_feature (565)..(565): n is a, c, t, g, unknown, or other
  misc_feature (579)..(579): n is a, c, t, g, unknown, or other
  misc_feature (614)..(614): n is a, c, t, g, unknown, or other
  misc_feature (664)..(664): n is a, c, t, g, unknown, or other
  misc_feature (666)..(666): n is a, c, t, g, unknown, or other
  misc_feature (667)..(667): n is a, c, t, g, unknown, or other
  misc_feature (671)..(671): n is a, c, t, g, unknown, or other
  misc_feature (674)..(674): n is a, c, t, g, unknown, or other
  misc_feature (677)..(677): n is a, c, t, g, unknown, or other
  misc_feature (744)..(744): n is a, c, t, g, unknown, or other
ctccccgcggtggcggccgctctagaactagtggatcccccgggctgcaggaattcgtctcacccctagaaaaatctgctcagctcgaacgaacaaaaagaactcccctcggccctctcctcttgtgcttctgcttccccaccgagtctcctcaaccccaggcactcgccctctgtcggtctgtcccctcccttcctcgcctccgatgccgccgccgccgccgcttctcgagccgcgcgactacctcggcgccggcgccacctcgtcgtgctgctcgtcgtcctgctcctccggccgcgagggcgcggggccccacctcgcgctgcggctcgggcttccggggtccgacgactcccccggccgcagcgcggacgcggagcacgccggcgcccacgtcgacgccgcgctcaccctcggccccgcccccgcccccgcgcctcccaggggcagcgcccagcgcgggttcgccgactccctcgaccggtccgcgaagcgggacggcgttgccgccgatgacgctggctggggcgtcacgccggttacttgagctgctgccggagctccncccgctgccaaggnacaatttgtttgatggccgcctgttacgagctccngcgaaaaaaccctcagctgcgcgtgccccaaaaacaaattgggggacgtnanngtanganttnagccggaatccctgttatgtccaggtcagcatgggatggagcccctaccctaagggaaggtggaccntcagacctattcaagctatgaggatctcctcgctgggtctggaaaaaaatgtcagtttgcctcatcactgggtccaaacagttcatgcaa

SEQ ID NO: 78088 - protein, 113 aa, Zea mays
  misc_feature: Ceres CLONE 1563075
MPPPPPLLEPRDYLGAGATSSCCSSSCSSGREGAGPHLALRLGLPGSDDSPGRSADAEHAGAHVDAALTLGPAPAPAPPRGSAQRGFADSLDRSAKRDGVAADDAGWGVTPVT

SEQ ID NO: 78089 - DNA, 807 bp, Zea mays
  misc_feature: Ceres CLONE 1563076
  misc_feature: Encodes the peptide sequence at SEQ ID NO. 78090
  misc_feature (350)..(350): n is a, c, t, g, unknown, or other
  misc_feature (401)..(401): n is a, c, t, g, unknown, or other
  misc_feature (501)..(501): n is a, c, t, g, unknown, or other
  misc_feature (597)..(597): n is a, c, t, g, unknown, or other
  misc_feature (598)..(598): n is a, c, t, g, unknown, or other
  misc_feature (613)..(613): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (659)..(659): n is a, c, t, g, unknown, or other
  misc_feature (707)..(707): n is a, c, t, g, unknown, or other
  misc_feature (737)..(737): n is a, c, t, g, unknown, or other
  misc_feature (745)..(745): n is a, c, t, g, unknown, or other
  misc_feature (807)..(807): n is a, c, t, g, unknown, or other
ccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcngcggcggtggcgcacgcgttcgcgctgttcgtggcggtgtctgtgggcgcnaacatctccggcgggcacgtgaaccctgccgtggacctttggggccttcgggggcgggcaactcacccctggtccggggggctcctgtacttgggtgggncaacttgctggggtccaccgggggggggcttcctgctccgccttctccacggggggggaaggccccggggaacctttggggctgaccggccgtgtnngggggggggaggggnctggggggttgggaaatctccggnnnnaccttcgggggcggggggnaaccccggggacccccccccggggcgggggcacccacaaaaagggggnaaccctggggggcccacttccccccccccntttggccnagggggcttttcatgcggggggggggcggcgaaaatttccctctagggtgggggggcggccn

SEQ ID NO: 78090 - protein, 206 aa, Zea mays
  misc_feature: Ceres CLONE 1563076
  misc_feature (13)..(206): Pfam Name: MIP Pfam Description: Major intrinsic protein
  misc_feature (111)..(111): Xaa is any aa, unknown, or other
  misc_feature (143)..(143): Xaa is any aa, unknown, or other
  misc_feature (148)..(148): Xaa is any aa, unknown, or other
  misc_feature (156)..(156): Xaa is any aa, unknown, or other
  misc_feature (157)..(157): Xaa is any aa, unknown, or other
  misc_feature (192)..(192): Xaa is any aa, unknown, or other
MPINRIALGSHQEVYHPGALKAAFAEFISTLIFVFAGQGSGMAFSKLTGGGPTTPAGLIAAAVAHAFALFVAVSVGANISGGHVNPAVDLWGLRGRATHPWSGGLLYLGGXTCWGPPGGGFLLRLLHGGGRPRGTFGADRPCXGGGGXWGVGKSPXXPSGAGGNPGDPPPGRGHPQKGGNPGGPTSPPPFGXGGFSCGGGAAKISL

SEQ ID NO: 78091 - DNA, 912 bp, Zea mays
  misc_feature: Ceres CLONE 1563077
  misc_feature: Encodes the peptide sequence at SEQ ID NO. 78092
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (358)..(358): n is a, c, t, g, unknown, or other
  misc_feature (387)..(387): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnaaaattggggctccccgcggtggcggccgctctagaactagtggatcccccgggctgcaggaattcgtctcacccctagaaaaaacaaacaacgccaccctgtactagataccatcagggtcttcaaccagggcaggtttatgttcaggtggcactgccagcagaagtgatccgttgacttcagctatgggcaacctgtgctgctgtgttcaagtcgaccagtcgactgtggccatcaggaagcagtttggcaagtttgacagcgtgcttgagccangatgccactgcatgccttggttcgccggncagcgtgtagctgggcaactcacactcaagctgcagcaactggatgtgcggctgtgaagacaaaaacaaagggacaatgttttcgttgaaatgtgggtggcattcaatttcagttaccgccgcttcttgcttgaacaaaaccaggtgaaccccttttctaacaaactggagccaaaccaaagggtgccccaaaaatccaaaaccctaaacggttttttgttagaacgcgggggtttctctcaaaaaaaaaaaaagagggggtgtttttttcccccacaaaaaaaaccccccccttttttttgttttgtgagaaaaaaaaaaatatttttttttttctcccaaaaaaaaaaaaaaaaaaaaaaaaaatttcttccccccggggggggggggggggggagggggaaaaaaaaaaaaaacttttttttaaaaaaaaaggccccccccccccccccgcctttttttatttttttttttttttttaaaaaaaaaaaggggggaacgccaccccccctcccctttgggggc

SEQ ID NO: 78092 - protein, 58 aa, Zea mays
  misc_feature: Ceres CLONE 1563077
  misc_feature (31)..(31): Xaa is any aa, unknown, or other
MGNLCCCVQVDQSTVAIRKQFGKFDSVLEPXCHCMPWFAGQRVAGQLTLKLQQLDVRL

SEQ ID NO: 78093 - DNA, 786 bp, Zea mays
  misc_feature: Ceres CLONE 1563079
  misc_feature: Encodes the peptide sequence at SEQ ID NO. 78094
ggagctccccgcggtggcggccgctctagaactagtggatcccccgggctgcaggaattcgtctcacccctagaaaaaaccaaacactgcgtaatgataccgccgccggcaccttggcagctgacgccacctatcgacgcttccctttatggccggagcactagttgggagactcggccgccatccgagctctttggtcctcctaatactgccccgacacaccgccgcacaccatcgggtgcactctccttcatcctcccaaagtgagtattcaaaaatggctgatccagctgacaggaatggacacggcgctctcacccgggtgctattctgtgatacagattggcctgcttctactaactacacgagcgagtatttgcatgactatccagtgccttcaggttagatgaagtacgtctcgagcacgtaacctgatgttattcactcctatgcatatattgtttggctagaaaataccccgtatctgattccggaaatgcttggcctaggccacgtccgaccaagattaacgatgcaagaaccggttgttggggtcaagaaaggggattgacgtggaattgcttgttcccagttcccccttattcctaggttgccccaacttccggggaatttccccatggggaaacccctgggcccttggccccaaaaaaggggaaaactctcccccaaacccagggaaattcccggggaaaccattacgaaaaaatggttttctttttttgtaaaccggaaaaaaaaccttggggttttacaaaatttgaggaa

SEQ ID NO: 78094 - protein, 85 aa, Zea mays
  misc_feature: Ceres CLONE 1563079
MAGALVGRLGRHPSSLVLLILPRHTAAHHRVHSPSSSQSEYSKMADPADRNGHGALTRVLFCDTDWPASTNYTSEYLHDYPVPSG

SEQ ID NO: 78095 - DNA, 804 bp, Zea mays
  misc_feature: Ceres CLONE 1563081
  misc_feature: Encodes the peptide sequence at SEQ ID NO. 78096
ctccccgcggtggcggccgctctagaactagtggatcccccgggctgcaggaattcgtctcacccctagaaaaagccctcttccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaagagttcattgcagatgtgcttgggggtcgaggtgtttaggcagactattgctggaaatatccttgtggggagttactgcgccttctctaacagggggtggttttgttcatccccatacatccggtgaagaacttgacgagctcttcacgctcctccaagttcctcttggcgcaaggactggtaacaaaaggaagctattcattgca

SEQ ID NO: 78096 - protein, 138 aa, Zea mays
  misc_feature: Ceres CLONE 1563081
  misc_feature (3)..(138): Pfam Name: eIF-6 Pfam Description: eIF-6 family
MATRIQFENNCEIGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACNDHVALTHPDLDKETEEFIADVLGGRGV

SEQ ID NO: 78097 - DNA, 757 bp, Zea mays
  misc_feature: Ceres CLONE 1563086
  misc_feature: Encodes the peptide sequence at SEQ ID NO. 78098
ctccccgcggtggcggccgctctagaactagtggatcccccgggctgcaggaattcgtctcacccctagaaaaaactcccgactccacctctctccgatcgtctcatcttcttccttctcttccaccacatccttgctatctcatccggatcgaccagtacacgccccagtagtactaaagaaccagtttcgttctgagtaaaacatggcggcgtcgccttccccgtccggcagcggcggcggcaaggccggcgtggaccggatcaagggcccctggagccccgaggaggacgaggccctgcagcgcctcgtgcgccgccacggcgcgcgcaactggtccctcatcagccgctccgtcccgggccggtccggcaagtcgtgccgcctccggtggtgcaaccagctgtcgccgcgggtggagcaccgccccttcacgccagacgaggacgacgccatcctccgcgcgcacgccaggttcggcaacaagtgggccaccatcgcgcgcctcctctccggacgcacggacaacgccatcaagaaccactggaactccacgctcaagcgcgagcgcgagcgcgagcgcgagtactacgccgatgcgcgccccggccccggcgatcagcgctcgctcaagcgcaccagcagcgacaggcccccccggaagcccgtcccgggtcgaacttcagcgactccagccaccagagcctgtcccaccgtgatgccgtcagccgccttcttacggcgtcacctcccagca

SEQ ID NO: 78098 - protein, 184 aa, Zea mays
  misc_feature: Ceres CLONE 1563086
  misc_feature (21)..(67): Pfam Name: Myb_DNA-binding Pfam Description: Myb-like DNA-binding domain
  misc_feature (73)..(118): Pfam Name: Myb_DNA-binding Pfam Description: Myb-like DNA-binding domain
MAASPSPSGSGGGKAGVDRIKGPWSPEEDEALQRLVRRHGARNWSLISRSVPGRSGKSCRLRWCNQLSPRVEHRPFTPDEDDAILRAHARFGNKWATIARLLSGRTDNAIKNHWNSTLKREREREREYYADARPGPGDQRSLKRTSSDRPPRKPVPGRTSATPATRACPTVMPSAAFLRRHLPA

SEQ ID NO: 78099 - DNA, 790 bp, Zea mays
  misc_feature: Ceres CLONE 1563087
  misc_feature: Encodes the peptide sequence at SEQ ID NO. 78100
  misc_feature (521)..(521): n is a, c, t, g, unknown, or other
  misc_feature (641)..(641): n is a, c, t, g, unknown, or other
ctacccgcggtggcggccgctctagaactagtggatcccccgggctgcaggaattcgtctcacccctagaaaaaaccgagaatctttcaccctcctgacctctctctctcctcttctccctcccgtgagtgagtgagctggagccaagctagccgagcgagtgatggcatggggagcttgcactgctgcggcagctgctctccttctgctcctcctcctcctcgccgccgccgcagcaggtggtaacggcggcgtgcattgccttgaccttgaccttgaggaggggaggcggcaccatctgagcaggagagccttgcaagggaggcagaggcggcaccacctgaggtcaagggcggtgggtggcgccacggtgctcgagctgaggcaccacagcttcagccctgcaccggccaacagcagggaggaaggaggcggacgctctcctgtccgccgacgccgcgcgcgtctcgtcgctgcaagggcgcatagagcactaccggctgacgacgaccagctcgtcngccgaggtggcggtgacggcgtcaaaggcgcaggtgccccgtcagctcgggcgcgaggctccggacgctgaactacgtgggcacccttggggctgggcggcggcaagccaacggtgatcnttggacccggccagcgaaccttaaattgggtgcaattgcccccccttgccaaatcttggccccaaccaaaagggcccccttgttttaaaccttcctttgttgcccgttttaaaaccggggggggccggggaaaaccccccccctgggac

SEQ ID NO: 78100 - protein, 142 aa, Zea mays
  misc_feature: Ceres CLONE 1563087
  misc_feature (120)..(120): Xaa is any aa, unknown, or other
MAWGACTAAAAALLLLLLLLAAAAAGGNGGVHCLDLDLEEGRRHHLSRRALQGRQRRHHLRSRAVGGATVLELRHHSFSPAPANSREEGGGRSPVRRRRARLVAARAHRALPADDDQLVXRGGGDGVKGAGAPSARARGSGR

SEQ ID NO: 78101 - DNA, 748 bp, Zea mays
  misc_feature: Ceres CLONE 1563088
  misc_feature: Encodes the peptide sequence at SEQ ID NO. 78102
ctccccgcggtggcggccgctctagaactagtggatcccccgggctgcaggaattcgtctcacccctagaaaaatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaagccaacgacacatcaagatcgatctggagaccaacaagatggtgacctcatcaaggttgatgttggcaacgtcgtcatggttgactggtggaagaacactgggccggggtgggtggttatcaagaaccgggaaga

SEQ ID NO: 78102 - protein, 199 aa, Zea mays
  misc_feature: Ceres CLONE 1563088
  misc_feature (94)..(182): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKPTTHQDRSGDQQDGDLIKVDVGNVVMVDWWKNTGPGWVVIKNRE

SEQ ID NO: 78103 - DNA, 736 bp, Zea mays
  misc_feature: Ceres CLONE 1563090
  misc_feature: Translation starting site: 270
  misc_feature: SWISSPROT Homolog: EC 2.5.1.6 Methionine adenosyltransferase
ctccccgcggtggcggccgctctagaactagtggatcccccgggctgcaggaattcgtctcacccctagaaaaatgcgctgcggacgggtcggatctgagacgagacgatccccccctcccctcaaccggaacttgttttaccccatctcatcccactgactccacccacccacccgcccgctgcctccgccggatctcgtcggactcggatccgcccgaccacgaccaccccgcgccgccgccgcgcagcagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaaggtgcttgtgaacattgagcagcagtccccctgatattgctcagggtgtgcacggccacttcaccaagcgccccgaggagattggagctggtgaccaggggcacatggtttgggtatgcgactgacgagacccctgagctgatgcccctcagccatgtcccttgcaccaagctttggtgctcgttc

SEQ ID NO: 78104 - DNA, 827 bp, Zea mays
  misc_feature: Ceres CLONE 1563094
  misc_feature: Encodes the peptide sequence at SEQ ID NO. 78105
ctccccgcggtggcggccgctctagaactagtggatcccccgggctgcaggaattcgtctcacccctagaaaaatcgccgcaacgaattcccggtctccaaccagccggccagccaccgcagacgacccctagttccgcgtccccgacccgaaccctcgagttcgcacgggctccggccagattcgcgcggtctaagcttcgaatcggcgcatggaggcagcagtagccgcggcactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaggcgaagcagtgtggtcagggcctcctggtccccctcggagtctctgccaccgtcctcgtcgatggcgccgctcaggatggaatcgcccgcggggcagctactctcccagattcttcacacgcacccgcacctactgcctgccgccgccgagcagcagctcgagctgctccagaccgaccgcgaggcagagaaggataaggataaggagagcgatgctggcgacaagctggctccgacaggtgtcgacctcatgctgtacaggcggattggctcagtaaaggagaagggacgggagggagacttttggaggagatactctatggctctgggttgtttgaaaagtttgttggaggcccggcgttttcccttgggttccgggacttcttcacggcttccattcgaactcttctgggaaaaaaattgtaatacaggggggcaaaaatcctggt

SEQ ID NO: 78105 - protein, 129 aa, Zea mays
  misc_feature: Ceres CLONE 1563094
MAPLRMESPAGQLLSQILHTHPHLLPAAAEQQLELLQTDREAEKDKDKESDAGDKLAPTGVDLMLYRRIGSVKEKGREGDFWRRYSMALGCLKSLLEARRFPLGSGTSSRLPFELFWEKNCNTGGQKSW

SEQ ID NO: 78106 - DNA, 841 bp, Zea mays
  misc_feature: Ceres CLONE 1563095
  misc_feature: Translation starting site: 167
  misc_feature: SWISSPROT Homolog: EC 1.11.1.11 L-ascorbate peroxidase
  misc_feature (546)..(546): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (580)..(580): n is a, c, t, g, unknown, or other
  misc_feature (725)..(725): n is a, c, t, g, unknown, or other
ctccccgcggtggcggccgctctagaactagtggatcccccgggctgcaggaattcgtctcacccctagaaaaacgcaggcaccccagcagctcttgcggtcgtccctcaaccgcgtcgcaccgcatcgcattctacgattcgaagctctctgctcgcaggggaccatggcgaagaactacccaaccgtgagcgccgagtacagcgtggccgtcgagaaggccaggcgcaagctccgcgccctcatcgccgagaagagctgcgcacccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgacttctaccagcttgccggagttgtggccgtcgaggtcaccggtggggcctgagatccccttccacccaggcagggaggacaagcctcagccgccancctgagggnnnngcgcnnnctcttctgatgccancaaggttctgacacctgaggcaagtcttggcaagcagatggggtttgagtgatcaagacatcgttggcccctctctgggtggcaccaccctggggagggtgccaccaaagagccgtctgggttttttgaggggtgcctggactanccaaccccctttggtctttggacaactctaactttcaaggaacccttcctgagtgggggaacaagggaggcctttccttccagctccccaagttgaaaaaaggccctggctggaag

SEQ ID NO: 78107 - DNA, 774 bp, Zea mays
  misc_feature: Ceres CLONE 1563099
  misc_feature: Encodes the peptide sequence at SEQ ID NO. 78108
ctcaccgcggtggcggccgctctagaactagtggatcccccgggctgcaggaattcgtctcacccctagaaaaactctcgtctcgatcagctcgcttcgtgacttctctctcctctcgatcgattgcttcctccaccgaggcgggggaaagcgccgcccagatcgccgtaggcaagcggcgatcactccagctctgagcataagggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcgcttcgtgatcgatagagaagagtgcttctcgcataacgtggagtatgagggggatactgtccatgtatccttcgtcgtcatcaaggctgacaccacgtggcattacagcgaagaaggcgttgatcttgtggttaacgatcctaatggcgctcgagtccgtgattctcgagataagactagtgataagtttgagttcatagttcagaagagaagtgtccatcgcttctgcttcacgaataaatcccccgtaccacgaaactatagaacttcgacgtgcatggttgggcattttttcatactttcgagcagcatgcccaaagatgagcatgtttgccccgactttttcgaggctaatagccaaggttagaagaaggctctttttcaattatccccgttttggaacagccccctgggtaagggggccccataccttgac

SEQ ID NO: 78108 - protein, 149 aa, Zea mays
  misc_feature: Ceres CLONE 1563099
MEWLSWRTVCCLSVLCTVLFLRPVEGIRFVIDREECFSHNVEYEGDTVHVSFVVIKADTTWHYSEEGVDLVVNDPNGARVRDSRDKTSDKFEFIVQKRSVHRFCFTNKSPVPRNYRTSTCMVGHFFILSSSMPKDEHVCPDFFEANSQG

SEQ ID NO: 78109 - DNA, 757 bp, Zea mays
  misc_feature: Ceres CLONE 1563100
  misc_feature: Encodes the peptide sequence at SEQ ID NO. 78110
  misc_feature (663)..(663): n is a, c, t, g, unknown, or other
  misc_feature (726)..(726): n is a, c, t, g, unknown, or other
ggagctccccgcggtggcggccgctctagaactagtggatcccccgggctgcaggaattcgtctcacccctagaaaaagtccagcccaaagataagcccctgaactaccagtggccacacacagattccttcgattcccgctgacagcgaagctgaggagaatcccaagaaacagagccggtgaaattgcattgtcgcaacaggcaagagaagaggagaagaaagaaatggctgcaatacctgcagcgatcccgggctgctgctcttcgtctcgcctgcctcagcttgctggcctccctgcctccacaagcagaaggcgcttcaaggtcacggccatggcgcccaaaaagaaggtgaaccgctacgacgagaactggtcgaagcagtggttcggcgcgggcatcttcgcggagggcagcgaggaggtgtccgtggacgtgttcaagaagctggagcggcgcaaggtgctgagcaccgtggagaaggccggcctgctgtccaaggccgaggagctgggcctgacgctctcctcgctggagaagctgggcctgctctccaaggccgaggacctgggcctgctcagcctcgtcgagaccgcgggcggggacgtcccccctccgtcctcgcctccatctcgctgcccgctccctcgtgccgccgtcncccccggggtggtcgtcgtgccccgacgaactccgtcgcgctcgtcgcccttacaggccgtcnttccccgggcggtggctcggcggcgggaacc

SEQ ID NO: 78110 - protein, 140 aa, Zea mays
  misc_feature: Ceres CLONE 1563100
  misc_feature (1)..(140): Pfam Name: DUF1118 Pfam Description: Protein of unknown function (DUF1118)
  misc_feature (110)..(110): Xaa is any aa, unknown, or other
  misc_feature (131)..(131): Xaa is any aa, unknown, or other
MAPKKKVNRYDENWSKQWFGAGIFAEGSEEVSVDVFKKLERRKVLSTVEKAGLLSKAEELGLTLSSLEKLGLLSKAEDLGLLSLVETAGGDVPPPSSPPSRCPLPRAAVXPGVVVVPRRTPSRSSPLQAVXPRAVARRRE

SEQ ID NO: 78111 - DNA, 832 bp, Zea mays
  misc_feature: Ceres CLONE 1563102
  misc_feature: Encodes the peptide sequence at SEQ ID NO. 78112
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (461)..(461): n is a, c, t, g, unknown, or other
  misc_feature (674)..(674): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnaatgcggggctccccccggtggcggccgctctagaactagtggatcccccgggctgcaggaattcgtctcacccctagaaaaaaccacctccttgcgccatggcggagaagtcgccggcagccgacgtggaagccggtctccttgcccacctcaactcagcgggagaggtccccgactcacgctctttcgcttcctccctcggcgtctcccacctcgaacttgagggcgtcatcaagagcctctcagctttccgcatcgtcgacagcacagacatcatcaaggagacatgggtgctcaccgaggaggccaagggctacgccgccaaaggggctccccccgaggcacaagctcggtcgcccgcaatttcaccggggaggggtgccctcntaaagggaacgccccttcaaggggcaataattgggggaaaaaggcccttttcccaaatgggttggggcccatttgaaaaaggcccaccccccccccccaaagggaaaaacaaaaagggggggggggaaatataaggggggggtttccccacaaaaaaaaaaaaaaggaggggggggagaaaaataaataggagggggggcccccccttttttnccccccccccttcttaaaaaaaaaaggaggtttttataaaaaaaacaccccccctctaaaaaaaggggggaggttggggcgccccctcccccccaaaaaaaaaaaaaaacacccccccctcttttttttttaagaaaaaaaaccctccttcgcgggaa

SEQ ID NO: 78112 - protein, 140 aa, Zea mays
  misc_feature: Ceres CLONE 1563102
  misc_feature (97)..(97): Xaa is any aa, unknown, or other
MAEKSPAADVEAGLLAHLNSAGEVPDSRSFASSLGVSHLELEGVIKSLSAFRIVDSTDIIKETWVLTEEAKGYAAKGAPPEAQARSPAISPGRGALXKGTPLQGAIIGGKRPFSQMGWGPFEKGPPPPPKGKNKKGGGEI

SEQ ID NO: 78113 - DNA, 827 bp, Zea mays
  misc_feature: Ceres CLONE 1563106
  misc_feature: Encodes the peptide sequence at SEQ ID NO. 78114
ccccgcggtggcggccgctctagaactagtggatcccccgggctgcaggaattcgtctcacccctagaaaaaataggcttctgctccgacaacatgcgtggtctggctttacacgacggctattcagcagcacacctgatccgtgtgctgcgggtagctgctcggatagagctcattctgttcgtcacggcctcgcactcttgacgatctgatgacgggtccgtaatggtactagagccggcgcccgctgttacctggggcggccgccccaactcgctgttacggtaggtccgtcactaacctccaagattcgactcaaacgggctgtgaatcctatggcgggcgcagaacacctcactgtatgcggcgacttgcccatccggcgcgccgcggctggaagacgcgtggctcgaagactgcgcgctccagcctgattctatctctgaggcattctccgtcgatgacgcggacgtctcctcccgcctcgacttgctgcccttctccgaagactccgacgaggatgactgcgtctcggcaccactcggatgaagctgcttggatgacgccggactcgactgaaagggccgcccccatctcccttgacggcaggtgcgttgcgtgcttccgcagcgtcaaataagcctccgatcatcagcagaggacgatctagctgataccaagacgcggttactggtccggtgggcgctgcatatgaagatgataccggtccccggtggtcggggtgaccccccttggaacaggaacaaattcttcgcgggcaaaaaaaacaagggatttttttcgaaagggggtggccaaaaaaaagg

SEQ ID NO: 78114 - protein, 39 aa, Zea mays
  misc_feature: Ceres CLONE 1563106
MTASRHHSDEAAWMTPDSTERAAPISLDGRCVACFRSVK

SEQ ID NO: 78115 - DNA, 761 bp, Zea mays
  misc_feature: Ceres CLONE 1563109
  misc_feature: Encodes the peptide sequence at SEQ ID NO. 78116
  misc_feature (581)..(581): n is a, c, t, g, unknown, or other
  misc_feature (706)..(706): n is a, c, t, g, unknown, or other
ctctccgcggtggcggccgctctagaactagtggatcccccgggctgcaggaattcgtctcacccctagaaaaagccgcgccaggccagcagctagctaggcaggtagctcttgccaacgccccggccggccggcacctcacattttgtagcgtgatcgcgcgccgccgccacgcctccccatgcaagctactccgatcctagctactggctagctagttgcaactactcgagctaccagctagctaactggccagcagcaggtagtctgctcagggtcggagggtcggccggcgcggcggcggggcgcgcgcgcgcgggaaggcgggaagccgggaaccatgggcaacgccctgggggtgccgcgcgggggctcggctatgcgctgggcggccagcgcgaggaacggcgacgcggcggaggtgcgccgcctgctggaggaaaacccggggctcgcgcgctgcgccgccgtcggcagcagcctcaactcggcgctccacctcgccgccgccaaaggccaccacgagatcgccgcgttgctgctggagaacggagcagaggtgaatgctaggaacctttacngcgagacggcgttgatgcaggcgtgccggttcgccactggggaggtagttcaaacgctgctgggtttccgaatgcacgtgtccaaggtggaagcctgaagcggccagacggcgctgcaccttgcnggaggcgggaggcaccccacttgcgcgccctttgctgctggccggccccggcccc

SEQ ID NO: 78116 - protein, 112 aa, Zea mays
  misc_feature: Ceres CLONE 1563109
  misc_feature (47)..(79): Pfam Name: Ank Pfam Description: Ankyrin repeat
  misc_feature: SWISSPROT Homolog: EC 2.4.2.30 NAD(+) ADP-ribosyltransferase
  misc_feature (81)..(81): Xaa is any aa, unknown, or other
MGNALGVPRGGSAMRWAASARNGDAAEVRRLLEENPGLARCAAVGSSLNSALHLAAAKGHHEIAALLLENGAEVNARNLYXETALMQACRFATGEVVQTLLGFRMHVSKVEA

SEQ ID NO: 78117 - DNA, 763 bp, Zea mays
  misc_feature: Ceres CLONE 1563111
  misc_feature: Encodes the peptide sequence at SEQ ID NO. 78118
  misc_feature (42)..(42): n is a, c, t, g, unknown, or other
  misc_feature (487)..(487): n is a, c, t, g, unknown, or other
  misc_feature (490)..(490): n is a, c, t, g, unknown, or other
  misc_feature (496)..(496): n is a, c, t, g, unknown, or other
ctccccgcggtggcggccgctctagaactagtggatcccccngggctgcaggaattcgtctcacccctagaaaaaggagagatggctgagtggactaaagcggcggattgctaatccgttgtacaatttttttgtaccgagggttcgaatccctctctttcacgcctctccagctctcctctactagacttgttttttccgtccatcgtttcgtttgttccacctgcgcaactgcgacggggataagtacgtcttccagatgacgacggcggcatggccgcggccacgcttcctcgtcctcccccagcctggattcctccgctcggtctgccacggcctctgctcccgctgtctcttctgcttcctgctgctcctcgccttcgcctgcagctccagctccgggcgggtggtggtcactagcttgcctggcttcgacggcgacctccccttccactcgaaacagggtacgtggaggtggaagaagacnccngcgtgnagctcttctactacttcgtccaggccgaagtccggcgccgcggcgcccgccgatgacacccctttccctctctggctcaccgggggcgaccgctggctccgtcttcaagcgggctcggcctaagaaaatcgggtccacttcgaaattcgtccttggaaccccttaaaaggggcacccgtgccgcggcctggaaataaaaaccccaaaccggggggcaaaaaggggtccaaatattccccccttccgccaaatttccccgggttggga

SEQ ID NO: 78118 - protein, 119 aa, Zea mays
  misc_feature: Ceres CLONE 1563111
  misc_feature (79)..(79): Xaa is any aa, unknown, or other
MTTAAWPRPRFLVLPQPGFLRSVCHGLCSRCLFCFLLLLAFACSSSSGRVVVTSLPGFDGDLPFHSKQGTWRWKKTPAXSSSTTSSRPKSGAAAPADDTPFPLWLTGGDRWLRLQAGSA

SEQ ID NO: 78119 - DNA, 775 bp, Zea mays
  misc_feature: Ceres CLONE 1563114
  misc_feature: Encodes the peptide sequence at SEQ ID NO. 78120
ctcaccgcggtggcggccgctctagaatagtggatcccccgggctgcaggaattcgtctcacccctagaaaaatctctttctcttagactatctgccgctccagcctttcgctagggtttatccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcgtgagtgaccactttctcatcataacataccttatacttgtggcacgtagctcacgattgttcggttagtcttgcggccttggtagggcgatttgttttgggaaattgggagtaggtacggtgggtgggaaatgccggtattgaaagtttgggtggctaatctttccgtacaatgtagtggaagttagttgtccatatcgatatttatgtcattttataatgattagaattcttcttagtgtggaaacggggtgaaattcgggctgcaacatgcaatccttttttgacaggcataaaattcatgggatggaatttgattcccgagctgtgcatttttgtggtgtaatggaagctatggaggctttcagtccggaatggaatgggtggctcactataaccggtcgatattactgaaagcctaggggggtgtcatggcaagctaaacagggtctgcaaagtgggaca

SEQ ID NO: 78120 - protein, 75 aa, Zea mays
  misc_feature: Ceres CLONE 1563114
  misc_feature (5)..(66): Pfam Name: Ribosomal_L34e Pfam Description: Ribosomal protein L34e
MVQRLTYRKRHSYATKSNQTRVVKTPGGKLVYQYTKKRASGPKCPVTGKKIQGVSDHFLIITYLILVARSSRLFG

SEQ ID NO: 78121 - DNA, 1357 bp, Zea mays
  misc_feature: Ceres CLONE 1563116
  misc_feature: Encodes the peptide sequence at SEQ ID NO. 78122
aatcgccccccgctcctccattcgcgcaaagacgccaagcccacccagcgaaatctctccccaaactacccctcgccagcgcccggcgatgtgcccaacgaagcccgatcgccctggccaggccgccgccggctccggcgagaagagctggcgggaggaggccgtggccgcctgctcgctgcggctggtcgacctggaccgtggcaccaacggctgggcctcgccgccgggggacctcttccacctgcgcgcgcgcggctacttctccagcggcggcgggaagcgcggcaaggcgccgtccgccgcggactggctgctccgccccgccggcgtcgactggctacgctcccacgcgcgcctcgaccacgtgctcgcccgcgacgacaaccgcgtcgccgccgccttccgccgcgcgcgcctcaggaaggaccccagcgcgcacttcctcctcgccgtcaatctccaggtgccgggccggccggacgcgtacagcgccgtgttctacttcgcggcggaggcacccatcccgccggactcgctgctcggccgcttcatccacggcgacgacgcgtaccgcaacgcgcgtttcaagatagccaaccgcatcgtcaagggtccctggatcgtccgcgccaccgtcggcaactacgcggcctgcctgctcggccgcgcgctcacgtgccgctaccacaagggcgacgactacctcgagatcgacgtcgacatcggcagctcagcgatcgccagcgccatcctgcatctcgcgctcggcgccgtcacgtcggtgaccatcgacatggggttcctcgtcgagtcccagtccgaggaggagctgcccgagaggctattcggcgccgtgcgcatcgcgcagatggagatgagcgcggccaagtacgtggagctgccccctgatgaggccatgcctgagacggccggcagggccggggccgggttcagggtaagctcggcgaaggtggtcaatcatagccgccaacaagaccacgccggcggcaaggtcggcaggtcgatgagttgcccggagcgagagagcggaggaaaataggcgcaaagtatgcgggtgcactgcagaaagaaaccatccatcgatggcagagcgatggcgagaaccggaagacgaaggccgggtaacccccaacacataaaatgctgaagctggcgccatgaccacgacctcgaccacgaatggcgccccctccccttctttcataaatttctgacttcatttggttgtgatgatgagagcttaaaaacctgatggatgcgaaatcaattcatagcagcagattaatctatctatctatctatggccgagttccatgaaaaaaaaaaaaaaaaa

SEQ ID NO: 78122 - protein, 324 aa, Zea mays
  misc_feature: Ceres CLONE 1563116
  misc_feature (43)..(263): Pfam Name: DUF1336 Pfam Description: Protein of unknown function (DUF1336)
MCPTKPDRPGQAAAGSGEKSWREEAVAACSLRLVDLDRGTNGWASPPGDLFHLRARGYFSSGGGKRGKAPSAADWLLRPAGVDWLRSHARLDHVLARDDNRVAAAFRRARLRKDPSAHFLLAVNLQVPGRPDAYSAVFYFAAEAPIPPDSLLGRFIHGDDAYRNARFKIANRIVKGPWIVRATVGNYAACLLGRALTCRYHKGDDYLEIDVDIGSSAIASAILHLALGAVTSVTIDMGFLVESQSEEELPERLFGAVRIAQMEMSAAKYVELPPDEAMPETAGRAGAGFRVSSAKVVNHSRQQDHAGGKVGRSMSCPERESGGK

SEQ ID NO: 78123 - DNA, 832 bp, Zea mays
  misc_feature: Ceres CLONE 1563117
ctccccgcggtggcggccgctctagaactagtggatcccccgggctgcaggaattcgtctcacccctagaaaaacgctagtgtcaaggctgaactaggaaaaccaagcattcttcaccctgacaaaggaaaagttgccatttttgtcgactgtagtccaaccgctgagcctctgtttgagggtagaggctctgaagaattgtctgctgagctctctgtttccctgcaaagatgcttgttgggtggtaaaagtggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaaccctgagttgatgtaagtgatgaggaatttctgcagtttgacacatccggtgtgcctgttattattacattaaccaaggtgggtcggcactactcggtttgatgccacctcagaggaagaatcccagatgagtttctgcagtgtccggtgtcagtcaacaggcatggccagatatcggggctttcccaaaaggggaggggcaagggctgggatccaagcgtcatcctccaacatgatatctggtcccccaagcatgttggagccagcagtttcctcttccctccttggattcaaaaaattgccccccgcccgaaacctaaagaaaaagccccccggggtttggatggaaaaggaaaaaaagggcctgggttgcccttaaaaa

SEQ ID NO: 78124 - DNA, 864 bp, Zea mays
  misc_feature: Ceres CLONE 1563118
  misc_feature: Encodes the peptide sequence at SEQ ID NO. 78125
  misc_feature (622)..(622): n is a, c, t, g, unknown, or other
ggagctccccgcggtggcggccgctctagaactagtggatcccccgggctgcaggaattcgtctcacccctagaaaaaaaaaagatctccaattccccaccccaaagagctaccctgaccagatttggccgcttcctcctctgcctcccgctaaccctagtccagcaccccgagatctgctccgcgcgagcagccatggcggagacgctcgacatgaccctcgatgacatcatcaagaacaacaagaagagtaacccctcctccggcggggcccgccgcagccgcggcggatccgcccctggcggcggcagcggcggggtcgggccgaccaggcgctccttcaagagggctgggaacaggcaggcgccctaccagcccccaaaggcccctgacgctgcgtggcagcacgacatgtaccctggcggtcgccccaagaagcggcggcagccggaaggtctcggcgcctcgaaacggggcaccaagcttctcatctccaacctgggattggggggtttccaaacgacaatttccaaggagcctgttccccgggaactaggggaacctgaaagccttttcccgataaatttatggatcaaaaggggggaggggccaaagggaaacngcctgaaagttggtttttcgcaaggggcctgccggatggctgtgtggcggggcgggtaaaaaaaaatataaccaatgggccaacattgggaggggaaagcccccgggaagaaatgagaaaacggttggggaaccaataacccgccagcgggcacctgggcggggccttttccacggtggccacaaggggaggggccttggctaggggaaatggcgtggggaagaagaagagcccccgagagg

SEQ ID NO: 78125 - protein, 161 aa, Zea mays
  misc_feature: Ceres CLONE 1563118
  misc_feature (143)..(143): Xaa is any aa, unknown, or other
MAETLDMTLDDIIKNNKKSNPSSGGARRSRGGSAPGGGSGGVGPTRRSFKRAGNRQAPYQPPKAPDAAWQHDMYPGGRPKKRRQPEGLGASKRGTKLLISNLGLGGFQTTISKEPVPRELGEPESLFPINLWIKRGEGPKGNXLKVGFSQGACRMAVWRGG

SEQ ID NO: 78126 - DNA, 819 bp, Zea mays
  misc_feature: Ceres CLONE 1563119
  misc_feature: Encodes the peptide sequence at SEQ ID NO. 78127
ctcaccgcggtggcggccgctctagaactagtggatcccccgggctgcaggaattcgtctcacccctagaaaaaccccctagaaaaagcacaatccatccatccatctattctccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccagcgacaaggaaagggagcccgccgaaaagctcatgaaggtaccagaacaaacgtggagggcagggggaaggctccaatccgatggtgacgccctttaaccgaagtttgaccacccctggagaaaaggaaaagctcctgtacccctatgggaagcgggctcctgggccctggaaaaaacctgggcaaaggaaaaaaccctggccaaaccctgggggggggggggggaaaccagg

SEQ ID NO: 78127 - protein, 164 aa, Zea mays
  misc_feature: Ceres CLONE 1563119
  misc_feature: SWISSPROT Homolog: EC 1.16.3.1 Ferroxidase
MMLRVSPSPAAAVPTQLSGAPATPAPVVRVAAPRGVASPAAGAACRAAGKGKEVLSGVVFQPFEEIKGELALVPQSPDKSLARHKFVDDCEAALNEQINVEYNASYAYHSLFAYFDRDNVALKGFAKFFKESSDKEREPAEKLMKVPEQTWRAGGRLQSDGDAL

SEQ ID NO: 78128 - DNA, 849 bp, Zea mays
  misc_feature: Ceres CLONE 1563121
  misc_feature: Encodes the peptide sequence at SEQ ID NO. 78129
  misc_feature (727)..(727): n is a, c, t, g, unknown, or other
ctccccgcggtggcggccgctctagaactagtggatcccccgggctgcaggaattcgtctcacccctagaaaaaagttgagcgtgcttcacctgaatatttgtcagttaatgttggtcatgaagacatgactggtattgattttgtggtttttgaacgccctgaagtaacaatcttgagtggccatgtggaaggagatggcattgatacgttacatccgcatctctctgttgaaatcagatcagcaacagactcttctagagtagaagctgtacttcctcttcctctttcatactactttgaagtccgagatttgcccaagggcaagcatcttgttcagcttcgatctggccttccatcacatacacataggtttgaatcggagttagtcgaagtagatctggaaaaggatccccaaatccatgttggtcccctcaaatataaaactgaggagcgtcatcaaaagcaggaactgaccccagcaccagtttttccgcttattgttggagtttctgtggttgcactggtgatcagtatgtcaaggttaaatgacttataccagagcgctgtagggatgacttctctggggtcagggatggcaccgaccaaaaaggagccacgcaagaatatattaaagaaagagagtgtaaatggcatattagcttagcccttaggggtcgaagaatgagacatgacaaattgagcaatttccacagtggaatagcttnctggtttccccctccggtaattttgccgacgaaaaggaaatgccagttttgttgtacgatagcactatgcacagtttttgaagccttaaatgtggcctttttggagttgtgcatcatgaatg

SEQ ID NO: 78129 - protein, 179 aa, Zea mays
  misc_feature: Ceres CLONE 1563121
MTGIDFVVFERPEVTILSGHVEGDGIDTLHPHLSVEIRSATDSSRVEAVLPLPLSYYFEVRDLPKGKHLVQLRSGLPSHTHRFESELVEVDLEKDPQIHVGPLKYKTEERHQKQELTPAPVFPLIVGVSVVALVISMSRLNDLYQSAVGMTSLGSGMAPTKKEPRKNILKKESVNGILA

SEQ ID NO: 78130 - DNA, 628 bp, Zea mays
  misc_feature: Ceres CLONE 1563124
  misc_feature: Encodes the peptide sequence at SEQ ID NO. 78131
  misc_feature (297)..(297): n is a, c, t, g, unknown, or other
ggagctccccgcggtggcggccgctctagaactagtggatcccccgggctgcaggaattcgtctcacccctagaaaaatcgtgaggtagaagccattggaggaaatgtctctgcatcagcttcccgtgaacaaatgagctatacctatgatgcattgaagagctatacaccagaaatggttgaagttctcattgacagtgtgaggaatccagcattcctcgattgggaggtcaaagagcagctccagaacataaaatctgaaatagctgatgcgtctgctaatcctcaaggtctacnttctggaggcccttcattcggttggatattccggggcactggcaaaacctttgatggcttcagaatctgctgtaaaccggtttggatgttagcagcttggaagaaatttgttgctgaacattacactgctccccaggatgtttcttgcagcctcaggagtttgatcatgatgcgcttaatttcaagttgtagaaaccccttccgtcttgaccttccggggcgtgaaaacgtccctgaaaaaagccaaaaatcttgttgtaacgtggggaaaggaaaaaataattcccttgcccaaaacaaaaatttcctcccaaaaaaacaacacactttt

SEQ ID NO: 78131 - protein, 165 aa, Zea mays
  misc_feature: Ceres CLONE 1563124
  misc_feature (55)..(55): Xaa is any aa, unknown, or other
MSYTYDALKSYTPEMVEVLIDSVRNPAFLDWEVKEQLQNIKSEIADASANPQGLXSGGPSFGWIFRGTGKTFDGFRICCKPVWMLAAWKKFVAEHYTAPQDVSCSLRSLIMMRLISSCRNPFRLDLPGRENVPEKSQKSCCNVGKGKNNSLAQNKNFLPKKQHTF

SEQ ID NO: 78132 - DNA, 740 bp, Zea mays
  misc_feature: Ceres CLONE 1563125
  misc_feature: Encodes the peptide sequence at SEQ ID NO. 78133
  misc_feature (542)..(542): n is a, c, t, g, unknown, or other
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctgggttcagggccggctcccagatcttcagcgagggcngggctggactacctcggcaaaccccagccctgatcccacgcgcagagcatccctccgccatcttgggcctggcccaggtcgtggctccatggggtgcccctccaaagggctaacccgcatttgcccgggcgggccccccctctggggaaaaggtcccttcaaacacccccttttttaccccttgggcggggaagccct

SEQ ID NO: 78133 - protein, 204 aa, Zea mays
  misc_feature: Ceres CLONE 1563125
  misc_feature (61)..(196): Pfam Name: Chloroa_b-bind Pfam Description: Chlorophyll A-B binding protein
  misc_feature (139)..(139): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWVQGRLPDLQRGXGWTTSANPSPDPTRRASLRHLGPGPGRGSMGCPSKGLTRICPGGPPLWGKGPFKHPLFYPLGGEA

SEQ ID NO: 78134 - DNA, 813 bp, Zea mays
  misc_feature: Ceres CLONE 1563129
  misc_feature: Encodes the peptide sequence at SEQ ID NO. 78135
  misc_feature (667)..(667): n is a, c, t, g, unknown, or other
  misc_feature (708)..(708): n is a, c, t, g, unknown, or other
  misc_feature (776)..(776): n is a, c, t, g, unknown, or other
ctggagctcaccgcggtggcggccgctctagaatagtggatcccccgggctgcaggaattcgtctcacccctagaaaaactagtggagacaaagtggtagttggagaacccaatgaaggcagttgcatgccatctgaagttgagggcaaaacaaaagagggagatgctgaagaaaaggaaaggacagatgaagctggaaatatcgataaaattagcaaggatgatactgggaagaaagatggagatgacactgagaagaaagatggaggtgatgatactggaggtgaatcagagcagaaagggcaaacaccatcagcaacaccccttttctcgtttaagaatctgtcaagtggtcaaaatgctttcacaggtctgaccggaactggattttcaagcacatcattctcgtttggctcagcctctaaagatggctcaagtgctggtcccctatttgggctgaaagctgatggttcttcgttcccttcttttaatcttggtgctgccaccaatgggggttctgccacagctcttgctacttcagcagaggcacccaagatgtttgctatgacagagggccctgtcgaaaccggtgaagaaaatgagaaggctgtattcagcgctgattctgctttgtacgaatacttagatgggggctggaaagaaagtnagaaagggtgactgaaagctgaacgttccccgtatctggcnggcgagcgagcccccgctcgtcatgaggacaaaaagccactaaccgggctggtcctgaatgcaagccntctacaacgacatggtcgctcaaggacatggaacaaa

SEQ ID NO: 78135 - protein, 183 aa, Zea mays
  misc_feature: Ceres CLONE 1563129
  misc_feature (181)..(181): Xaa is any aa, unknown, or other
MPSEVEGKTKEGDAEEKERTDEAGNIDKISKDDTGKKDGDDTEKKDGGDDTGGESEQKGQTPSATPLFSFKNLSSGQNAFTGLTGTGFSSTSFSFGSASKDGSSAGPLFGLKADGSSFPSFNLGAATNGGSATALATSAEAPKMFAMTEGPVETGEENEKAVFSADSALYEYLDGGWKESXKG

SEQ ID NO: 78136 - DNA, 860 bp, Zea mays
  misc_feature: Ceres CLONE 1563130
  misc_feature: Translation starting site: 156
  misc_feature: SWISSPROT Homolog: EC 6.3.2.19 Ubiquitin--protein ligase
  misc_feature (599)..(599): n is a, c, t, g, unknown, or other
ctccccgcggtggcggccgctctagaactagtggatcccccgggctgcaggaattcgtctcacccctagaaaaactagaaaaagcgtcaccgcgtcccgagagcgcgattcattccgcgcgacgcaaaaccctagctcatccaccgatccttgtcatggcggccaccaccagccaggcgagcctcctcctgcagaagcagctcagagatctcgccaagcacccggtggatgggttctcggctgggctggtcgacgatagtaacgtattcgagtggcaggtcaccatcatcggcccgcccgataccctatatgatggagggtacttcaatgcaataatgagcttcccagaaaattacccaaacagcccgccatcagtcagatttacctctgaaatgtggcatccaaatgtttattcagatggggctggtgtgtatctctattcttcatccacctggtgaagatccaagtggttatgagctcgcaagtgagcgttggacacctgtgcatacagttgaaagcatagttctgagcattatatcaatgctctctagtcaaaatgacgagtctgcagcaaacattgaggcagctaaggaatggangggataaaaaaggggagatttcaagaaaaagggtcaggcgcatcctggccgaatccacaggaaaatggtatgaagaaaatgaaataactgggggaagtccaacgctggccatgtcaggcctaccaagatttttgcttttcacctcaaaatgctcatccggaacatcctgggggattttcccaatttagcgcccgggtccattggtgcaccagaattgcatttggggaaccggtggggtatcgggtggcctgggggcctcac

SEQ ID NO: 78137 - DNA, 861 bp, Zea mays
  misc_feature: Ceres CLONE 1563131
  misc_feature: Encodes the peptide sequence at SEQ ID NO. 78138
  misc_feature (420)..(420): n is a, c, t, g, unknown, or other
  misc_feature (423)..(423): n is a, c, t, g, unknown, or other
  misc_feature (495)..(495): n is a, c, t, g, unknown, or other
ctccccgcggtggcggccgctctagaactagtggatcccccgggctgcaggaattcgtctcacccctagaaaaaaagcgttccagatcgtactggaccaatctgccaccacactttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgtttccggaagccagcccgcctcagcggctgcagccgcaancangaatgtggtcagggtgggacagggactacctgtcctacgacgagccaaagaagggtgttccggggcgaggcntgcgacgaacttcgggggcgagttcttcttaggcgcctttaccaggacggcgtctcccagggaacctgggccccctcctgaggaccctgaaccaatccctgttgggtcccccacacctttgatctttttgtgtggcaaaaaggttcacaccccccggtggttaaaacaaaatccggggaccttcccaaatgggggtcccggaaaccctttttttttggaaaacccaattaacctttttttaacccccaaggggcccccaaacccgcgtccctaaaaaaaaagggggggtggacctttcccccccccttttatcccgcttttttcttccccccaacaaacccttttggggttaccccccggtttttt

SEQ ID NO: 78138 - protein, 124 aa, Zea mays
  misc_feature: Ceres CLONE 1563131
  misc_feature (1)..(118): Pfam Name: Lir1 Pfam Description: Light regulated protein Lir1
  misc_feature (90)..(90): Xaa is any aa, unknown, or other
  misc_feature (91)..(91): Xaa is any aa, unknown, or other
  misc_feature (115)..(115): Xaa is any aa, unknown, or other
MQAAATAAGFSAVLPAKGRPAARSRVVARVPATRRSVRAAAVVATEAAQIDYSSSVSVFPMEACDLLGGDACNGPMFPEASPPQRLQPQXXMWSGWDRDYLSYDEPKKGVPGRGXRRTSGASSS

SEQ ID NO: 78139 - DNA, 673 bp, Zea mays
  misc_feature: Ceres CLONE 1563132
  misc_feature: Encodes the peptide sequence at SEQ ID NO. 78140
  misc_feature (303)..(303): n is a, c, t, g, unknown, or other
  misc_feature (321)..(321): n is a, c, t, g, unknown, or other
ggagctcaccgcggtggcggccgctctagaactagtggatcccccgggctgcaggaattcgtctcacccctagaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcnttgaggacgggcgcacgncttgctgactacaacatgccagaaaggagagcacccctccacctttgtgctcccgcctcaggggtagcatgccagatcttttgtgaaaaaccctgacccgggaaagaactttcacccctcaaagggtgaaagccctctgaaccccatttgaacaaccgtcaagggccaaaaatccccgggaaaaaggggggggggggattcccccccccaaaaaccaaagaggggggttcttttttttgtggggaaaaacccccttgggggaaagggggccccccctttttgccaaaaaaaaaaaaattctcccaaaaggggggaaacccccccccccccctttggggggcggtcgcgcccc

SEQ ID NO: 78140 - protein, 49 aa, Zea mays
  misc_feature: Ceres CLONE 1563132
  misc_feature (6)..(51): Pfam Name: ubiquitin Pfam Description: Ubiquitin family
MQIFVKTLTGKTITLEVESSDTIDNVKAKIQDKEGIPPDQQRLIFAGKQ

SEQ ID NO: 78141 - DNA, 838 bp, Zea mays
  misc_feature: Ceres CLONE 1563134
  misc_feature: Encodes the peptide sequence at SEQ ID NO. 78142
  misc_feature (531)..(531): n is a, c, t, g, unknown, or other
  misc_feature (610)..(610): n is a, c, t, g, unknown, or other
  misc_feature (678)..(678): n is a, c, t, g, unknown, or other
  misc_feature (720)..(720): n is a, c, t, g, unknown, or other
acccgcggtggcggccgctctagaactagtggatcccccgggctgcaggaattcgtctcacccctagaaaaacctaattaagccaaaaggcactgaagaagccagtcaatagcgagttctactactagtagctagcctgctgatctgttctgttgtttagttcgcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaagaggcgatcgatgagaacggcgagattatcangaggaagaagatgaagatgggcctcaaggagaagctcaaggagaagctgccggggccacaggacgggcaccacacggtncgcaccgtccccggcgccccgcgcccgtgggagacgcatgcccaccaccaagtaggatcgcacaaggncgtacgtcgtcccgaacccgggcccgtcgggcttcacggganggtcaccagcacgaacaccgggggtcgtcgtcccaggaacgacgtgtaagaccgggaacccccgcccccttggcaccggagggaggaaaaaaaaaaggcctggctggaaaaaaaatca

SEQ ID NO: 78142 - protein, 193 aa, Zea mays
  misc_feature: Ceres CLONE 1563134
  misc_feature (25)..(187): Pfam Name: Dehydrin Pfam Description: Dehydrin
  misc_feature (115)..(115): Xaa is any aa, unknown, or other
  misc_feature (164)..(164): Xaa is any aa, unknown, or other
  misc_feature (178)..(178): Xaa is any aa, unknown, or other
MEDERNTQQHQGGEAQQDAADQVDVKDRGLLDSLLGRKKHDDDQEKKKQTDELATGMEKVTVSEPEKHGHKEEEHEVVGEKKEGLLAKLHRTSSSSSSSSDEEEEAIDENGEIIXRKKMKMGLKEKLKEKLPGPQDGHHTVRTVPGAPRPWETHAHHQVGSHKXVRRPEPGPVGLHGXVTSTNTGGRRPRNDV

SEQ ID NO: 78143 - DNA, 778 bp, Zea mays
  misc_feature: Ceres CLONE 1563137
  misc_feature: Encodes the peptide sequence at SEQ ID NO. 78144
  misc_feature (480)..(480): n is a, c, t, g, unknown, or other
  misc_feature (649)..(649): n is a, c, t, g, unknown, or other
ctcaccgcggtggcggccgctctagaactagtggatcccccgggctgcaggaattcgtctcacccctagaaaaaatccccaatatatcccccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgcagccgcagccgccgcctcgaaggccggttccgacgacgtgggtgccgcctccgccaacagcaccgccgcctccggtgaggacctncagaactgggatgcggacttcgtcaaggtcgaccaggccacgcttttcgacctcatcttggctgcaaactatctgaacatcaagggtctgctcgacctgacctgtcagactgttgctgacatgatcaaaggcaagacaccagaagagattcgcaagaaccttcacatcnagaatgactttcaccccctgagaaggagaagagatccgcaggggagaacccagtgggccttccgagtaaaggaagtgctgggatctattgatgcctaaagtttcgtgggtggtcaactactaggtcctc

SEQ ID NO: 78144 - protein, 187 aa, Zea mays
  misc_feature: Ceres CLONE 1563137
  misc_feature (99)..(177): Pfam Name: Skp1 Pfam Description: Skp1 family, dimerisation domain
  misc_feature (8)..(68): Pfam Name: Skp1_POZ Pfam Description: Skp1 family, tetramerisation domain
  misc_feature (156)..(156): Xaa is any aa, unknown, or other
MAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLQNWDADFVKVDQATLFDLILAANYLNIKGLLDLTCQTVADMIKGKTPEEIRKNLHIXNDFHPLRRRRDPQGRTQWAFRVKEVLGSIDA

SEQ ID NO: 78145 - DNA, 842 bp, Zea mays
  misc_feature: Ceres CLONE 1563138
  misc_feature: Encodes the peptide sequence at SEQ ID NO. 78146
  misc_feature (543)..(543): n is a, c, t, g, unknown, or other
ggagctccccgcggtggcggccgctctagaactagtggatcccccgggctgcaggaattcgtctcacccctagaaaaagaggagcaggcgacaccttcaccgcttcggtaacggatcgacaggcgacagctcacagctggcggtggtttggctcggggacggggtgcggcggcctccgcgagcagttcggcagcgacacggcgcggggggtgggcgccttgctggctggtgtagcgtagtgcgggccacaacgaggaagcggtggcatccagcaggcaccatcagaaaaccacatggctcggcaaccttggagcaataatggccatagaaattccccttcaaattcattagatggaggagttcctggacccatgcctctggtccctttccaggaggaacttgcagttggttgtgaagagattcgtagaattgctgctgataatactcttgtgctagaggatattctgggccttaggcaagaattagctgtcattgaagacgagatccatatacttgccaaacaaaccattgcccagacttcgntgttgataatgaaatggaatacagggatattatccaggggaggcatgaagttagaggaacagatgcatgctcttaaacttatcagggaagaagtgttggtcctaagttctgaaaagatggagttgggagctttgtgcaaagagctatctgtgaaaggttcagtcattgtacagggagctggagcagatcccatccgagaaccagcagatactgctatttagaagaaggttgcatgatatacaagaggagattcccaggggcaggatgggctacgaaccatgaaaaacgtgcaaaagtga

SEQ ID NO: 78146 - protein, 156 aa, Zea mays
  misc_feature: Ceres CLONE 1563138
  misc_feature (84)..(84): Xaa is any aa, unknown, or other
MARQPWSNNGHRNSPSNSLDGGVPGPMPLVPFQEELAVGCEEIRRIAADNTLVLEDILGLRQELAVIEDEIHILAKQTIAQTSXLIMKWNTGILSRGGMKLEEQMHALKLIREEVLVLSSEKMELGALCKELSVKGSVIVQGAGADPIREPADTAI

SEQ ID NO: 78147 - DNA, 749 bp, Zea mays
  misc_feature: Ceres CLONE 1563139
  misc_feature: Encodes the peptide sequence at SEQ ID NO. 78148
  misc_feature (43)..(43): n is a, c, t, g, unknown, or other
  misc_feature (104)..(104): n is a, c, t, g, unknown, or other
  misc_feature (106)..(106): n is a, c, t, g, unknown, or other
  misc_feature (494)..(494): n is a, c, t, g, unknown, or other
gctccccgcggtggcggccgctctagaactagtggatcccccngggctgcaggaattcgtctcacccctagaaaaaaaaaaaaaaaaaaaaaaaaaaaaaaaananaaaaaaaaaaaaaaattcccagccgaagccggacgatgaagagggagggatggcagcacggcgccgtccgggccagccgcagcaaggtgcttaggacggccgccggcgacaacaactccgacgccgccgcggtcgtgaaaacggcggcggcggcggcggcggcaaggaagccaacaaacgcgtcccggagcacgggcaagtgccggcgggcccggtgcgcgggctgccacgcgcacccggtctccaaggcgcgcgacaaggccaagggcgcgcgcaagctgcgcgcctgcgacgtcgcgctcaaccaccgcctcgtgtcctggcgcgtcgtcgaccagggccccgggtacagcggcgcgtccgcctcctccctgctggcgtacctggnccggtggcagcagctggcccgagggaggaggacgacgaccacaagggcggagcggccccccgaacggcggggttcttctgaacctctaaaaaacctttttcgttggggcccgccaaaaccaaaagggcccccggggaaaaaaaggaaaaaatggcccttggaaatgggggttttaaaaaaaaaaattttctcgggcgccttttaaaaaaaaacacaggggccctttgcttggatgccccaagggggggggggaag

SEQ ID NO: 78148 - protein, 185 aa, Zea mays
  misc_feature: Ceres CLONE 1563139
  misc_feature (118)..(118): Xaa is any aa, unknown, or other
MKREGWQHGAVRASRSKVLRTAAGDNNSDAAAVVKTAAAAAAARKPTNASRSTGKCRRARCAGCHAHPVSKARDKAKGARKLRACDVALNHRLVSWRVVDQGPGYSGASASSLLAYLXRWQQLARGRRTTTTRAERPPERRGSSEPLKNLFRWGPPKPKGPPGKKRKKWPLEMGVLKKKIFSGAF

SEQ ID NO: 78149 - DNA, 828 bp, Zea mays
  misc_feature: Ceres CLONE 1563140
  misc_feature: Encodes the peptide sequence at SEQ ID NO. 78150
  misc_feature (542)..(542): n is a, c, t, g, unknown, or other
ggagctccccgcggtggcggccgctctagaactagtggatcccccgggctgcaggaattcgtctcacccctagaaaaaaggcatccctcccttccgcgtggtgtgctctctgttcccctttacgccgtttcctctcccgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggctgcctcagcgtacgtcgaggcagcaaattgctacaaaaagtttcacctcaggaagctgcgcagcgctaaaacagtctgttaatcttttcttggaaattgtaaggtngaacatgcctggcagatacagcagggacttgtggtgagatttttcagcaagaacagattttgaagaaggcaccgatttccctggaaagggcagctgaccttttttgacaatgaagggaaaagccgctccaattcaaaccccttcaaaaagaaaggttccaaaaattggcggcctccgtggggaaacctcccccaaaagccactgggaatttttttaaaaggttatcccctcctcaattaaaaatacaaaaaaatcttctcctaaaaaataaggggtcaaagagaat

SEQ ID NO: 78150 - protein, 98 aa, Zea mays
  misc_feature: Ceres CLONE 1563140
MGDHEARGDDFEKKAEKKLSGWGLFGSKYEDAADLFDKAANSFKLAKNWSRAASVYIKIANCHLKGDSKHEAASAYVEAANCYKKFHLRKLRSAKTVC

SEQ ID NO: 78151 - DNA, 763 bp, Zea mays
  misc_feature: Ceres CLONE 1563141
  misc_feature: Encodes the peptide sequence at SEQ ID NO. 78152
  misc_feature (344)..(344): n is a, c, t, g, unknown, or other
  misc_feature (403)..(403): n is a, c, t, g, unknown, or other
tggagctccccgcggtggcggccgctctagaactagtggatcccccgaggctgcagagaaattcgtctcatcccctagaaaaatcagccccagccctcggaaacccatcgcaaattcgcaaactaaccccaaaccccaatccaccccatcccctcctcatccactccgggcggccatggcctgctccttctccgccgccatcaccgtctcttccgcccctaccccggccgccagacccctcgctgctgccacgcagtccgtctgcatcgctcgctccgcggtcgccaccactggcaggccgctccgcctcgccgcctcaaggtccgcgcgggctaccagactcngtgcccgcgccagcgtagtcgatgacttgcccgctggttcggaacaaagcgccagactncgaagcccaagctgtggtccgaccagaaattcctcaacgtgaagccctccgaattcacttgggaaaaaaagacgtcaattcggtccttcctcccccttgggaattttacctttcggttgggcccaaaccaaaaataacccgggcttttttgggccaaaaaccaaggaaatttgaaaaaaattgaaacaccggggggggtcttggggggtttcccccttggaaaagggggtgtctcccccccaccttttgttgggggggggcgaaacaaaaaaaaaaaaaaaacccgggtggggggccccccccgagattttctttataaaaccccccccccccgtgttctctcaaaaaagagagaaaaaa

SEQ ID NO: 78152 - protein, 89 aa, Zea mays
  misc_feature: Ceres CLONE 1563141
  misc_feature (57)..(57): Xaa is any aa, unknown, or other
MACSFSAAITVSSAPTPAARPLAAATQSVCIARSAVATTGRPLRLAASRSARATRLXARASVVDDLPAGSEQSARLRSPSCGPTRNSST

SEQ ID NO: 78153 - DNA, 844 bp, Zea mays
  misc_feature: Ceres CLONE 1563144
  misc_feature: Encodes the peptide sequence at SEQ ID NO. 78154
ctccccgcggtggcggccgctctagaactagtggatcccccgggctgcaggaattcgtctcacccctagaaaaaaccacaccacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgcccgccgccgcgatggctcgtgggtgcccgaccccgtcacgggccaactacgccccggcaactgggccgccggcggtcgaccccggcgaactccggggccggggaccttggcccgaacttacgcccgggggctgaagggccccgggtccccttcaaccctggtccgcctcgtttcggttgaaaataccccccccgtaccagggggaaaacaacgggggggccggggggttcctttgtgcaaaaagcgtttttgagccaccccgcccgggggggcgcccccctctggaacccccgaaaaattttttgggggaaaaccccgaagaagaggcctcctttttttccccggggggggggcccgttgccccaaaaaaagtagaacaccggggctgtttttggggccccacaaccccgggaaaaaaaacacccccgttgggtccgggggtcccccccccccgggtgtgggggcgaggagggcggcgcccccc

SEQ ID NO: 78154 - protein, 136 aa, Zea mays
  misc_feature: Ceres CLONE 1563144
  misc_feature (1)..(78): Pfam Name: LEA_3 Pfam Description: Late embryogenesis abundant protein
MALSLSGTSARFALASLVPRARAYAASAASGAMRRAAEGAAAGEAKEAGRAAARRRDGSWVPDPVTGQLRPGNWAAGGRPRRTPGPGTLARTYARGLKGPGSPSTLVRLVSVENTPPVPGGKQRGGRGVPLCKKRF

SEQ ID NO: 78155 - DNA, 793 bp, Zea mays
  misc_feature: Ceres CLONE 1563145
  misc_feature: Encodes the peptide sequence at SEQ ID NO. 78156
  misc_feature (560)..(560): n is a, c, t, g, unknown, or other
  misc_feature (710)..(710): n is a, c, t, g, unknown, or other
ggagctccccgcggtggcggccgctctagaactagtggatcccccgggctgcaggaattcgtctcacccctagaaaaatccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcggggccggcgcggacccgagcgccatcgcgcccttctccttcgggtcgctgctgggcacgcagctgctgctgatggggntggggtggaagtcaaacgggggggttgaccttctgcacccggactcccaggccgtggagtgggcccaacgcgtggtcgcgcaccgctgagaacttcggctacttcaccggcgagcagggctacccggggcggcaagttcttcgacccgcntcggcctcgccgggaccgtgaaaggacgggggtctaaaatcccccgacgtcaacaagctcgaagcggctcaaggctggcccaa

SEQ ID NO: 78156 - protein, 169 aa, Zea mays
  misc_feature: Ceres CLONE 1563145
  misc_feature (54)..(170): Pfam Name: Chloroa_b-bind Pfam Description: Chlorophyll A-B binding protein
  misc_feature (141)..(141): Xaa is any aa, unknown, or other
MALAPTSAAVLKTPFLGARRALAKPAPRRALVIAAAAAAKKSWIPAIKSDAEIVNPPWLDGSLPGDFGFDPLGLGKDPAFLKWYREAELIHGRWAMAAVLGIFVGQAWSGIPWFGAGADPSAIAPFSFGSLLGTQLLLMGXGWKSNGGVDLLHPDSQAVEWAQRVVAHR

SEQ ID NO: 78157 - DNA, 849 bp, Zea mays
  misc_feature: Ceres CLONE 1563146
  misc_feature: Translation starting site: 243
  misc_feature: SWISSPROT Homolog: EC 2.7.11.1 Non-specific serine/threonine protein kinase
  misc_feature (601)..(601): n is a, c, t, g, unknown, or other
ctccccgcggtggcggccgctctagaactagtggatcccccgggctgcaggaattcgtctcacccctagaaaaaagaggaggcacaagagcgccatacatacacaaacagcgtacaagactcaaccactccctccttgtttgtttatataccttggcaccaccaaggcagcaccctgtaaactaaccaccaaagccgaagaaggcggcttgccctgcccgccgccttggtgccgcgcgcgccatggccaagagcaagtcgtccgccaaggccggccccccgctcctcggcaagtacgagctcggccacctcctcggccggggcaacttcgccaaggtataccacgcgcgctgcctcggcggaggcgaccccgtggccgtgaaggtgctggacaaggccgggctggccgccacgggcatggcgtcgcggctcctgcgcgaggtgtccgccatgcgccgcctgagccaccccaacgtgctccgcctccacgaggtgctggcgacgcgctccaaggtgtacctcgtgatggagctggccccgggcggggacctcctgtcccggctggcgtcgctgccgtcccgcaggctccccgagcacgcggncgcggcgcgtgttcctcccagctggcgtcggcgctcatctacagccacgcggcgcggggtgtcccaccgcgacgtgaagcccgcagaacgtgctgctggacgccgagggcaacctcaaggtgtccgacttcggcctcgcgcgctccccggactcgttccgcgaacacgggcgccttgcacacggcgtggggggacccccggcgtccgggcgccccgaagtgctccgggcgcagggcctacgacgcgcc

SEQ ID NO: 78158 - DNA, 782 bp, Zea mays
  misc_feature: Ceres CLONE 1563150
  misc_feature: Encodes the peptide sequence at SEQ ID NO. 78159
  misc_feature (477)..(477): n is a, c, t, g, unknown, or other
  misc_feature (609)..(609): n is a, c, t, g, unknown, or other
  misc_feature (774)..(774): n is a, c, t, g, unknown, or other
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgncacggcgtcaagttcggcgaagccgtctggttcaaggccggctcccagatcttcagcgagggcgggctggactacctcggcaaccccagcctgatccacgcgcagagcatcctcgccatctgggcctgccangtcgtgctcatgggtgcccgtcgagggctaccgcattgccggcgggccgctcgggcgaggtcgtcgaccccgctgtacccctggcgggaagcttcgaccccccttcggcctggccgaacgacccccgaagccttcgcccgaagctcaaaggtgaaaggagctcangaaacggc

SEQ ID NO: 78159 - protein, 218 aa, Zea mays
  misc_feature: Ceres CLONE 1563150
  misc_feature (61)..(216): Pfam Name: Chloroa_b-bind Pfam Description: Chlorophyll A-B binding protein
  misc_feature (161)..(161): Xaa is any aa, unknown, or other
  misc_feature (216)..(216): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRHGVKFGEAVWFKAGSQIFSEGGLDYLGNPSLIHAQSILAIWACXVVLMGARRGLPHCRRAARARSSTPLYPWREASTPLRPGRTTPEAFARSSKVKGAXET

SEQ ID NO: 78160 - DNA, 813 bp, Zea mays
  misc_feature: Ceres CLONE 1563153
ggagctcaccgcggtggcggccgctctagaactagtggatcccccgggctgcaggaattcgtctcacccctagaaaaagtttccctgctgtctcgcctctctttcggttctcacggcgacgactgggcgagcgccgcctcccctccctcgctccgtgaggtcctcgccggcgacgagtgccgccgcccgtttccatgttttttccgccgattagtgtccaccagatctagtgaaggctggtaacttgacgcaaggtgttcaagaaatttaagccacacactcttcatcataggcccaggcaatatttgtgttaatctcagggacctccagtagattgctgagagttatccttgatacaggggaatatagacacagaattttttgaacattgatctgtagccagtgctgcaatggctacaaagcttgtggttctcggtatcccctgggggatgtgacactgagggttacgagagtacatggccaagtttggacccctagatgatggtgtcgtcatggaagagcgggcttctgggcgatccccgggggtttggcttatgtacatttcgcatcagccaaagatgcaaagaatgttcctggatttgcgaacctgttctttgggggcccgtacctttaaaagtgagaattgcctccccccaaggggaaaaattggatttcccgggggaccaaaaaaccgccccggggttttttggggggccccaaattcccccaccccgggggaccaaatcccattttttttccaagagctttttttgaaatcttttggggagaaaaattttggggtccttttcccct

SEQ ID NO: 78161 - DNA, 824 bp, Zea mays
  misc_feature: Ceres CLONE 1563154
  misc_feature: Encodes the peptide sequence at SEQ ID NO. 78162
  misc_feature (699)..(699): n is a, c, t, g, unknown, or other
ctcctcggtggcggccgctctagaactagtggatcccccgggctgcaggaattcgtctcacccctagaaaaagaaaagaaaggatgatatactgcctaagttgatggctggtgttggatcacatgatgatcttttcaagaaagagattgctaagtatgatcctatctgtgctgatattgctgataacattgtggcacaggaacaattattgctgcaaatacaggcacaaaatgagcaatttgctgctgtattcaatatagaggattacaaagctgctcgtgagagatgttacaagcaaattgctgctgctgttgctaaataccgggagtttaagaagaacattaacgagggcttaaacttttacgtgactctgcaggaagcaataggcaaaataaaacagcagtgcatgtacttcataatgacccgaaacattcaatgccgtgaaatgatcgaagatgtgcagaggaagctagcgggtttcagcttctcgtcctccagccactcctctatgcagaggaatgcttctgtaccacctgatcagagcagcccgtcaccaccaccgcatgctcatgctccctatgcctctccaccctggggtagactcacagccataccccccatcctatggcgcaccaccacaacagccctcatatggcgcaccacacccctggtcagtaccatgccgcagcgcaccagcancctcctggccatgactacggtcagccggcatatccctggattggcgtgggccattattacaatgcccctcagccgcaacaattctcgccttttcccacgcccaccgttaaaatgccccctggggt

SEQ ID NO: 78162 - protein, 240 aa, Zea mays
  misc_feature: Ceres CLONE 1563154
  misc_feature (199)..(199): Xaa is any aa, unknown, or other
MAGVGSHDDLFKKEIAKYDPICADIADNIVAQEQLLLQIQAQNEQFAAVFNIEDYKAARERCYKQIAAAVAKYREFKKNINEGLNFYVTLQEAIGKIKQQCMYFIMTRNIQCREMIEDVQRKLAGFSFSSSSHSSMQRNASVPPDQSSPSPPPHAHAPYASPPWGRLTAIPPILWRTTTTALIWRTTPLVSTMPQRTSXLLAMTTVSRHIPGLAWAIITMPLSRNNSRLFPRPPLKCPLG

SEQ ID NO: 78163 - DNA, 665 bp, Zea mays
  misc_feature: Ceres CLONE 1563155
  misc_feature (254)..(254): n is a, c, t, g, unknown, or other
  misc_feature (255)..(255): n is a, c, t, g, unknown, or other
  misc_feature (627)..(627): n is a, c, t, g, unknown, or other
ctccccgcggtggcggccgctctagaactagtggatcccccgggctgcaggaattcgtctcacccctagaaaaactcccgcagagccgccgacaactctctctaccgtccgataccccaagcaccagcgcggcggcggcgaccatggctgtcggaaagaacaagaggatctccaagggaaagaaggggtggcaagaaaaagaccgtcgaccctttctctaagaaggattgggtattgacatcaagggcacccgnntcggttgttcaagtgttgcggcaaacatccgggaaaagactcctccgtatcccagggaaacacaggggggtacccccagggaatttggcctttccggaaagggggcctggaaaacccaacaaaaaagtccccttttttaaaaggggtttttttccccccctaaaaaccgtggttaaaattctttctttcccggggggggggcccaacccccccaaagggggattttttttttaggggcgcctttttttttttgggggggggaaaaaaaaaaatatttttttgggggggggggccccccccccccccgggggggggggggaaaaaaaaaaaaaaaatattttttgccccccccgggggggggggggccccccngagaagaaaaaaaaaatatgtgggggcccgccgccccc

SEQ ID NO: 78164 - DNA, 831 bp, Zea mays
  misc_feature: Ceres CLONE 1563159
  misc_feature: Encodes the peptide sequence at SEQ ID NO. 78165
  misc_feature (688)..(688): n is a, c, t, g, unknown, or other
  misc_feature (794)..(794): n is a, c, t, g, unknown, or other
ctggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatcacgcgcagagcatccttgctatctggacatgcccagtcgtgctcatgggcgccgtcgaggggctacgcatcgccggcagccngctcggcgaagtcgtcgatccgctctaccccggcgcagctgcaccgtggcctccccccaaaaaaaacacccaaagccttcccccgagctcaaggtcagggactaangaacggccgccccccaaggttctccatgttcggatcc

SEQ ID NO: 78165 - protein, 228 aa, Zea mays
  misc_feature: Ceres CLONE 1563159
  misc_feature (65)..(228): Pfam Name: Chloroa_b-bind Pfam Description: Chlorophyll A-B binding protein
  misc_feature (181)..(181): Xaa is any aa, unknown, or other
  misc_feature (216)..(216): Xaa is any aa, unknown, or other
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLITRRASLLSGHAQSCSWAPSRGYASPAAXSAKSSIRSTPAQLHRGLPPKKTPKAFPRAQGQGLXNGRPPRFSMFGS

SEQ ID NO: 78166 - DNA, 772 bp, Zea mays
  misc_feature: Ceres CLONE 1563160
  misc_feature (682)..(682): n is a, c, t, g, unknown, or other
ctcaccgcggtggcggccgctctagaactagtggatcccccgggctgcaggaattcgtctcacccctagaaaaatggattgtggtagtagcttctaacacacctggcctggatttgtgcaggacaatgtttttgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaaggacgagatcgcaagggcggtggaggaagagcttgagaaggccatgtcggcttatggctttgagatcgtgcagactctcatcgtggacatcgagccagacgagcatgtgaagcgcgcaatgaacgagatcaacgcagctgcgaggctcagggcggctgcaaacgagaaggcggaggcgggagaagatcgtgcagatcaagcgcgcggaagggggaggcagaagccaagtacctgtccgggctgggcattgcgcgccagcggcaggccatcgtggacgggctcagggacagcgtgctgggggtcctccgtcaacgtgccgggcaccacccgcccaggacgtccatggacatggtgctcatcacccagtaactcgacaccattgaagganatccggcgcgtccgtccaaggcggtcctcgggtgttcatccccgcatggccccccgggagcggtggcgcgacattcccccacgcagatcc

SEQ ID NO: 78167 - DNA, 836 bp, Zea mays
  misc_feature: Ceres CLONE 1563163
  misc_feature: Translation starting site: 129
ctggagctccccgcggtggcggccgctctagaactagtggatcccccgggctgcaggaattcgtctcacccctagaaaaacttccattccccaatctagggttgctgagctccccaccaccgccggtcatgcccgacgcggatgttgacaccgtgattcgcgaagccgccgcggccgcggccccagccggcgacgacgacagcgagggtgacaccgaggaagaggaggaggagggggacgaggtcgacgaggacgaggacgacgacgaggaggagttacccgccgaggcgccggcgccggacgaggagcaacctgccccagcgcccatctcgaccttgccggggaatccaaaccagctgacgctggtcttccagggcgaggtttacgttttcgaatccgtcacccccgagaagttcaagctgtgctgctacttttaggacgtggtgaactaccacctggtttagctggcatggttttacccaatcaaaatgcccacaagggctatgacgatatacttcagaggacagacattccagcaaaaaaggttgcttcactatttaggttccgtgagaaaaggaaggaaaagaattttgataaaaaaataccttatgctgtccccaaagaagtggccccccgggatgcaccgtccgaaagggcaatttgctggaaaaacccacccggaagggaaaacccccgcccccgggaatggatacccgggtccccaggggccaggcccaaatttttgcctccccaaaaacaaggggcccaaaactggggggtcttagggaaaaaaaagccccccccctttggtcttggggggcccccgggggccaaag

SEQ ID NO: 78168 - DNA, 785 bp, Zea mays
  misc_feature: Ceres CLONE 1563164
  misc_feature: Encodes the peptide sequence at SEQ ID NO. 78169
ctcaccgcggtggcggccgctctagaactagtggatcccccgggctgcaggaattcgtctcacccctagaaaaacaacacgacgatcgtggagatggaccccggcagcttccgcaccttcgacctgagctactaccgcggcgtgctcaagcggcggggcctgttccagtccgacgccgcgctcatcaccgacgccgcctccaaggccgacatcctcagcgtgatcaacgcgccgcccgaggtgttcttccaggtcttcgcgggctccatggtcaagatgggcgccatcgaggtcaagaccggctccgagggcgagatcaggaagcactgcgccctcgtcaacaagcactaggcggcggaattcatgcgggagatggctccattgctcgcaaaaaatccttgtgagacacacaacatgctctgcatctgcaggcgttgtcgtcaccttggtggacgtagtacatcggtgcatggattatctgttgtttaatttgtacgttcagttcattctgtttcttgtattcttttggttcctttcctcttgtttattctggatgatgaaggtgtttctgttttaatctctggttcagctgtaacatgtaacatgtaaagtgcgcgttttgtcctcgtgatctctgcaactgtatttattttaaatggatggtatacatgggaagatatgatcatgatattaacaattagggtgattacaaaaaatagcacagcaccaaggagaggccgaaaagcgcttttacccgtagcgtaaacgataagatggaagctagc

SEQ ID NO: 78169 - protein, 85 aa, Zea mays
  misc_feature: Ceres CLONE 1563164
  misc_feature: SWISSPROT Homolog: EC 1.11.1.7 Peroxidase
MDPGSFRTFDLSYYRGVLKRRGLFQSDAALITDAASKADILSVINAPPEVFFQVFAGSMVKMGAIEVKTGSEGEIRKHCALVNKH

SEQ ID NO: 78170 - DNA, 828 bp, Zea mays
  misc_feature: Ceres CLONE 1563165
  misc_feature: Encodes the peptide sequence at SEQ ID NO. 78171
ctccccgcggtggcggccgctctagaactagtggatcccccgggctgcaggaattcgtctcacccctagaaaaatcatctccagcggcttcttccaaagctccaactacgacgagaaccgccactcctcgaaatctccaaggattttctgcggcgaaccccttcgtgacgtgacccaatgggagaggcctcgccgtctatcgccaaggacgtcaccgagttgatcgggaacacgccgctggtgtacctcaacaaggtgaccgatgggtgcgtcggccgcgtcgccgcctagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagatgaggatcatattgaatgctcttggtgctgaacttgtccttactgacccactcctgggaatgaaaggagctgtctagaaagcggaagacgtacaagcaaagacacccctactcgtacatccttcgacaattttgaaaatccagctaacccaaagattcactgtgagactactgggccctggaatctggaaagctacagcaggaaaaattgctgggcctttgttcctggtatcggggacaggaagtaccatccccgggaactggggcgatacctcaaagagccaaaatcctatggtaaggcttcttgggggtggaaccccggtggaaaag

SEQ ID NO: 78171 - protein, 91 aa, Zea mays
  misc_feature: Ceres CLONE 1563165
  misc_feature: SWISSPROT Homolog: EC 2.5.1.47 Cysteine synthase
MEPCSSVKDRIGYSMITDAEEKGLITPGVSVLIEPTSGNTGIGLAFMAAAKGYKLTLTMPASMSMEMRIILNALGAELVLTDPLLGMKGAV

SEQ ID NO: 78172 - DNA, 807 bp, Zea mays
  misc_feature: Ceres CLONE 1563166
  misc_feature: Encodes the peptide sequence at SEQ ID NO. 78173
  misc_feature (611)..(611): n is a, c, t, g, unknown, or other
ctccccgcggtggcggccgctctagaactagtggatcccccgggctgcaggaattcgtctcacccctagaaaaacttgacctcacaaaggcagtaaaggatacagttaatgtaagcgctggagatgttgcttctctcatatatttgtggaacccttgggcaatagtcacttgtgtgggatcatgtacatcaccaatcgagaatctaatggttgtaataatgatctacggatcctgttcacgtctggctcctcttgctgcttttggatatgttatggccacacacctctctctttatcctgcaattctcatagtaccggtcattctgttgctgggttatggtctagatgctcctcctccaaaagtatttgttataaaagggtcaattgccagaaaaagtgatgtgtcagacaatgataaaacaagcagacagagagttgttcagcagttttcatggaaaccagtacttcactttatattttggctgttcatctggtcgtgccatgtgttgttattgagcagcgtgattttgaagaaaagtggtggcctccacgagatgtttgaaaagacgtatgggtttttacttacagtgaaagaactatcaccaatattngtggttttggtggtactccctttgctgaagtttccgacttcctttaaaaatttcctttcttatgggtattccataattgaacatcatttttttatgggcctttacccatgggggccatccccaattgaaaaacattcggccccggggcttttcccttggaaattttggttttaacacccggcaaatttttggtggc

SEQ ID NO: 78173 - protein, 260 aa, Zea mays
  misc_feature: Ceres CLONE 1563166
  misc_feature (203)..(203): Xaa is any aa, unknown, or other
PRGGGRSRTSGSPGLQEFVSPLEKLDLTKAVKDTVNVSAGDVASLIYLWNPWAIVTCVGSCTSPIENLMVVIMIYGSCSRLAPLAAFGYVMATHLSLYPAILIVPVILLLGYGLDAPPPKVFVIKGSIARKSDVSDNDKTSRQRVVQQFSWKPVLHFIFWLFIWSCHVLLLSSVILKKSGGLHEMFEKTYGFLLTVKELSPIXVVLVVLPLLKFPTSFKNFLSYGYSIIEHHFFMGLYPWGPSPIEKHSAPGLFPWKFWF

SEQ ID NO: 78174 - DNA, 807 bp, Zea mays
  misc_feature: Ceres CLONE 1563167
  misc_feature: Translation starting site: 98
  misc_feature (443)..(443): n is a, c, t, g, unknown, or other
  misc_feature (541)..(541): n is a, c, t, g, unknown, or other
  misc_feature (642)..(642): n is a, c, t, g, unknown, or other
  misc_feature (643)..(643): n is a, c, t, g, unknown, or other
  misc_feature (776)..(776): n is a, c, t, g, unknown, or other
  misc_feature (807)..(807): n is a, c, t, g, unknown, or other
ctccccgcggtggcggccgctctagaactagtggatcccccgggctgcaggaattcgtctcacccctagaaaaaccactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgctcgccgcctgccgctcgccccgctcgccgcctccgactccgccttcgagtcctccgtcggagttaactacgcggagcccgacgactcggagaaggataaggaggtggagttgttcggatcgggtgacgacgagggggcgggtgaagttggtggatgaccattccgtagaggtctcagccgctgtcgaggacgaggtggaggaggaggtncggggagtacgttgagccgcccgaggaggccaaggtctacgtcggaaacctgccctacgacgtcgacagcgagcgcctcgctcagctcttcgaccagnccggcgtcgtcgaggtcgcagaggtcatttacaacagagaacagatcaaagtcgtgggttttgggtttgtcactatgagcactgttgaagaagctgaaaanngctgtgagatgttccatcgctatgatgtcaatggaaaggctctgactgtaaataagcagctctagaggctctcgtgtggacagactcccaaacatctgggcctctctcaaaattatgtgggcacctggctggncagtgatgattcaaaattggggagttgtcan

SEQ ID NO: 78175 - DNA, 781 bp, Zea mays
  misc_feature: Ceres CLONE 1563168
  misc_feature: Translation starting site: 206
  misc_feature: SWISSPROT Homolog: EC 1.15.1.1 Superoxide dismutase
ctccccgcggtggcggccgctctagaactagtggatcccccgggctgcaggaattcgtctcacccctagaaaaaatcctcacttcaggtctgcagcccccaactacccccagcctcggaaggaaccttccagaagcgcaagactctaaaggccgtcgccttcccattcttcctcgccgcgggggtcgcctgagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcagatggtgttgctaatatcaatgtcaccgacagccagatcccactgactggggccaaactcaatcattggcagagctgttgttgttcacgctgatcctgatgatctttggaaagggtgggcacgagctcagcaagagcactgggaacgccgggtgggccgtgtgcttggtgggatcattggactccaggggctgaaaacgatcgccgggacttgggggttgccctgaaaaagtcccggtctcctggcggtcccccagcagtacgaaccctgaacatttccggaagacatccgtgaaaataagaagcg

SEQ ID NO: 78176 - DNA, 825 bp, Zea mays
  misc_feature: Ceres CLONE 1563173
  misc_feature: Encodes the peptide sequence at SEQ ID NO. 78177
  misc_feature (537)..(537): n is a, c, t, g, unknown, or other
  misc_feature (575)..(575): n is a, c, t, g, unknown, or other
  misc_feature (593)..(593): n is a, c, t, g, unknown, or other
  misc_feature (661)..(661): n is a, c, t, g, unknown, or other
ctccccgcggtggcggccgctctagaactagtggatcccccgggctgcaggaattcgtctcacccctagaaaaagaggagcaggcgacaccttcaccgcttcggtaacggatcgacaggcgacagctcacagctggcggtggtttggctcggggacggggtgcggcggcctccgcgagcagttcggcagcgacacggcgcggggggtgggcgccttgctggctggtgtagcgtagtgcgggccacaacgaggaagcggtggcatccagcaggcaccatcagaaaaccacatggctcggcaaccttggagcaataatggccatagaaattccccttcaaattcattagatggaggagttcctggacccatgcctctggtccctttccaggaggaacttgcagttggttgtgaagagattcgtagaattgctgctgataatactcttgtgctagaggatattctgggccttaggcaagaattagctgtcattgaagacgagatccatatacttgccaaacaaaccattcccagacttcngtgttgataatgaaatggaatacagggatattatccangggaggcatgaagttagnaggaacagatgcatgctcttaaacttatcaagggaggaagtgttggtccctagttctgaaaagatggnagtgggaagctttgtgcaaagagctatctgtgaaggttcagtccattgtacagggaggctggagcaaatcccatcccgagaaacagcagatacctgctattaaaagaaggggtgcatgattttccaagaggaaaaccgaagggcccagattgcataccaaccag

SEQ ID NO: 78177 - protein, 84 aa, Zea mays
  misc_feature: Ceres CLONE 1563173
  misc_feature (83)..(83): Xaa is any aa, unknown, or other
MARQPWSNNGHRNSPSNSLDGGVPGPMPLVPFQEELAVGCEEIRRIAADNTLVLEDILGLRQELAVIEDEIHILAKQTIPRLXC

SEQ ID NO: 78178 - DNA, 773 bp, Zea mays
  misc_feature: Ceres CLONE 1563174
  misc_feature: Encodes the peptide sequence at SEQ ID NO. 78179
  misc_feature (545)..(545): n is a, c, t, g, unknown, or other
ctggagctccccgcggtggcggccgctctagaactagtggatcccccgggctgcaggaattcgtctcacccctagaaaaattcacgccccgtggcagcgggcagcggctcggacagcgctcattcagttcgtcacggacttgcagatctgaggatttgggccgtaagggtactagagccggcgccggcggttacctggggcggccgccccacctcgctgttacggtaggtgcgtccctaacctcgaagcttcgacgcaagaggcggtgaatccaatggcgggcgaggaagagctcactgtaggcggcggcgtgcccatccggccgccgcggctggaagacgcggggctcgaggactgcgcgctcccgccggagtctatcgctgaggcattctccctcgctgccgcggccgtctcctcccgcctcgcccggctgcccttctccgaagactccgacgaggaggactgcgtctcggcaccacgcggaggaggctgcgtggatgacgccggactcgactgcggggccgcccccgtcgccctcgtccgcngcggcgttgcgggcgtcggcagcgtccaccaaatccgtggtccgtcggccggaagaccccgaagcggaatacaagaaccccgtaaattgggcccggtggcccccccaaaaaagaaagaatacccttccctggggggggcccggggaaacaccccccggggacaaggggaaaaaaaaaccctggggaaaaaagaaaaaatgaaattttctcccaaggggggggccccaa

SEQ ID NO: 78179 - protein, 166 aa, Zea mays
  misc_feature: Ceres CLONE 1563174
  misc_feature (91)..(91): Xaa is any aa, unknown, or other
MAGEEELTVGGGVPIRPPRLEDAGLEDCALPPESIAEAFSLAAAAVSSRLARLPFSEDSDEEDCVSAPRGGGCVDDAGLDCGAAPVALVRXGVAGVGSVHQIRGPSAGRPRSGIQEPRKLGPVAPPKKKEYPSLGGARGNTPRGQGEKKTLGKKEKMKFSPKGGAP

SEQ ID NO: 78180 - DNA, 844 bp, Zea mays
  misc_feature: Ceres CLONE 1563176
  misc_feature: Encodes the peptide sequence at SEQ ID NO. 78181
  misc_feature (416)..(416): n is a, c, t, g, unknown, or other
ctccccgcggtggcggccgctctagaactagtggatcccccgggctgcaggaattcgtctcacccctagaaaaaggcaaaccagcacccgccgccgacagggaacatcgccggccgagatcggctgcacatctgtgctgcttcagggcgccggagttcgcgtcgtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctcccccaggggcgtatcctcctcctccaggggcatatcctcctccacctggggcatacccaccacaatatgggtaccctcagccangtggctacccacctcaaggtggatatccctctgcaggctaccccgggctcatctcaccagggttatgggagcagccacggcgggggccacgggggccaccatggggacggggggcaagctaacaggaggtgctgccccgggccccttcccctttttggaaccaaaaaacctttcccatgggccttagcggaaaccggggggaaaagggggccctttgggaggctttgggcccacgggggtttccgccccccggggttttggggggcccccggcaaaatttcaaaacttggggcccgggccccccccgggaaaatttttaaaacccgggggccccggaaattttcttaaatttggggaaaaacccggggcccccccgttttttttttggggcccgcccccttttctccaaaaaaagggggggaagagtt

SEQ ID NO: 78181 - protein, 116 aa, Zea mays
  misc_feature: Ceres CLONE 1563176
  misc_feature (77)..(77): Xaa is any aa, unknown, or other
MGGGKDKHDESDKGLFSNMMHGVAGGHGYPHQGYPPQGYPPQPGAYPPPPGAYPPPPGAYPPPPGAYPPQYGYPQPXGYPPQGGYPSAGYPGLISPGLWEQPRRGPRGPPWGRGAS

SEQ ID NO: 78182 - DNA, 794 bp, Zea mays
  misc_feature: Ceres CLONE 1563177
  misc_feature: Encodes the peptide sequence at SEQ ID NO. 78183
  misc_feature (711)..(711): n is a, c, t, g, unknown, or other
tccccgcggtggcggccgctctagaactagtggatcccccgggctgcaggaattcgtctcacccctagaaaaagccacctccgcgcgggcacggcacgtcgtagtaaaaccctagaaaaacagtagcccaccgcgccggcgagccgaagcgagcgcggagctaaggatgccgcggaccaccgtggtagagagctccggctgcccgccgctccgcgccctcaccaccgacatcctcggcctcgtcaaagtcgtcgaggcccacgcgaggccggcgggcgccgccaaggtcgtcgagacgtggggcgcgcctgacgcttcccgtgccatcgttgctgcctccctcgccgatcgtgccgccgaccccgtcttggctgtggcgaggaggaacggcgtggttgagctgctgaatcccttgaatggaagtgctctggctgctgtcaagaccgcggggtcagcgccaaatgacagtggcgctgaaggtgatcccctcgccgcactgcatcttttcgcaagacagacttcggactcgatcttaggcacatttcttgcctgcacggagaaggggaaagcttctatcaggtccatcacgaaagaaaatgcagattcggggttcggatgttgggccatcagccacaatgggatgtgtgcaatgggggccaatgtgcaattttgctcagtagatcatggcgaaagctatgtgatattttgganggaaaaggcataagaagtgaaacttgtgggatatcacatctagtagtaaggacatgggtctgctaaatctccccggagcaatt

SEQ ID NO: 78183 - protein, 185 aa, Zea mays
  misc_feature: Ceres CLONE 1563177
  misc_feature (182)..(182): Xaa is any aa, unknown, or other
MPRTTVVESSGCPPLRALTTDILGLVKVVEAHARPAGAAKVVETWGAPDASRAIVAASLADRAADPVLAVARRNGVVELLNPLNGSALAAVKTAGSAPNDSGAEGDPLAALHLFARQTSDSILGTFLACTEKGKASIRSITKENADSGFGCWAISHNGMCAMGANVQFCSVDHGESYVIFWXEKA

SEQ ID NO: 78184 - DNA, 771 bp, Zea mays
  misc_feature: Ceres CLONE 1563180
  misc_feature: Translation starting site: 145
ctccccgcggtggcggccgctctagaactagtggatcccccgggctgcaggaattcgtctcacccctagaaaaaaaaaaccctagctttccctcctcccctgttttgcggcgcgccacgaactctcgacgctctcgagagatccatggtatcggcgcaagggcggcaaccgcgacaccaacggcagcctggtcgaggccacggcgtcgaggctgacggtcgaatcccacgaggaggcggaagaagtggggtgggaggctggaagagagctccgacgcctcggtgtcaagacccaccggcggagcccaaggtcattgggaacaaaaagaccgtggacgactactaattcggagtctaatgccgactccggatccacgaagaactgcttaaacatctccttcgcaccaaagcatatgcgaaagttctcacccagactagctctctgatctagagcacactaccacctgatggtggtgctggaacaggtactatctccacctgctgtggaggatcaggaccttaacatgtctatgcgattgagtgctcgcctacgacatacctggcacacgagatccgcagactcgacggatactcagatgtcatcactgtaatggaaggcagagcggaagacatagaacttctactcgctcaagtagacgtcctcatctgacgagtggatgcgacatctcctcctgcttcagaacatgttgaaaactgtcctatatgaacgtgacatatggcgtgcgaaagggcgttgacgtccctgccaaaa

SEQ ID NO: 78185 - DNA, 842 bp, Zea mays
  misc_feature: Ceres CLONE 1563181
  misc_feature: Encodes the peptide sequence at SEQ ID NO. 78186
  misc_feature (768)..(768): n is a, c, t, g, unknown, or other
  misc_feature (773)..(773): n is a, c, t, g, unknown, or other
  misc_feature (830)..(830): n is a, c, t, g, unknown, or other
ggagctccccgcggtggcggccgctctagaactagtggatcccccgggctgcaggaattcgtctcacccctagaaaaaatcccattccataccattccgccaaagaagaaccacagacgctcgctcccaactcccaagccaagccggatcccaaaatcggcacagcgcacccactccgctcagtcccttcgttcacccccatccatccagccagccagccagccatgggcggcaaggactgcggcaaccacggcgaggacgacctgcggcggtcgtgccggcgcctgctagcgatcctcctagtcctggccctgatcgtgggcgtgatcgcgctgatcatctacctggtggtccgccccacgcacccgcgcttctacctgcaggacgcgtcgctgcagcagctagacctctccaacgccaccaccaccaccaccacctccgcgtcctcgtccctcctctccacgacgctgcaggtgacgctggcctcgcgcaacccgaacgagcgcgtgggggtgtactacgaccggctggacgtgtacgcgtcgtacaagtaccagcaggtgacggtggccgcggcgctgccgcccgtgtaccagggccacggcgacgtggacgtgtggtcgcccgtgctctccggccccggcgtccccttcgcgccctacctcgccgacgcgctccgccaggactgccaggcgggctacctcgtcctcccagtcaggtccaacgccgcgtgcgaatgaaagtcggcagctggatctccggcactancaccntctcgtacctgcccccgcgtcctcgtcacgccgggcgcaacgggcgccgggggcttnccgggtcaggtt

SEQ ID NO: 78186 - protein, 171 aa, Zea mays
  misc_feature: Ceres CLONE 1563181
  misc_feature (40)..(170): Pfam Name: Hin1 Pfam Description: Harpin-induced protein 1 (Hin1)
MGGKDCGNHGEDDLRRSCRRLLAILLVLALIVGVIALIIYLVVRPTHPRFYLQDASLQQLDLSNATTTTTTSASSSLLSTTLQVTLASRNPNERVGVYYDRLDVYASYKYQQVTVAAALPPVYQGHGDVDVWSPVLSGPGVPFAPYLADALRQDCQAGYLVLPVRSNAACE

SEQ ID NO: 78187 - DNA, 753 bp, Zea mays
  misc_feature: Ceres CLONE 1563182
  misc_feature: Encodes the peptide sequence at SEQ ID NO. 78188
  misc_feature (613)..(613): n is a, c, t, g, unknown, or other
ctcaccgcggtggcggccgctctagaactagtggatcccccgggctgcaggaattcgtctcacccctagaaaaaaggacgccattagcagcggttggccaccacccgacgccggaggcccggaggaggaggcggcgatggcggggaagcacgggcgcaacggcttcgacgacgacaacgtcaaccctttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagaggcggcatcccgagctggcgttgtgataggagagaaaaactggcctccctttttccccctcatccaccacgacatttccaatgaaatacctatccatctacaaaggatgcagtaccttgcattctcatcattcttgggattgatagcgtgtctcttttggaatgtcatagcaactacaacagcatggattaaagggggagggggtgtatgatctgggctgcttgccattatctacttncatatcctggtgcgcctgggggcttatgttgctatgggtatcggaccctctttataatggcaatgagaactgagagcgctttggaaatttggggttgggtttttccctatttttacatgattcatataaaaccctccggg

SEQ ID NO: 78188 - protein, 149 aa, Zea mays
  misc_feature: Ceres CLONE 1563182
  misc_feature (90)..(148): Pfam Name: SCAMP Pfam Description: SCAMP family
MAGKHGRNGFDDDNVNPFAGGSVPPATNSRLSPLSHEPADFYNVDIPLDSSKDLKKKEKELQAMEAELNKRERELKRKEEAASRAGVVIGEKNWPPFFPLIHHDISNEIPIHLQRMQYLAFSSFLGLIACLFWNVIATTTAWIKGGGGV

SEQ ID NO: 78189 - DNA, 791 bp, Zea mays
  misc_feature: Ceres CLONE 1563184
  misc_feature: Encodes the peptide sequence at SEQ ID NO. 78190
ctcaccgcggtggcggccgctctagaactagtggatcccccgggctgcaggaattcgtctcacccctagaaaaaaaatcccattactttctcccttaaaacctcctctcccctcgttctcctccgcctcctcctcccacctccccacacgggcacacctgccctccccgtcgccgcggacccactcccatggcaaagctcccgcgtctaccctgctcgtttgccgttctcgcgctcatgtgcatcatcccgctcacagcgccgcggcctgcactgtcctcgcgcgcggccccaagggacggtgtctccttcgccggcgcaggcaacacgatacatcaacttcttaaagatcacggccttcccggaggactgctcccgcgcggcgtggagtcgtacaccctggacgagtcgaccggcctgctggaggcgcggctgtcggcgccgtgctacgccacgtacgacaacggcgaactggcctacttcgacaacgtggtgcgcggcaacctcagcaagggcgcgctccgaggcgtggaaggcctctcccaggaagagctcttcgtctggctcccccgtcagggcatcctcgtccaggaccaggaaacccgggggtcatcctggtccaacatcggggttagcccacaaagaaccctggcggaagggtcgctcttccaagggaacccgccgggaatggcaaagccgtccgggccttccggggggggaatgaaagcgccggccctcccggcccgccccgggaagggaaaggggccaccccccaaggggggtttacctgga

SEQ ID NO: 78190 - protein, 201 aa, Zea mays
  misc_feature: Ceres CLONE 1563184
  misc_feature (17)..(171): Pfam Name: DUF538 Pfam Description: Protein of unknown function, DUF538
  misc_feature: SWISSPROT Homolog: EC 3.6.1.41 Bis(5'-nucleosyl)-tetraphosphatase (symmetrical)
MAKLPRLPCSFAVLALMCIIPLTAPRPALSSRAAPRDGVSFAGAGNTIHQLLKDHGLPGGLLPRGVESYTLDESTGLLEARLSAPCYATYDNGELAYFDNVVRGNLSKGALRGVEGLSQEELFVWLPRQGILVQDQETRGSSWSNIGVSPQRTLAEGSLFQGNPPGMAKPSGPSGGGMKAPALPARPGKGKGPPPKGGLPG

SEQ ID NO: 78191 - DNA, 753 bp, Zea mays
  misc_feature: Ceres CLONE 1563185
  misc_feature: Encodes the peptide sequence at SEQ ID NO. 78192
  misc_feature (592)..(592): n is a, c, t, g, unknown, or other
  misc_feature (611)..(611): n is a, c, t, g, unknown, or other
  misc_feature (612)..(612): n is a, c, t, g, unknown, or other
  misc_feature (618)..(618): n is a, c, t, g, unknown, or other
ctccccgcggtggcggccgctctagaactagtggatcccccgggctgcaggaattcgtctcacccctagaaaaactccctcctcagtcgtcacacacactcagccagtccgctgcctccgcgctcccccaaaacccaccgcctcgccggaatcctagccttcgccaaccagtcgccatgagagagatcctccacatccagggcgggcagtgcggtaaccagatcggggccaagttctgggaggtgatatgcgacgagcacggcatcgatcacaccggaaagtacgccggcgactccgacctccagctggagcgcatcaacgtctactacaacgaggccagcggcggccgcttcgtcccgcgcgccgtcctcatggacctcgagcccggcaccatggactccgtgcgctcgggccccttcggccagatcttccgccccgacaatttcgtcttcggccagtccggcgccggcaacaactgggccaagggccactacaccgagggcgccgagctcatcgactccgtgctcgacgtcgtgcgcaaggaggccgagaactgcgactgccctccaaggggtccaggtctgccactcgnctgggaggaaggtacaggnntcaggnaatgggcacccctgctcatctcccagatcaagggaggagtaccccggaccggaatgatgttgaacattcctctgtcttccccgtcggcccaagttgtcctgaatactgttggggggagcccttaaaaacgccacc

SEQ ID NO: 78192 - protein, 188 aa, Zea mays
  misc_feature: Ceres CLONE 1563185
  misc_feature (45)..(185): Pfam Name: Tubulin Pfam Description: Tubulin/FtsZ family, GTPase domain
  misc_feature (139)..(139): Xaa is any aa, unknown, or other
  misc_feature (146)..(146): Xaa is any aa, unknown, or other
  misc_feature (148)..(148): Xaa is any aa, unknown, or other
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRKEAENCDCPPRGPGLPLXWEEGTGXRXWAPLLISQIKGGVPRTGMMLNIPLSSPSAQVVLNTVGGSP

SEQ ID NO: 78193 - DNA, 868 bp, Zea mays
  misc_feature: Ceres CLONE 1563186
  misc_feature: Encodes the peptide sequence at SEQ ID NO. 78194
  misc_feature (425)..(425): n is a, c, t, g, unknown, or other
  misc_feature (611)..(611): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (787)..(787): n is a, c, t, g, unknown, or other
  misc_feature (824)..(824): n is a, c, t, g, unknown, or other
  misc_feature (855)..(855): n is a, c, t, g, unknown, or other
ctccccgcggtggcggccgctctagaactagtggatcccccgggctgcaggaattcgtctcacccctagaaaaaagcctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgtccaccgtcgggatgggggtgcccctaagagggcttcttttcttccctgccgcntctcgggaaacgccggccggcgggagacctacgcgaaaggacaagctgggcaaacgacattccccggggggaagggttggctcaaaaacgcaacagtggcccaaagacccgcacgcctcgcgccaagggggcttcaaggggtggaccccccccccgtaacacccggggtgggtgggagcaaggganaacagaccgctgggccaccctacgggggattcaaacgcccgtgtggggcctcccaccccccgggcctggggtggcggnnnnntggggccccggggaaaacggcgccccccaaaaaaaaagttttacatttttgccccttggcccccggatgtcccgtacaacaaaacaaagggggnaaaagaggggtcctggtggaacacggcggcctcctcnaattaactccacattccccctggccctgggnttcacgccccacc

SEQ ID NO: 78194 - protein, 145 aa, Zea mays
  misc_feature: Ceres CLONE 1563186
  misc_feature (54)..(94): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
MATSAALSTAANPTQLCRSRASLGKPVKGLGLSMGRERAQRSIVCQAASSISADRVPDMEKRKLMNLLLLGAISLSTVGMGVPLRGLLFFPAASRETPAGGRPTRKDKLGKRHSPGGRVGSKTQQWPKDPHASRQGGFKGWTPPP

SEQ ID NO: 78195 - DNA, 908 bp, Zea mays
  misc_feature: Ceres CLONE 1563187
  misc_feature: Encodes the peptide sequence at SEQ ID NO. 78196
  misc_feature (401)..(401): n is a, c, t, g, unknown, or other
  misc_feature (419)..(419): n is a, c, t, g, unknown, or other
  misc_feature (482)..(482): n is a, c, t, g, unknown, or other
  misc_feature (484)..(484): n is a, c, t, g, unknown, or other
  misc_feature (487)..(487): n is a, c, t, g, unknown, or other
  misc_feature (488)..(488): n is a, c, t, g, unknown, or other
  misc_feature (506)..(506): n is a, c, t, g, unknown, or other
ggagctccccgcggtggcggccgctctagaactagtggatcccccgggctgcaggaattcgtctcacccctagaaaaaacactccgccacacagtaaacaaaacgacgggcccactccccgacggctgacgccctcccacggccccttccatgaggcagctgcacctctcgccgcagctctccccctccccggtcctctcctcttacttctcgccgccgccggcggaggcctcgtcctggcggcggcggctgcaccggggacgggccttccaaccgccgctctcctcgctgcgggatcccaacaaggccacgctccgcaaggcctcgtccaacgtccccttccgcctcggcggtgggcgggagcggcagccccaaggaccgccgccccgccgacgacgacnaggcggaggaagaagccntaggcgagggcggcgcaggggcactcacggggacgctggtcgcaggagcgctactggtggttncntanngggggtttgggggcgccnggatacctgtacaaggaccagatcacacccttcctcacgcagtttctaggggtccttggaaggctatggtccaagccggaaaggctcccggtccaaacttggaaaaggcaggaattggaggtttccccctaattcccccaaaaacctttaacaatggcaaccggggccaattattttgggaagggggaccggggaaatttttttgtttcaaaccaagggaaaaacaaaacgtggccggggggggccccctccctttcccccaaaaaacttcccccaaaaaaaaaaattttttaaagttgttgaagaaaaaaaaaaaaaatttcttcggcttttaaaaaacacaaaggggaaaaagggtctcccggggggccccccttctcccctttggagccccccgtttcc

SEQ ID NO: 78196 - protein, 134 aa, Zea mays
  misc_feature: Ceres CLONE 1563187
  misc_feature (84)..(84): Xaa is any aa, unknown, or other
  misc_feature (90)..(90): Xaa is any aa, unknown, or other
  misc_feature (111)..(111): Xaa is any aa, unknown, or other
  misc_feature (112)..(112): Xaa is any aa, unknown, or other
  misc_feature (113)..(113): Xaa is any aa, unknown, or other
  misc_feature (119)..(119): Xaa is any aa, unknown, or other
MRQLHLSPQLSPSPVLSSYFSPPPAEASSWRRRLHRGRAFQPPLSSLRDPNKATLRKASSNVPFRLGGGRERQPQGPPPRRRRXGGGRSXRRGRRRGTHGDAGRRSATGGXXXGVWGRXDTCTRTRSHPSSRSF

SEQ ID NO: 78197 - DNA, 773 bp, Zea mays
  misc_feature: Ceres CLONE 1563188
  misc_feature: Encodes the peptide sequence at SEQ ID NO. 78198
  misc_feature (347)..(347): n is a, c, t, g, unknown, or other
  misc_feature (348)..(348): n is a, c, t, g, unknown, or other
  misc_feature (359)..(359): n is a, c, t, g, unknown, or other
  misc_feature (360)..(360): n is a, c, t, g, unknown, or other
ctccccgcggtggcggccgctctagaactagtggatcccccgggctgcaggaattcgtctcacccctagaaaaaagcaagagcatgtgtttagacctttctgtgaaggataattctgccaaacccccacggaggcactcaatacaaaccaagccaggagctagtccaaggccaacaccttctggaactgtgactccggtgtctggggttcggtcaaagagatcggaaagccaggggaggtttgataccccgacatcagaagtgtccatgtccatctcaaggcgcaagttcagcacgctttcttcaatctcgtactggatgacacagatcaggctggcagaggctgcnnttccaagcacnntcggtttctctggggcttcttttaagcttttgctctttgaaattcagaaatgttgaaagcctttgggaaaccggaatggagggggaagaaaaactcaaagtcccttacggtagccacggggcattgggccctggccggacagaaatttggaagggacccccagttttaaggaacattttcttcccagggtttttaatgaattatttttttgggaatgaaattttttgaaaaaaaaaccttggaaaaaaaattccccctggggcaaaaaaaaacccccccccccccaaagggggggcaaaccccccccaaaaaaaaaaaaaaattttctgaaacaaaaaaagagggggggggccccccggtaaaaattggcggcccccaaaaaaaaggtggggggggttcaaccaccacaaaaa

SEQ ID NO: 78198 - protein, 110 aa, Zea mays
  misc_feature: Ceres CLONE 1563188
  misc_feature (89)..(89): Xaa is any aa, unknown, or other
  misc_feature (93)..(93): Xaa is any aa, unknown, or other
MCLDLSVKDNSAKPPRRHSIQTKPGASPRPTPSGTVTPVSGVRSKRSESQGRFDTPTSEVSMSISRRKFSTLSSISYWMTQIRLAEAAXPSTXGFSGASFKLLLFEIQKC

SEQ ID NO: 78199 - DNA, 789 bp, Zea mays
  misc_feature: Ceres CLONE 1563189
  misc_feature: Encodes the peptide sequence at SEQ ID NO. 78200
  misc_feature (621)..(621): n is a, c, t, g, unknown, or other
ctggagctcaccgcggtggcggccgctctagaactagtggatcccccgggctgcaggaattcgtctcacccctagaaaaaaccttccccgctctcctccctccgctcgcctccgcttccgttccgcgccctgcccccggaaggcaagcaaagccctcgctacttgcggagcgtcgttggtcaaaccctagcacacgtacgagcaggccagccccgcccgctcccattcccaggccctcatccatggcggcgctctccgtgcccctccacgccgccgccggatcccgcgccgccgcggccgaccccgtcaaggttccgtgcgtgaggagcactggttcagcccatttcggccgcgccttcccctccgtcgcggtctcctctttggctgcgaggcacatcgagccgatgagagcgatagctacacaggcgccccctgccgtgccacaatatttgagtggcgagaagacaaagatcggcatcaacggctttgggcggattggcaggttggtcctgcgaattgcaactagcagagacgatattgaagttgtggctgtgaatgaccctttcgttgatgctaagtacatggcctatatgttcaagtatgactctactcatggcccgntttaaggttctatttgtgttgtggatgattcaaccctggagatcaatgggaagaaggtcacaattacaagcaaaagagatcctgccagagattccatggggtaactttgggggctgaaaaatgttggtgaaatcctcctgggtgtcttttccaacgacggataaaacc

SEQ ID NO: 78200 - protein, 126 aa, Zea mays
  misc_feature: Ceres CLONE 1563189
  misc_feature (75)..(128): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGP

SEQ ID NO: 78201 - DNA, 824 bp, Zea mays
  misc_feature: Ceres CLONE 1563191
  misc_feature: Encodes the peptide sequence at SEQ ID NO. 78202
ctccccgcggtggcggccgctctagaactagtggatcccccgggctgcaggaattcgtctcacccctagaaaaaaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtctatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgaccctgagaccttcgcgcgcaaccgggagctagaggtgatccactcccagtgggcgatgctgggggcgctgggctgcgtgttcacggagatcctggctaagaacggcgtcaagttcggctaggcggtgtggctcaaggacggcgcgcagatcttctcggagggcgggctggactacctggggaacccacacctggtgcacgcgcagagcatcctggccatctaggcggtgcacgtggtgctcatgggcttcctcgagggctaccgcggcggcggccgcccgctcggggaaggcttccacaaggtgtacaccgggcgcgccttcgaaccggtgggcctctccgactacccggacacggcgaccaaggtaaagtgaaagagctcaaaacggccgccttgcctgtgtccccatggttcgggttcttcctgcag

SEQ ID NO: 78202 - protein, 121 aa, Zea mays
  misc_feature: Ceres CLONE 1563191
  misc_feature (59)..(122): Pfam Name: Chloroa_b-bind Pfam Description: Chlorophyll A-B binding protein
  misc_feature: SWISSPROT Homolog: EC 2.7.11.1 Non-specific serine/threonine protein kinase
MAASALHQTTSFLGQALVARAAGVYAGGRITMRRTVKSVPQSIWYGPDRPKYLGPFSEQTPSYLTGEFPGDYGWDTAGLSADPETFARNRELEVIHSQWAMLGALGCVFTEILAKNGVKFG

SEQ ID NO: 78203 - DNA, 873 bp, Zea mays
  misc_feature: Ceres CLONE 1563193
  misc_feature: Encodes the peptide sequence at SEQ ID NO. 78204
  misc_feature (410)..(410): n is a, c, t, g, unknown, or other
tggagctccccgcggtggcggccgctctagaactagtggatcccccgggctgcaggaattcgtctcacccctagaaaaagctctccttcgttctgtttgttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactcctacaataatgatggagagaagagcaatgttccttcattaaagaaccttcctccaattgttcatcatgaaacattcttcagcaatgttcagaatgactacaatcaaacaggattagtgcctnttggagggatgttctgccagtgaggcttcacagcttctcagtgatcgctggactgctgcaatcaacatgtacaatgaccaaacaattgacccctcaggtgaatcaacagtactctaaactctacatttctccatggttatcggctggctcttcaatgttaaatctggcagtgaggaaaaaatttggaccttagtacttactagtgactttcatgtatattattacatgcaatgacgacttcaaagttgacattatatttcttgtactttgctccgacctaattgtagcagctgttaagaattgagaatttcatacttgggtaagagggtttttgtgcatatactctggctgcaactcataaaaactaattatgttcatattggcgcaaaaagctagtgaaagccgggagtggtaagtataaaaaaatccaaggctttgccactgcacatttaaaccacagtag

SEQ ID NO: 78204 - protein, 81 aa, Zea mays
  misc_feature: Ceres CLONE 1563193
  misc_feature (75)..(75): Xaa is any aa, unknown, or other
MSSSGPLPAGTHQTRNRAGNRRKSGDRADKANYSYNNDGEKSNVPSLKNLPPIVHHETFFSNVQNDYNQTGLVPXGGMFCQ

SEQ ID NO: 78205 - DNA, 831 bp, Zea mays
  misc_feature: Ceres CLONE 1563195
  misc_feature: Encodes the peptide sequence at SEQ ID NO. 78206
ctggagctccccgcggtggcggccgctctagaactagtggatcccccgggctgcaggaattcgtctcacccctagaaaaatgctttcgtagaggtgggttggcttctcctccccctccggttcgggttcgggttcgtgaggttgtccggggttcgggttcgtgggtgagcggatcgagatggcggcgtctgatgttgagtaccgctgcttcgtcggcggcctcgcctgggccacggacgaccactccctccacgacgccttcagcacctacggcgaggtcctcgagtccaagatcatcctcgatcgggagacgcataggtcccgcggcttcggcttcgtcaccttctccactgaggaggcgatgcggaacgccatctagggcatgaacggcaaggagctggacggccgcaacatcaccgtcaacgaggcccagtcccgcagctgccgtggatgctgcagcggtgggtacggtggtggccgtggatgcggcggctaccgcggtggcgggcgccatgatggctgtggctgctactgccgtggcggccgctaccgtggccgccgccgctaccgtggtggtggcggctgctacagcggtggcaaccgtggcggcggctacagcatctcccatcggaactgtaggaactgagctgtgggcccgccactgccaaattatcctgttcgcatacgataatgatgagccataggcaagatgggttacctgcctctactgtcgtcgtgtgcttgttcacccccttgtcgtctttgattagcgatgaccctcatcgaatcaagctgtgaggtgcctgcctttcattcccccggtctcaacct

SEQ ID NO: 78206 - protein, 66 aa, Zea mays
  misc_feature: Ceres CLONE 1563195
  misc_feature (10)..(67): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHDAFSTYGEVLESKIILDRETHRSRGFGFVTFSTEEAMRNAI

SEQ ID NO: 78207 - DNA, 754 bp, Zea mays
  misc_feature: Ceres CLONE 1563198
  misc_feature: Encodes the peptide sequence at SEQ ID NO. 78208
agctccccgcggtggcggccgctctagaactagtggatcccccgggctgcaggaattcgtctcacccctagaaaaaaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaggcgggttaccgacatatcgattgtgccagagtttacggcaacgaaaaggagattggtttggcgctgaagaactatttgaagagggtgtagtgaagcgagaagatctgtttatcacctctaagctatggaatgatcatcatgctccctgaagatgtgcctgaggcactaaatgacagcctgaatgatttgcagcttgagtacctggatctttatcttatccattggccatttagagtcaagaagggaacaaataccagccctggaaatttttgttacacctgacttccctgctactttggggggcaatggaaaagttatatgatgctggcaaactcgcgctattggtgtgaagtacttctcctcaaagaaattgggtgacttgcttgctgtaactcgtgtacctccagctgttgatcagtgggatgggcatcccgggtggcagcaaactaagctccatacttttgtcagtcaacctggggttcatctaactgc

SEQ ID NO: 78208 - protein, 50 aa, Zea mays
  misc_feature: Ceres CLONE 1563198
  misc_feature: SWISSPROT Homolog: EC 1.1.1.2 Alcohol dehydrogenase (NADP(+))
MIIMLPEDVPEALNDSLNDLQLEYLDLYLIHWPFRVKKGTNTSPGNFCYT

SEQ ID NO: 78209 - DNA, 863 bp, Zea mays
  misc_feature: Ceres CLONE 1563199
  misc_feature: Encodes the peptide sequence at SEQ ID NO. 78210
  misc_feature (684)..(684): n is a, c, t, g, unknown, or other
ctggagctccccgcggtggcggccgctctagaactagtggatcccccgggctgcaggaattcgtctcacccctagaaaaaattttaaagcaggacagtttgccatcatcatataaatcatttctaaacaagcatggtggaaaagatcttactattttgcaaggtgtgaaggatgtagtcaaccacactgctttcagtaacttagcgggtatcgagaagtactacaaatctgttggtgttgacataaagctagatccaaacatgaaagtgccttgctcaattgtgcatggtaaccagtcatgtacaggacatgtcttttcattcttgttacaagcatatggaagagcagttcctgtatatgttccagtctacttagtccctgcacttgtagttcataggcagcatctcatgaaaagggcttggacctgcctgctttttaggatcttccggagagccaatacccctcttgtcatccttggcacgtttccaacaggcctggctttgcttatcgagaagaagagcaggaggattgagatatccctgtactgtcttgccagagctatcgagagttttttcacatggatgaccgatgcaggactctgccctccaatactgcagataaagcgagctgaatgtggttgtgttcagcatagctacctctatcattatgcactgctatgcgcangaaagagaagtcttcccggtcaaggtacctgaatgtgctggactggggtattttggtgtgccgccacccaccgacagtgaggataagaattgctatctaccaatgaagccaagaattccagtgacatacgggcttgtagaagtcaattggcgtgatttttgtatggtccactcatgtgt

SEQ ID NO: 78210 - protein, 237 aa, Zea mays
  misc_feature: Ceres CLONE 1563199
  misc_feature (228)..(228): Xaa is any aa, unknown, or other
GAPRGGGRSRTSGSPGLQEFVSPLEKILKQDSLPSSYKSFLNKHGGKDLTILQGVKDVVNHTAFSNLAGIEKYYKSVGVDIKLDPNMKVPCSIVHGNQSCTGHVFSFLLQAYGRAVPVYVPVYLVPALVVHRQHLMKRAWTCLLFRIFRRANTPLVILGTFPTGLALLIEKKSRRIEISLYCLARAIESFFTWMTDAGLCPPILQIKRAECGCVQHSYLYHYALLCAXKRSLPGQGT

SEQ ID NO: 78211 - DNA, 736 bp, Zea mays
  misc_feature: Ceres CLONE 1563202
  misc_feature: Encodes the peptide sequence at SEQ ID NO. 78212
gtgctccccgcggtggcggccgctctagaactagtggatcccccgggctgcaggaattcgtctcacccctagaaaaaaatccataggcagcaatgtggatgactctgaagtcattgaaatcgttgggaaaaatccatttctgtggcctgaccactggccagtcaaagactatgccaaaatcttcgattgccttgtcttagttcctgagatagaaaccgaagtggtcaaggtgatatccaagattagagaggcaggccaaagagcaagacatgaagctgggggttctcatagtaagcagaggagagatagctcaacgaatccgcctgtaccgtatgttgctgttcacatgagaatagaaaaagattggatgatacattgcaagaagtgggagcagcggtccaagtcacatgaaatctgcagtagtaaagaagagatcattcataaggtctcacagatcactgacctacgtcggccggttgttgtttatcttgcggtagctgacagcccttcttgaagacgattcaataaaccattggggggaaaaagggggggtatatgggtttgccttaccaaaaaaaaaaaaaaaacttggggggttttcccgaaaaatttttaaaaaatggtgggcgccccattatttttttttttaaaaaaaaaaaggggggggccccccccaaaaaattttttaaggggagggggggggcccccccaaaaaaaaaaaaaacaaaaaattttt

SEQ ID NO: 78212 - protein, 55 aa, Zea mays
  misc_feature: Ceres CLONE 1563202
MRIEKDWMIHCKKWEQRSKSHEICSSKEEIIHKVSQITDLRRPVVVYLAVADSPS

SEQ ID NO: 78213 - DNA, 828 bp, Zea mays
  misc_feature: Ceres CLONE 1563203
  misc_feature: Encodes the peptide sequence at SEQ ID NO. 78214
ctccccgcggtggcggccgctctagaactagtggatcccccgggctgcaggaattcgtctcacccctagaaaaactcgttcttccagcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtgaagggcgtcgttagccccgtctacgaccgcttcggcggcctgcctctcgacgtcatcaccttcgtcgaccgcaaggtggacgacacggtgcacgaggtggacaagcacctcccgggcgcgctgaaggcagcgtctgcgcatgtctactcggtggttctgagcgtgcctgaagtggcgcgccatctggcggccgaggcgcagctgtcgagcgtgaggggcgcagcccgtgaggcgctcgctattactgaacctgtggccctagacgtgtacggacgcgtggagcccgtgacaaaggacctctacgtgcggtactagcctgccgccggagcacctggcacgtctcgcctgacactctctgaaggggcctgacggtggtcccgcaccttgtcggaa

SEQ ID NO: 78214 - protein, 177 aa, Zea mays
  misc_feature: Ceres CLONE 1563203
  misc_feature (19)..(173): Pfam Name: REF Pfam Description: Rubber elongation factor protein (REF)
MAEEQSNPQHQQAEEREVMVEQQQPRRAPKLRYLDFVQVAAAQAAVCLAGLYGLAKDHAGPLRPSVDAVESAVKGVVSPVYDRFGGLPLDVITFVDRKVDDTVHEVDKHLPGALKAASAHVYSVVLSVPEVARHLAAEAQLSSVRGAAREALAITEPVALDVYGRVEPVTKDLYVRY

SEQ ID NO: 78215 - DNA, 832 bp, Zea mays
  misc_feature: Ceres CLONE 1563205
  misc_feature: Encodes the peptide sequence at SEQ ID NO. 78216
  misc_feature (606)..(606): n is a, c, t, g, unknown, or other
  misc_feature (753)..(753): n is a, c, t, g, unknown, or other
ctccccgcggtggcggccgctctagaactagtggatcccccgggctgcaggaattcgtctcacccctagaaaaaggccaaaccagcacccgccgccgacagggaacatcgccggccgagatcggctgcacatctgtgctgcttcagggcgccggagttcgcgtcgtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctcccccaggggcgtatcctcctcctccaggggcatatcctcctccacctggggcatacccaccacaatatgggtaccctcagccaggtggctacccacctcaaggtggatatcctcctgcaggctaccccggctcatctcaccagggttatgggagcagccacggcgggggccacgggggccacatggggacgggggcaatgctagcaggaggtgctgccgcggccgctgccgcttatggagcacacaagctttctcatggccatagcggacacngtggacatggggcctttggagctatggtcacggtggtaccgcccacgggtatggtgcccacgcaagttcagcatggtacggccaccacgcaaagtcaagcacgggcacgcaagttcagcatggcagcacggccccgcatgtttggcngcgcaagtcaagaatggaagtgatgtgccctcctggttgatcctactgaaccagctttccagaaatgtgttgccgtaat

SEQ ID NO: 78216 - protein, 195 aa, Zea mays
  misc_feature: Ceres CLONE 1563205
  misc_feature (140)..(140): Xaa is any aa, unknown, or other
  misc_feature (189)..(189): Xaa is any aa, unknown, or other
MGGGKDKHDESDKGLFSNMMHGVAGGHGYPHQGYPPQGYPPQPGAYPPPPGAYPPPPGAYPPPPGAYPPQYGYPQPGGYPPQGGYPPAGYPGSSHQGYGSSHGGGHGGHMGTGAMLAGGAAAAAAAYGAHKLSHGHSGHXGHGAFGAMVTVVPPTGMVPTQVQHGTATTQSQARARKFSMAARPRMFGXASQEWK

SEQ ID NO: 78217 - DNA, 777 bp, Zea mays
  misc_feature: Ceres CLONE 1563208
  misc_feature: Encodes the peptide sequence at SEQ ID NO. 78218
ctccccgcggtggcggccgctctagactagtggatcccccgggctgcaggaattcgtctcacccctagaaaaaacccgaagcacatcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaagaagttgagaaagtggctgccgctttgccagaaggtggagttctgctcctagagaatgttagattctacaaggaggaagagaagaacgaccctgagtttgctaagaagctagcatctgttgctggactttatgtcaatgatgcttttggcacggcacacagagctcatgcttcaacccgaggagttacaaagtatttgaaagcctgctggttgccggcttcctcatgcagaaagaaacttactaccttgttgggagctgttgccaacccaaaagaagcccttttgccgctttttggttggggggatcccag

SEQ ID NO: 78218 - protein, 204 aa, Zea mays
  misc_feature: Ceres CLONE 1563208
  misc_feature (3)..(202): Pfam Name: PGK Pfam Description: Phosphoglycerate kinase
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKVAAALPEGGVLLLENVRFYKEEEKNDPEFAKKLASVAGLYVNDAFGTAHRAHASTRGVTKYLKACWLPASSCRKKLTTLLGAVANPKEALLPLFGWGDP

SEQ ID NO: 78219 - DNA, 872 bp, Zea mays
  misc_feature: Ceres CLONE 1563211
  misc_feature: Encodes the peptide sequence at SEQ ID NO. 78220
  misc_feature (670)..(670): n is a, c, t, g, unknown, or other
ggagctccccgcggtggcggccgctctagaactagtggatcccccgggctgcaggaattcgtctcacccctagaaaaatctcgaagtcgactcctattcttatcgccccgaaggcggtctccactctctacagacagccgccaccgccgccggtggttcacaagcagccggtaggtactcaacccaaaccgcaaggaggacacggaacccaaattccagcacgactcctccagccagcagcccaagcgaacctagggcccttgagctccctcccgcatggcgttcccgtggtgcctctcggctccggccgccgtcccgcctgtggcgcccgcgcccgcgcccgcgcccggcgcctttggcgtctccgcgtcggtcaccgccctagcgcgtgtgccggttctcgccggtaggcggcgcaagtggagcacgctcgtggtccgcgcggcccccgacgaggagaagattaccaagcggtcgcccctcgatttccccatcgaatgggagagaccaaagcctgggaggagacctgatatcttcccctagttcagcccaatgaagacaccattaccacatccgttaccagctgatgatccctttgggatgatgatcaagaggaaggaaagaggaagaacaacccccaccgcaggaagagccaccagaggatgatccngacaaaggaagaacctgagggagatgacccggacaagccaacccgagtaacttctgaatggctggaaactgttggtggtaaaatataggcaggggggcaaacatggggctaaatcttttggagccagccaaaaaaattcccgttttatttcgaaactggtttggtctgccgggcttaaataagccccaaaaagcccaaaatt

SEQ ID NO: 78220 - protein, 88 aa, Zea mays
  misc_feature: Ceres CLONE 1563211
MAFPWCLSAPAAVPPVAPAPAPAPGAFGVSASVTALARVPVLAGRRRKWSTLVVRAAPDEEKITKRSPLDFPIEWERPKPGRRPDIFP

SEQ ID NO: 78221 - DNA, 769 bp, Zea mays
  misc_feature: Ceres CLONE 1563213
  misc_feature: Encodes the peptide sequence at SEQ ID NO. 78222
ctcaccgcggtggcggccgctctagaactagtggatcccccgggctgcaggaattcgtctcacccctagaaaaagcgttgtgcgtcttttcctcagcagcaaccggagagcggctgctcgcctgctcctcctcctagggaaaggacagcggcggcggcggcggcgagaagttgggcctgaagcccggactctttctcccgagatacggcaatactgctagagcactgtcactaatgtttgcttatgacaatggagtcacctacaactgccgctggtggtgaactggagagctacttctccttgggtttgacagtatcccactcacagaaagataatgctgaatttccaaaggttctgttgcttctctcagcgtatcttgacaagacagttcagcagaatgaagagttactagactccagtaaaataaaggagtcgaccactatctttcatggtcagagggtgcctgaacttagtataaagctgtatgcagagcgtattttcaagtatgcaaagtgcagcccatcttgctttgtgctagcacttatctacatggagagatatctacaacaaccaaacatttacatgacgtcatttagtgttcatcgcctgcttattacaagtgttggtgttgctgcaaattcatagatgatgcgtttttcataatggatactacgggagagttggaggaatagcacaagagagatgatatgcttgaactggaattttttgtcggtcggacttcaggctcaagtggatatagagctttcga

SEQ ID NO: 78222 - protein, 131 aa, Zea mays
  misc_feature: Ceres CLONE 1563213
  misc_feature (33)..(132): Pfam Name: Cyclin Pfam Description: Cyclin
MESPTTAAGGELESYFSLGLTVSHSQKDNAEFPKVLLLLSAYLDKTVQQNEELLDSSKIKESTTIFHGQRVPELSIKLYAERIFKYAKCSPSCFVLALIYMERYLQQPNIYMTSFSVHRLLITSVGVAANS

SEQ ID NO: 78223 - DNA, 790 bp, Zea mays
  misc_feature: Ceres CLONE 1563214
  misc_feature: Encodes the peptide sequence at SEQ ID NO. 78224
  misc_feature (553)..(553): n is a, c, t, g, unknown, or other
  misc_feature (682)..(682): n is a, c, t, g, unknown, or other
  misc_feature (717)..(717): n is a, c, t, g, unknown, or other
  misc_feature (728)..(728): n is a, c, t, g, unknown, or other
  misc_feature (730)..(730): n is a, c, t, g, unknown, or other
ctccccgcggtggcggccgctctagaactagtggatcccccgggctgcaggaattcgtctcacccctagaaaaacaacccgggcgccggcttcaccggcgggacgcgcgtcggcgtgtacctcgacacgcaggaggaggagcacgcgcgcgtcaagaccttcgccatggacctcctccaccgctccgcccgcacctggtccgccgacttccgcgcgagcgtcggcgccatgctggacgccgtggacgcggagttcggcaaggacgacggcagcgacaagaagccctccgccagctacctcgtccccctgcagcagtgcatcttccggttcctctgcaaggcgttcgtgggcgccgacccgtccgccgactggctggtggacaacttcggcttcaccatcctggacatctggctggcgctgcagatcctgcccacgcagaagatcggcctcgtccagccgctggaggagctgctcatccactcgttcccgctgccctccttcctcatctggccgggctactacgtgctgtaccgcttcatcgagaagcacggcngccgaggccgtggcctacgccgatgcgcagcacggcatcggcaagaaagacgccatcaacaacattgctggttcgtgctcggcttcaacgccttcggcggctttctccgtgttcctggcccttcctcgntggccaaaggtcggcgggccgcccccggcgctgcncaagcagctgncngggacaagggtgcggccgcggccatggtggggcaaaagacaggccaagttccggggttcc

SEQ ID NO: 78224 - protein, 208 aa, Zea mays
  misc_feature: Ceres CLONE 1563214
  misc_feature: SWISSPROT Homolog: EC 4.2.1.92 Hydroperoxide dehydratase
  misc_feature (130)..(130): Xaa is any aa, unknown, or other
  misc_feature (173)..(173): Xaa is any aa, unknown, or other
  misc_feature (188)..(188): Xaa is any aa, unknown, or other
  misc_feature (189)..(189): Xaa is any aa, unknown, or other
MDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGXRGRGLRRCAARHRQERRHQQHCWFVLGFNAFGGFLRVPGPSSXAKGRRAAPGAAQAAXXDKGAAAAMVGQKTGQVPGF

SEQ ID NO: 78225 - DNA, 813 bp, Zea mays
  misc_feature: Ceres CLONE 1563215
  misc_feature: Encodes the peptide sequence at SEQ ID NO. 78226
  misc_feature (755)..(755): n is a, c, t, g, unknown, or other
  misc_feature (764)..(764): n is a, c, t, g, unknown, or other
ctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaccccaacctgggtgacgcgcagagcatcctggcgtgctcggctccaggtcatctcatggggctcgtcgagggcttcgcatcacggcctcgacggcgtcggcgagggcaacacctctaccccggcggcagtactcgacccgntgggctcgncgacgaccccgtcacttcgccgagtcagggcaagagatcagacggcccc

SEQ ID NO: 78226 - protein, 219 aa, Zea mays
  misc_feature: Ceres CLONE 1563215
  misc_feature (69)..(217): Pfam Name: Chloroa_b-bind Pfam Description: Chlorophyll A-B binding protein
  misc_feature (201)..(201): Xaa is any aa, unknown, or other
  misc_feature (204)..(204): Xaa is any aa, unknown, or other
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGTPTWVTRRASWRARLQVISWGSSRASHHGLDGVGEGNTSTPAAVLDPXGSXTTPSLRRVRARDQTA

SEQ ID NO: 78227 - DNA, 713 bp, Zea mays
  misc_feature: Ceres CLONE 1563216
  misc_feature: Encodes the peptide sequence at SEQ ID NO. 78228
  misc_feature (185)..(185): n is a, c, t, g, unknown, or other
ctggagctccccgcggtggcggccgctctagaactagtggatcccccgggctgcaggaattcgtctccccctagaaaaaatcccattccataccattccgccaaagaagaaccacagacgctcgctcccaactcccaagccaagccggatcccaaaatcggcacagcgcacccactccgctcagntcccttcgttcaccccatccatccagcccagccagccagccatggggcgcaaggactgcgcacacgcgaagacaactgcgcgtcgtgccgcgctgctacgatcctctagtcctgccctgatcgtgggcttgatcccctgatctctacctgggggtcgccccaagaacggggttttaactgaggaaaggttcttgaaaaaattaaacttttcaaaggcccaaaaaaaaaaaaaaatttgggggttcctttttccccctttctcccaaaaactccagggggaaactggggcccccccaaaaccccaaaaaaagagggggggggggtgtataaaaacccgggggggaggtttttcccccccttaaaaaaaaccccacaatgaaaaaagggggggccccgttgctcccccccccttttttataaggccgccccaaaaataaaaaatgtggttggcggcccccttttttttctacccgccccggggggccccttttttggcgcgcccctttggaggaaagagggggggcgggg

SEQ ID NO: 78228 - protein, 32 aa, Zea mays
  misc_feature: Ceres CLONE 1563216
MGRKDCAHAKTTARRAALLRSSSPALIVGLIP

SEQ ID NO: 78229 - DNA, 808 bp, Zea mays
  misc_feature: Ceres CLONE 1563218
  misc_feature: Encodes the peptide sequence at SEQ ID NO. 78230
ctccccgcggtggcggccgctctagaactagtggatcccccgggctgcaggaattcgtctcacccctagaaaaagagaaggggatctagcgcgtcccgatgctctgctttcttttatgatggcgtggtccacgccgtttgcctcccccttccatttgtctcttgcccgtactacgggacgatgaccctgctttggttaatgctggattgcttctatccccccctcaccctcttccaatttgatcctcctcggctccatcttgcgcccccccatttcgctgcgactactaaagagctcaggatcttccctgagcacttcgggctcggccagtggactaccaccacagattcaaaggagagtccgacgctgctgaccatcgacgacgagagccgccaccagccgcggacaagggaacaacctgcccataccccaccgactccttcgaacgtggaggacctccggaacactcacaaaatgctccaggtgctaggtggaaaagtccgcagaaggaaattactgtcacctaaagataggaatgtccgtccaatgatggaagttgtccgaggagcagcctttgacattttacagtcagctggtggttctcctgcttcactcagaccgggtcggtggctagacttgtatagtggtactggatccgttggaatgaagctatgagcccgagatgttcagaggccatttcgttgagatggatccttgggtcatctctgaaggctcaaccaaatcctgagtgtactggattattgacgtgtccccatacttatgctccgcgttgaaaattcttggcaat

SEQ ID NO: 78230 - protein, 164 aa, Zea mays
  misc_feature: Ceres CLONE 1563218
MTLLWLMLDCFYPPLTLFQFDPPRLHLAPPHFAATTKELRIFPEHFGLGQWTTTTDSKESPTLLTIDDESRHQPRTREQPAHTPPTPSNVEDLRNTHKMLQVLGGKVRRRKLLSPKDRNVRPMMEVVRGAAFDILQSAGGSPASLRPGRWLDLYSGTGSVGMKL

SEQ ID NO: 78231 - DNA, 777 bp, Zea mays
  misc_feature: Ceres CLONE 1563219
  misc_feature: Encodes the peptide sequence at SEQ ID NO. 78232
  misc_feature (665)..(665): n is a, c, t, g, unknown, or other
  misc_feature (699)..(699): n is a, c, t, g, unknown, or other
ctcaccgcggtggcggccgctctagaactagtggatcccccgggctgcaggaattcgtctcacccctagaaaaatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttggttgttggtgtcaatgaggacaaagtacacctcggatgttaacatttgtttccaatgctagctgcaccacaaactgcccttgctcccctttgctaaagtcattcatgacaactttcngcatttggtggaagagtttgatgaacaactggtncatgcccatcactgccaccccagaatactgtttgacggaccctccagcccaaggaactgggagaagtgggcaggggct

SEQ ID NO: 78232 - protein, 138 aa, Zea mays; identical to SEQ ID NO: 78053
  misc_feature: Ceres CLONE 1563219
  misc_feature (4)..(135): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)

SEQ ID NO: 78233 - DNA, 839 bp, Zea mays
  misc_feature: Ceres CLONE 1563220
  misc_feature: Encodes the peptide sequence at SEQ ID NO. 78234
  misc_feature (722)..(722): n is a, c, t, g, unknown, or other
  misc_feature (740)..(740): n is a, c, t, g, unknown, or other
  misc_feature (744)..(744): n is a, c, t, g, unknown, or other
  misc_feature (795)..(795): n is a, c, t, g, unknown, or other
  misc_feature (796)..(796): n is a, c, t, g, unknown, or other
ctggagctccccgcggtggcggccgctctagaactagtggatcccccgggctgcaggaattcgtctcacccctagaaaaaacgcaggcaccccagcagctcttgcggtcgtccctcagccgcgtcgcaccgcatcgcattctacgattcgaagctctctgctcgcaggggaccatggcgaagaactacccaaccgtgagcgccgagtacagcgtggccgtcgagaaggccaggcgcaagctccgcgccctcatcgccgagaagagctgcgcacccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgacttctaccagcttgccggagttgtggccgtcgaggtcaccggtgggcctgagatccccttccacccaggcagggaggacaagcctcagccgccacctgagggccgtcttcctgatgccaccaagggttctgaccacctgaggcaagtctttggcaagcagatgggttttgagtgatcaggacatcgttgcccctctctgggtggcacacctttgggaaggtgccacaaagagcgggtctggtttttgaggggtgcctggactacnaaaccctttgggtctttngacnactctttactccagggaacctccggagtggtgaacaagggagggcccttcnnttcagctcccaagtgaacaaagccctggctgaaccgaccctgt

SEQ ID NO: 78234 - protein, 152 aa, Zea mays
  misc_feature: Ceres CLONE 1563220
  misc_feature (19)..(153): Pfam Name: peroxidase Pfam Description: Peroxidase
  misc_feature: SWISSPROT Homolog: EC 1.11.1.11 L-ascorbate peroxidase
MAKNYPTVSAEYSVAVEKARRKLRALIAEKSCAPLMLRLAWHSAGTFDVSSRTGGPFGTMKCPAELAHGANAGLDIAVRLLEPIKEEFPTLSYADFYQLAGVVAVEVTGGPEIPFHPGREDKPQPPPEGRLPDATKGSDHLRQVFGKQMGFE

SEQ ID NO: 78235 - DNA, 793 bp, Zea mays
  misc_feature: Ceres CLONE 1563221
  misc_feature: Encodes the peptide sequence at SEQ ID NO. 78236
  misc_feature (292)..(292): n is a, c, t, g, unknown, or other
  misc_feature (522)..(522): n is a, c, t, g, unknown, or other
  misc_feature (586)..(586): n is a, c, t, g, unknown, or other
ggagctcaccgcggtggcggccgctctagaatagtggatcccccgggctgcaggaattcgtctcacccctagaaaaaaccactcccagtcccagtctcccaccgtcccacgaaacacactcaactctgccccgaagcggagaaccgccagccagacatgaagagaaccagagcgcagcagcccaaggtcgaggagccgcaggacctcgccgccaacctaaagccgcagcgccgggacaaacagccgaggcagcccaagtcaggcgccaaagcgaagcccgcggcgggcccgnctgcgtcgcggcggccacgaccctcgccgccgccgccgccgcagcagcagcagcagcaaatgccgcctcggccgcgtcgtcgcccgggccggaaacggctccgaccgtgccggacgtgtgcgtcggcggggacaaggacggggacgcggacgcggacgcgagcgccgtggactgggacctcgacgccgggctgagcgcggcggcgtggtggacgtggggcgtggacgaangagagctgctcggctggttccccttcgtggaagaggacttccggtgcgccggcggcggcgcccnccgaagtggccggccttcgaccacgacatttggagcatctggggaacgaaccttttgagaagacagacaaccgagcccggtggcgatgccttcttttccctggtctttgctctgccctgcccccagggggttgggaaggtagtggccttggggtacagtggaccggggggaatgcggggcgggaggaattttttaaggccaagggtt

SEQ ID NO: 78236 - protein, 109 aa, Zea mays
  misc_feature: Ceres CLONE 1563221
  misc_feature (46)..(46): Xaa is any aa, unknown, or other
MKRTRAQQPKVEEPQDLAANLKPQRRDKQPRQPKSGAKAKPAAGPXASRRPRPSPPPPPQQQQQQMPPRPRRRPGRKRLRPCRTCASAGTRTGTRTRTRAPWTGTSTPG

SEQ ID NO: 78237 - DNA, 806 bp, Zea mays
  misc_feature: Ceres CLONE 1563224
  misc_feature: Encodes the peptide sequence at SEQ ID NO. 78238
  misc_feature (744)..(744): n is a, c, t, g, unknown, or other
  misc_feature (760)..(760): n is a, c, t, g, unknown, or other
ctccccgcggtggcggccgctctagaactagtggatcccccgggctgcaggaattcgtctcacccctagaaaaaacaccagcgcagcgagctctctcctcgtagcggagtcccagcccctcacgccctcccgatcgcgctcgtcggcgccctgtcgactcgagcccgcttctgggccgatcgacagcgagagcgagagcgagcgcagcggcgcgccgaggagagctctttcggtgctgtataacgacgacgacagcaggcggcagataacacataaaggcgcgcgatgtgcgacgcggcggccgtggcggctccgcggtacaggggcgtgcggaagcggccgtggggccggttcgcggcggagatccgggacccggcgaagcgcgcgcgcgtctggctcggcaccttcgactccgctgaggccgcggcgcgcgcctacgacgtggccgcgcgggccctgcgcggcccgctcgccaggaccaacttccccgcgctcacctcccgccctcctgccaacgcgcccgcgcccgcgcccacgtgcagctcaagctccaccgtcgagtcctccagcgggccccgcgccggggtgcccagtgcgggcaggcgcgctgctgggaagccgcgtgccccgcggcaggcggccgcgcccgccgacgccgactgccgtagcgactgcgcctcgtcggccctccgtcgtgtacgacggcgacgacgcctcccccgttcggtccgcgcccggcgttcngacctcaatctcccgnggccgctcgaacgtcaacaagggtcatggactcgagctttgcacgg

SEQ ID NO: 78238 - protein, 173 aa, Zea mays
  misc_feature: Ceres CLONE 1563224
  misc_feature (10)..(61): Pfam Name: AP2 Pfam Description: AP2 domain
  misc_feature (159)..(159): Xaa is any aa, unknown, or other
MCDAAAVAAPRYRGVRKRPWGRFAAEIRDPAKRARVWLGTFDSAEAAARAYDVAARALRGPLARTNFPALTSRPPANAPAPAPTCSSSSTVESSSGPRAGVPSAGRRAAGKPRAPRQAAAPADADCRSDCASSALRRVRRRRRLPRSVRARRSDLNLPXPLERQQGSWTRALH

SEQ ID NO: 78239 - DNA, 799 bp, Zea mays
  misc_feature: Ceres CLONE 1563229
  misc_feature: Translation starting site: 83
  misc_feature (663)..(663): n is a, c, t, g, unknown, or other
ctggagctcaccgcggtggcggccgctctagaactagtggatcccccgggctgcaggaattcgtctcacccctagaaaaaatatggctgaacccaagtcaaataatggcggggcggacgcgacggcatcgatgatgctccacggccgcgtagccattgtcaccggtggtgccggcggcatcggctcggccgtgtcgaagcacctgtcgtcgctcggcgcgcgcgtcgtggtggggtacatcggcgacccggcacctgctctgacgctggtagccgccatcaactcctccgagcaccccggcgagagccagcagccgcgagccatcgcggtcgaggcggacgtgtccgacgcggcagccgtgaaggcgctgttcgacgcggccgccgcagccttcggcggggagctccacatcctggtaacgttggcggcggtgctggactactcctacccgccgctggcggagaccagcgaggcgacgttcgacgccgccttcagcgtcaacacacggggcaccttcctgtgctgccgcgaggcggccaggcgggctggtgcgtgacggccgcggccgaatcgtgacgttctcttcgtcggggagttgggtctctgcgccctggctactcggcatacgcagcaagcaagccgccggtggaagtgatgactaanatcctggcgcgcgagctgccgggcacggggatcacgggccaacgttggtggccgccggggtccacggggacaccccatgatgtacaccggccaagaccgaagatgacagggagcgatacatcgcccgtagcgccgc

SEQ ID NO: 78240 - DNA, 803 bp, Zea mays
  misc_feature: Ceres CLONE 1563231
  misc_feature: Encodes the peptide sequence at SEQ ID NO. 78241
ggagctccccgcggtggcggccgctctagaactagtggatcccccgggctgcaggaattcgtctcacccctagaaaaaattgacaagcagcaagtggaagtgggcatggctatgggtgctgcggcggccgcatccacctgcaccaggcccgcgtcccctggcctggcccgacgtcgcgtcagggcgcaggcgacgtcgtcgtgggccggaggcgccgaggcgctggtgcggtcgggcgcggtgagggccgtgcggccgagggacgctgcggaggcgctgggcggcgaggggttccgcctgctggacgtccggccggagtgggagcgcgcccgcgccagcgtgcggggctcggtgcacgtgccgctgttcgtgggggacgacgacatgggccccgtgacgctgctgaagaagtgggtccacttgggctacatcgggctctggaccggccaggccttcaccaagatgaacgagcgctgtcgtcgacgacgtcgcccgccgccgtcgacggcagcaaggacgccaagcttctcgtcgcttgtggcgaaagcctcaggtcgttgatcgccggtgaggatgctgcaccgacgacgggtacagggacctggcgtggctccgccgggcgggtcagcaagtgcgcggacgcatttttccccaaattgggggggggggggaaaaacaaagctgcaaataccccaccctttggggggggcgcgtccctacatctttcctcccagatcccgctggttttctggggaaagggggggaaatgaacccccctcccaaaaacaaagtgtgggttaata

SEQ ID NO: 78241 - protein, 151 aa, Zea mays
  misc_feature: Ceres CLONE 1563231
MAMGAAAAASTCTRPASPGLARRRVRAQATSSWAGGAEALVRSGAVRAVRPRDAAEALGGEGFRLLDVRPEWERARASVRGSVHVPLFVGDDDMGPVTLLKKWVHLGYIGLWTGQAFTKMNERCRRRRRPPPSTAARTPSFSSLVAKASGR

SEQ ID NO: 78242 - DNA, 940 bp, Zea mays
  misc_feature: Ceres CLONE 1563234
  misc_feature: Encodes the peptide sequence at SEQ ID NO. 78243
  misc_feature (354)..(354): n is a, c, t, g, unknown, or other
tggagctccccgcggtggcggccgctctagaactagtggatcccccgggctgcaggaattcgtctcacccctagaaaaaagtttgccgctctgtgagcctgctgccgtcttcttccgccgccgccgccgtcgtcgtcttcgtccgtagatcagagagcggggaggaagaaaaagcgatcgatggcgtccaactacgtggacacgccgggcgaggagggacggttccacggccctcacagccacagcaccagcacgaccccgacgggcggcgcggcggcggcggcggcatcgccgcgcaacttccggcgcagcttctcctccgcgtcctccgcgggccacaccactgcggctgcntgccgaagaaggaggacggcaggtgttctcccgcggggggggtttttcctggttaggggggtgtgaacgggtccggcctcaccccgcctttcttgagatacaccatcctcggtggacaacggtttgaaagttcttcaacacccctcctcgaacctcctttgtgctggtcctcaatttttttttttttttactggtccaagggaataaagccaagtggaaccccctctgggtgttggctttacccacccgcccccaacccttttagggttagggcataaccaacggggggcaacagagaatgggggcaaaaaccctttaaaagggggaaaacgggtttctcctttggccacacaagttttgggaaaaatggggggaaaaattttgctttgggccaaaaggggaccccttttggccccaagagggttttacccctggggccccggataaaaacggggcgaaatctttccggaaaaagggggcccccgcatttcaaaatgggattgggaattaaggggaaaaaggttttttaaaaagggtgggggcctctccttggggatccaaaaccccgggcgaaaaaatttttctt

SEQ ID NO: 78243 - protein, 79 aa, Zea mays
  misc_feature: Ceres CLONE 1563234
MASNYVDTPGEEGRFHGPHSHSTSTTPTGGAAAAAASPRNFRRSFSSASSAGHTTAAACRRRRTAGVLPRGGFFLVRGV

SEQ ID NO: 78244 - DNA, 808 bp, Zea mays
  misc_feature: Ceres CLONE 1563236
  misc_feature: Encodes the peptide sequence at SEQ ID NO. 78245
  misc_feature (713)..(713): n is a, c, t, g, unknown, or other
  misc_feature (808)..(808): n is a, c, t, g, unknown, or other
ccccgcggtggcggccgctctagaactagtggatcccccgggctgcaggaattcgtctcacccctagaaaaaggagagatggctgagtggactaaagcggcggattgctaatccgttgtacaatttttttgtaccgagggttcgaatccctctctttcacgcctctccagctctcctctactagacttgttttttccgtccatcgtttcgtttgttccacctgcgcaactgcgacggggataagtacgtcttccagatgacgacggcggcatggccgcggccacgcttcctcgtcctcccccagcctggattcctccgctcggtctgccacggcctctgctcccgctgtctcttctgcttcctgctgctcctcgccttcgcctgcagctccagctccgggcgggtggtggtcactagcttgcctggcttcgacggcgacctccccttccacctcgaaacagggtacgtggaggtggaggaggacgccggcgtggagctcttctactacttcgtccaggccgagtccggcgccgccgccgccgccgatgacacccctttcctcttctggctcaccggcggcgaccgctgctccgtcttcagcggcctcgccctacgagatcggtcccatcagattcgtcctggaacccctacacggcaccctgccgcgcctgcgatacaaccacaactcgtgggtcaaaggtgtcacatatccntcttcgtccaattcacgggttggaggctggattttccttctcgagagacccaaaaggctacgaatgtcgagaattcttcggctcactgcaactan

SEQ ID NO: 78245 - protein, 183 aa, Zea mays
  misc_feature: Ceres CLONE 1563236
  misc_feature: SWISSPROT Homolog: EC 2.3.1.91 Sinapoylglucose--choline O-sinapoyltransferase
  misc_feature (153)..(153): Xaa is any aa, unknown, or other
MTTAAWPRPRFLVLPQPGFLRSVCHGLCSRCLFCFLLLLAFACSSSSGRVVVTSLPGFDGDLPFHLETGYVEVEEDAGVELFYYFVQAESGAAAAADDTPFLFWLTGGDRCSVFSGLALRDRSHQIRPGTPTRHPAAPAIQPQLVGQRCHISXFVQFTGWRLDFPSRETQKATNVENSSAHCN

SEQ ID NO: 78246 - DNA, 808 bp, Zea mays
  misc_feature: Ceres CLONE 1563237
  misc_feature: Encodes the peptide sequence at SEQ ID NO. 78247
  misc_feature (670)..(670): n is a, c, t, g, unknown, or other
  misc_feature (806)..(806): n is a, c, t, g, unknown, or other
ctccccgcggtggcggccgctctagaactagtggatcccccgggctgcaggaattcgtctcacccctagaaaaactcactggccatcttgagaactatactagtgactacaccctacaggtgttggtaggttattgcgctgtgtacatcttcatgcagaccttcatgatcccagggacaatattcatgtcactgcttgctggtgctctatttgggcaactgcgtggccttgcactggtggtctttgctgccactgcaggtgcttcttcgtgctatttcctgtcaaagatgattgggaagccactggtgttcacactgtggccagataagctcagcttcttccagagacaggttgctaaaagaagagagaagttgttgaattacatgcttttcctcagggtgaccccaacattgccaaataccttcatcaacttagcttcacccatagtagatgtcccctaccatatattcttactgggaactctcattggtcttatcccagctgcttatgtcactgtcagggctggaattgctcttggagagttaacttcgctgagtgacctttacgacacccagtcgatagcactgctattccctgaatcggtgttgtttcagtcacaccagcattgctggggcaaggatgaggcacaagagaaacaccagaaaatgcnggtaggcgcgtcatgatcccaaagcacctagcggtgtccacgtcaccctgtatatatgtcaacatcccagcatgcagtggcttcatttagttcggatcaaacggggcccttggtggctgggatgattaaaaacggntc

SEQ ID NO: 78247 - protein, 227 aa, Zea mays
  misc_feature: Ceres CLONE 1563237
  misc_feature (56)..(177): Pfam Name: SNARE_assoc Pfam Description: SNARE associated Golgi protein
  misc_feature (223)..(223): Xaa is any aa, unknown, or other
PRGGGRSRTSGSPGLQEFVSPLEKLTGHLENYTSDYTLQVLVGYCAVYIFMQTFMIPGTIFMSLLAGALFGQLRGLALVVFAATAGASSCYFLSKMIGKPLVFTLWPDKLSFFQRQVAKRREKLLNYMLFLRVTPTLPNTFINLASPIVDVPYHIFLLGTLIGLIPAAYVTVRAGIALGELTSLSDLYDTQSIALLFPESVLFQSHQHCWGKDEAQEKHQKMXVGAS

SEQ ID NO: 78248 - DNA, 800 bp, Zea mays
  misc_feature: Ceres CLONE 1563241
  misc_feature: Encodes the peptide sequence at SEQ ID NO. 78249
ggagctccccgcggtggcggccgctctagaactagtggatcccccgggctgcaggaattcgtctcacccctagaaaaagtgcgccatcacacacaagacacaaccccactcacccggcagggaggccctcttcgtcggcggaggccatggtttccctcaagccgcagaagaggctcgccgcgggagtcctaaaatgtggcaaggggaaggtgtggcttgaccccaacgaggtctacgagatctcgatggctaactcgcgtcagaacattcgtaagctggtgaaggatggattcataattaagaagccacagaaaatccactcaaggtcccgggcaaggagggcccatgaggccaagcagaaggggaggcactctggttacggtaagcgcaggggtaccagggaggctaggctccccaccaagatcctttggatgcgcaggatgcgtgtcctcaggcgtctgctgcgcaagtatcgtgaagcaaagaaaatcgacaaacacatgtaccacgatatgtatatgaaagtaaaaggaaacatgtttaaaaataagagggtactcatggagagcatccacaagtcaaaggccgagaaggccagagagaagtactctctcggatcagtttgaggccaagcgagccaagagcaaggcttcccgtgagagaaagattgcaagggagggaggagagattggctcagggccccaagggaacctgcggcagcaccagtatcaagctactgctcccgtttgcagctggcacaaagaaaagcgaagaaagtggaaaaagtgggtcctgctaat

SEQ ID NO: 78249 - protein, 159 aa, Zea mays
  misc_feature: Ceres CLONE 1563241
  misc_feature (2)..(149): Pfam Name: Ribosomal_L19e Pfam Description: Ribosomal protein L19e
MVSLKPQKRLAAGVLKCGKGKVWLDPNEVYEISMANSRQNIRKLVKDGFIIKKPQKIHSRSRARRAHEAKQKGRHSGYGKRRGTREARLPTKILWMRRMRVLRRLLRKYREAKKIDKHMYHDMYMKVKGNMFKNKRVLMESIHKSKAEKAREKYSLGSV

SEQ ID NO: 78250 - DNA, 780 bp, Zea mays
  misc_feature: Ceres CLONE 1563243
  misc_feature: Encodes the peptide sequence at SEQ ID NO. 78251
  misc_feature (645)..(645): n is a, c, t, g, unknown, or other
  misc_feature (672)..(672): n is a, c, t, g, unknown, or other
  misc_feature (695)..(695): n is a, c, t, g, unknown, or other
  misc_feature (733)..(733): n is a, c, t, g, unknown, or other
tggagctcaccgcggtggcggccgctctagaactagtggatcccccgggctgcaggaattcgtctcacccctagaaaaagctggaagctggtcacacaaacctacgtagagtgacataccttgtgttggatgaggcggaccggatgctagatatggggtttgagccccaaattcggaaaatagtagcacagatccgcccagacaggcaaaccttgtactggagtgccacatggcctagagaagttgaagccttagcaagacagtttctacaaaatccttacaaggtaatcataggctcacctgaacttaaagctaatcattccatacaacaaattgttgaagttatttcagatcatgagaagtatccaagactcagtaagctcttgtctgatctaatggatgggagccgtatcttgatattcttccaaacaaaaaaggattgcgataagatcacccggcagcttagaatggatgggtggccagcattatctatacatggtgataaagctcaagctgaacgggactatgttcttgcagagtttaagagcggcagagcccccataatggctgccacagatgtggcagcacgtgggtcttgatgtgaaggacataaagtgtgtgattaaattatgattttccaacaanctcttgaagattatattcacaggatangtccgaactggcccgtgctggtngctagcggaaactggcatttactttttttcacacacgncaaatgcaaaagttctcaaaggaatcctaagtgaagatttctgcgaa

SEQ ID NO: 78251 - protein, 151 aa, Zea mays
  misc_feature: Ceres CLONE 1563243
MLDMGFEPQIRKIVAQIRPDRQTLYWSATWPREVEALARQFLQNPYKVIIGSPELKANHSIQQIVEVISDHEKYPRLSKLLSDLMDGSRILIFFQTKKDCDKITRQLRMDGWPALSIHGDKAQAERDYVLAEFKSGRAPIMAATDVAARGS

SEQ ID NO: 78252 - DNA, 787 bp, Zea mays
  misc_feature: Ceres CLONE 1563245
  misc_feature: Translation starting site: 147
  misc_feature (460)..(460): n is a, c, t, g, unknown, or other
  misc_feature (462)..(462): n is a, c, t, g, unknown, or other
  misc_feature (463)..(463): n is a, c, t, g, unknown, or other
  misc_feature (533)..(533): n is a, c, t, g, unknown, or other
ggagctcaccgcggtggcggccgctctagaactagtggatcccccgggctgcaggaattcgtctcacccctagaaaaaccctcgccatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctcccgccttgggacctctncnnacggcctcacacccgcgcttcgtcggccacgagaaggacgtcatctccgtcgccttctccgtcgacaccngccagatcgtctccgcgtcccgcggacagaccatcaagctctggaacactctccggcgagtgcaagtacaccatcggcgggcgacctcgggcggggccagggccaccaacggtggggtctcctgccgttaggttctccccaaaaacctttccgcccaccattggtctccgggatcccggggaacccacccgtccaagggctgggaacctttacaaattggaaagctgcccctgcacttctgggaaggggcacct

SEQ ID NO: 78253 - DNA, 859 bp, Zea mays
  misc_feature: Ceres CLONE 1563246
  misc_feature: Translation starting site: 164
  misc_feature (440)..(440): n is a, c, t, g, unknown, or other
  misc_feature (487)..(487): n is a, c, t, g, unknown, or other
  misc_feature (546)..(546): n is a, c, t, g, unknown, or other
  misc_feature (601)..(601): n is a, c, t, g, unknown, or other
  misc_feature (615)..(615): n is a, c, t, g, unknown, or other
ctggagctccccgcggtggcggccgctctagaactagtggatcccccgggctgcaggaattcgtctcacccctagaaaaaacgagactgctcggccgacgaaataataaagcgcgcgcgcgcacgcggagaggctcggagagctgagtgagatggcacaaaccatggcgtccatgaccggcctctcgcagggcgttctgcccagcaggcgcgccgccaacagggccaggacggccgccgtcgtcagggcgtccgccgaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccnttgaaggagcggttctacctgcagccgctgccgccggcggaggcggntggcgaggggtgaagacgtcgggcgcaggacatcatcaacctcaagccgctcatcgacnagaaggcgtgggccgtacgtccagaacgacctccgccctccgggcctcctacctngcgctacgacctcnaagaccgtcatcgcttccaagccccaaggaggagaagcagagcctcaaggagctcaccgggcaagctctcagcccaatcgacgatcttgaccatgccgcaagatcaagagcacccccggaggccgagaatacttcgcagcaccaaagatcgcttcggcgacgtcccgccaggctagcctgatgaagcctatagatgggttaacgatggcccctaatttcggacttttgtttgttctatgagccg

SEQ ID NO: 78254 - DNA, 758 bp, Zea mays
  misc_feature: Ceres CLONE 1563247
  misc_feature: Encodes the peptide sequence at SEQ ID NO. 78255
  misc_feature (718)..(718): n is a, c, t, g, unknown, or other
tggagctccccgcggtggcggccgctctagaatagtggatcccccgggctgcaggaattcgtctcacccctagaaaaagaatacaatacctctcttcagaaattactgatgaatctattgatcgaaaatgcagggaagaattatcagaagaagactatgctgagatttccctcctacagaagagactaaaggaagagaagcagatcagaaatgagctgaaaaaaaagatggaactggagagaatggctgcatggaaaaatcggttagaggaatttgaaagtggccatcttcctttcatgtgcctgcaatacaaagataaggattcaattcagcacacgatccctgctgtatttattggaaacctcaactcatttgctgatcaaaagatcatgaacatggtggaagatgattcacttgtttctggcaagccgaaacgtgatagtggggaacaactttatcgcccatcttactatgtagctttaagttcagataattcatggtatctgttcacagaaaaatggattaaaactgtttacaagacaggtctacctgctgtcccttctgttgaagggggcacactccctagagaaaccctgaaacagctcctcctgcgtgaagagttggtgtgggataaaagtgaaaaatcagaatacggctctttgttaagcatgggaaggtctttagacacaggggtcgtggagtctcaatgttcctgtgncttaatagcccttttcgaagacaatggaggtaggaacgat

SEQ ID NO: 78255 - protein, 177 aa, Zea mays
  misc_feature: Ceres CLONE 1563247
  misc_feature (164)..(164): Xaa is any aa, unknown, or other
MELERMAAWKNRLEEFESGHLPFMCLQYKDKDSIQHTIPAVFIGNLNSFADQKIMNMVEDDSLVSGKPKRDSGEQLYRPSYYVALSSDNSWYLFTEKWIKTVYKTGLPAVPSVEGGTLPRETLKQLLLREELVWDKSEKSEYGSLLSMGRSLDTGVVESQCSCXLIALFEDNGGRND

SEQ ID NO: 78256 - DNA, 799 bp, Zea mays
  misc_feature: Ceres CLONE 1563248
  misc_feature: Encodes the peptide sequence at SEQ ID NO. 78257
acccgcggtggcggccgctctagaactagtggatcccccgggctgcaggaattcgtctcacccctagaaaaaagccatcagccacaacccacgcgccacgcgcccaagcccacccccacccgtcccgtgctagcttagctctcggctctcgccatggacgctgcggagaggaggctggctcgcgtcgctgcccacctcgttccgtccttcccggccccacacgccaccggacctcccctcgcgccttctcccgcggcagcgtcctcgtcgtcgtcctcgccggcgggggacagctacaggcgcgtgcacggcgacgtgccatcggagccaccggagtggcgcaccgccacagacgagtcagggaaggagttcgtcgacatcatctacgagaaggccgtcggagagggcatcgccaagatcaccattaaccggcctgacagaaggaacgccttccgtccgctgaccgtgaaggaactaatgcgcgcgttcaacgatgccagagatgatagttcgattggagtcatcattcttacagggaagggaaccaaggcgttctgcagtggcggtgaccaggcgttaagagattctgatggatatgttgacttcgatagctttggccgcctcaatgtcttagatctccaggtgcagattcgccgtcttcaaaagcctgtcattgctatggttgctggttatgctgtttggtggtggacatgtttttgcaccatggtgtgtgataatacaattgcagcagagaacgcgatatttgggcagacagggcccaaggtgggaacctctgagc

SEQ ID NO: 78257 - protein, 215 aa, Zea mays
  misc_feature: Ceres CLONE 1563248
  misc_feature (87)..(215): Pfam Name: ECH Pfam Description: Enoyl-CoA hydratase/isomerase family
  misc_feature: SWISSPROT Homolog: EC 4.1.3.36 Naphthoate synthase
MDAAERRLARVAAHLVPSFPAPHATGPPLAPSPAAASSSSSSPAGDSYRRVHGDVPSEPPEWRTATDESGKEFVDIIYEKAVGEGIAKITINRPDRRNAFRPLTVKELMRAFNDARDDSSIGVIILTGKGTKAFCSGGDQALRDSDGYVDFDSFGRLNVLDLQVQIRRLQKPVIAMVAGYAVWWWTCFCTMVCDNTIAAENAIFGQTGPKVGTSE

SEQ ID NO: 78258 - DNA, 842 bp, Zea mays
  misc_feature: Ceres CLONE 1563250
  misc_feature: Encodes the peptide sequence at SEQ ID NO. 78259
ctccccgcggtggcggccgctctagaactagtggatcccccgggctgcaggaattcgtctcacccctagaaaaaaaggggcggttacccgacgaccggactgggtttatgcggctccgccgtcacatctcgctcgagggaataaccccgccacggaagcctgcggcatgcatgctactgcggactcacctccaatctgcccctcgggccgccggcgccaatggagaaggagaacaacatgctatcgccgcaggcgacccctcagcatcgactgcgcgagtggtagctccgccaccgcaacgagtgactcgtcctcaaccgtcagatgcgatacgtgcacagggaggagaacaacatggagaaaggcttcggggaggctgccaagcacaatgacatgtgatctgcgtaggctctcgctaacaaactggtggtagcgagacgtcctgttaatcgcctttgccagagcaatgctcaaagaatgcaccatcatatgcaccttgcagacattgtcgcggctgcattaacagtgagacatctgtccgaaagcactgaagtgatgaacatggttgacagactcctgaaagctccacagttggaataccacgattcatgcatctatcaagaggcgcccaaggtcccgtgtgacggaaacatcatgtgtaacgaggctcctggattcctctttagactctcaacgacatcaacgaagaaattggaaaaagacgttcgacaaggttcttgctccagctagcttggtgagacgggctccaagcctccgagaagcctgccggagcccggcaccaaaatgatgtccccaaaaaaaaggttccagatagacctctc

SEQ ID NO: 78259 - protein, 90 aa, Zea mays
  misc_feature: Ceres CLONE 1563250
MHHHMHLADIVAAALTVRHLSESTEVMNMVDRLLKAPQLEYHDSCIYQEAPKVPCDGNIMCNEAPGFLFRLSTTSTKKLEKDVRQGSCSS

SEQ ID NO: 78260 - DNA, 841 bp, Zea mays
  misc_feature: Ceres CLONE 1563252
  misc_feature: Encodes the peptide sequence at SEQ ID NO. 78261
ctccccgcggtggcggccgctctagaactagtggatcccccgggctgcaggaattcgtctcacccctagaaaaactattccattcccaacttgtctgccctacccttgcttcagttgacggtggccgcagataggattcatggttccctgaggaggcaccgtatggacaccatggctaagtgcaacctaacagccccgaaacgaacctcatcctggcgcgaggttaaggacatgcactccaccccctcccccgacttcctggccctccccctcgaggaacacatcttcgcactgtgcaatttgctctccttgggccgagacacagcgagcttcacggtggaatctatcatggcaggatacaacttccctcggattatcctttcaagccgccatccttgtgcttactaacgccaagtggacgctttgagattcagaagaagatttgtttgagcatatccaattatcaccctgagcactggcagccatcatggagtgtgcgcacagcgttggtggccttgattgcattcatgccaaccaaccctggtggggcattgggctcattggattacaaaaaggaagatagacgggcacttggtataaaatcacgtgaagcaccgccaaaatttgggtccccagaacgacaaaaactaattgatgagatccctgagcaaatgctcagtaaggctccctctgtcccccaaacgctaccaaattgtgccaacgaggagtctaacgaaataccccccatctgacccttctggcgaacattccgacaaaggtagattaaggtgaccaccccttcttggttctgtatacaaacccctcctagggcccttcccgg

SEQ ID NO: 78261 - protein, 74 aa, Zea mays
  misc_feature: Ceres CLONE 1563252
MPTNPGGALGSLDYKKEDRRALGIKSREAPPKFGSPERQKLIDEIPEQMLSKAPSVPQTLPNCANEESNEIPPI

SEQ ID NO: 78262 - DNA, 807 bp, Zea mays
  misc_feature: Ceres CLONE 1563253
  misc_feature: Encodes the peptide sequence at SEQ ID NO. 78263
  misc_feature (637)..(637): n is a, c, t, g, unknown, or other
  misc_feature (733)..(733): n is a, c, t, g, unknown, or other
ggagctccccgcggtggcggccgctctagaactagtggatcccccgggctgcaggaattcgtctcacccctagaaaaaactcccagtcccaaacccatttcccttgccttcccctccggctccgcctcctcgaccactccgacaaccccagcgcctccggcgagctccacccctccaccggctgcggcgagaagcggcgggggctaactaagtctgtaggcggcggcggaggtgatccgggagccggagccgagtctagggcgatggggcagcagtcgctgatctacgcgttcgtggcgcgtggcaccgtggtgctggctgagtacaccgagttcaccggcaacttcaccaccatcgccgcccagtgcctgcagaagctccccgccagcaacaacaagttcacctacaactgcgacggccacaccttcaactacctcgtcgaggacggattcacgtattgtgtagttgctgttgaatcagttgggcgacaaatccccatagctttcctggacagagttaaggaagacttcaccaaaaagtatggaggcgggaaagcagctactgctgcagcgaacagcttggacaggggtagttggatcaaagcttaaagaagcacatgcagtactggtgtggaccnaccctgaggtagttagcaaagcttgccaaaggtgatggcccaaagtctcccgaagtcaaagggagttatgatggtaaacatttgagaagggtcttngaccccgtggcgagaagatttgaactgctgtgtcgacaaaactggaaaaatctggcgtttctcagggcacagaa

SEQ ID NO: 78263 - protein, 114 aa, Zea mays
  misc_feature: Ceres CLONE 1563253
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLDRGSWIKA

SEQ ID NO: 78264 - DNA, 797 bp, Zea mays
  misc_feature: Ceres CLONE 1563255
  misc_feature: Encodes the peptide sequence at SEQ ID NO. 78265
aaagctggagctcaccgcggtggcggccgctctagaactagtggatcccccgggctgcaggaattcgtctcacccctagaaaaaacttggattcggcgaccaccggagcgcggaggaggcacaggcgccgatctaaagacgatggccgccgcgggctcctcgccgtccttctcctcctcgagtaagcgggcgatgaattgaaggatccacccaggccaagcactggtgctctgtgcttatcttttagcgagcgaagtggtcatttccccctctctttttatgggaggaaaataggaaatggtgtgccaagtgtatcctcaaccattctactgttccaaacgtgcagtatacatcggcatacagtcgatccagttgcaacaccatagctggaagggaaggtggccctcgtcactggtggcgccaccggcatcggtgaggccatcgttcgcctcttcatggagcacggcgccaaggtctgcatcgcggacatccaggatgaggctgggcagcagctgcgcgacgccctgggaggtgacgcgcagggcgccatgttcgtccactgcgacgtgacgtcgggaggaggacgtgagccgcgccgtggacgcctgcggcgggatcgttcggcgcgctggaacgtgatggtgaccaacgccggcgtgacggggcccaaaggtgacggacatccggcaacgtgggactttcgcggaggcgcgcaggggtgctccaacgtcatcgtgtgcaacggctgtttccctggggggattgaagcacgccggcgccgcggctatgattcccgc

SEQ ID NO: 78265 - protein, 114 aa, Zea mays
  misc_feature: Ceres CLONE 1563255
  misc_feature: SWISSPROT Homolog: EC 1.1.1.288 Xanthoxin dehydrogenase
MEHGAKVCIADIQDEAGQQLRDALGGDAQGAMFVHCDVTSGGGREPRRGRLRRDRSARWNVMVTNAGVTGPKGDGHPATWDFRGGAQGCSNVIVCNGCFPGGIEARRRRGYDSR

SEQ ID NO: 78266 - DNA, 752 bp, Zea mays
  misc_feature: Ceres CLONE 1563256
  misc_feature: Encodes the peptide sequence at SEQ ID NO. 78267
  misc_feature (201)..(201): n is a, c, t, g, unknown, or other
  misc_feature (202)..(202): n is a, c, t, g, unknown, or other
  misc_feature (210)..(210): n is a, c, t, g, unknown, or other
  misc_feature (211)..(211): n is a, c, t, g, unknown, or other
ggagctccccgcggtggcggccgctctagaactagtggatcccccgggctgcaggaattcgtctcacccctagaaaaagcggctccctccggcgagcggcgatggccttctcacccccactgatcgactgggaggcggagagctaccctgcctacccagatttcgcggccattccccttttcgtcgtcttcttcctcgtcnngtccgttnntcttcctcgaccgcttcgtattcgagtgttagccagaagctgattttcaggagagatgagagaagctggccctactactatgcaggcagagaaagatcggaaattaaagatcagctgggaatgcatgtatttctttctgggaactatggcattgtctggaactacaacgagccctggttccaaacccaagaaaattctggggtgggacccggcgataaatattgggccaatccaaaaatttatttgaactccgaacccctttatggtttgtggtggggttttcacaacccccaatttgcccccttttttttgggaaaaaaaggggccaaaatccgggtttttcaggaccccccccggggggaacccccctggtttaaaaaaaccggcctccaaaataaaaaaaatcccccgggggggggggcatatttcctccccccccccctaaaaaaaccccccaaaggggttccccccacccgggggaaaaaaattctcccgccctttttgcgcccgccaaaatgtttttttccaaaagaattttttt

SEQ ID NO: 78267 - protein, 50 aa, Zea mays
  misc_feature: Ceres CLONE 1563256
  misc_feature (34)..(34): Xaa is any aa, unknown, or other
  misc_feature (37)..(37): Xaa is any aa, unknown, or other
MAFSPPLIDWEAESYPAYPDFAAIPLFVVFFLVXSVXLPRPLRIRVLARS

SEQ ID NO: 78268 - DNA, 760 bp, Zea mays
  misc_feature: Ceres CLONE 1563257
  misc_feature: Encodes the peptide sequence at SEQ ID NO. 78269
ctggagctcaccgcggtggcggccgctctagaactagtggatcccccgggctgcaggaattcgtctcacccctagaaaaagtctgactctgatctcgcatcgcgccgaggccctccggaatcccaatcctctcctctcccgcaagcaccccgggtctgctgcagcgcctcgtctccgtggtctggcatcagagtccccgggagaatggttgctctgtcggcaggagcgctggctccgctcgcaggtctgtctccgctgccgtcgtgcagcgcggctccgttgtactgccgcaggagtccgccacttctcaatgtcgccatcgccaagacgcggccagctgttcaccaatctgctcctgcaagcttccgaaaatgtgcagctatgtcagaacatggacgtcaggaactccggaccaatgagtaccagctggatgatgatgatgagccgttttggctggcagtggtcagagaccttgctgtgggtttcaagggattggtagctttcttagctgagcagccgaggcaactgaagcacctggagtggccgggctttctacacacgctgaagacggccacacttactctttgtattggtagcctatgtttattgttgcattatcaactattgatgctgccctctgctacatgctgggcctggctacctcgaaaatctgccctagaattatgctgggaatatcaatgtattgcttggaatatgattttagcacgacaggatagttagcagggcactgccagctgga

SEQ ID NO: 78269 - protein, 178 aa, Zea mays
  misc_feature: Ceres CLONE 1563257
MVALSAGALAPLAGLSPLPSCSAAPLYCRRSPPLLNVAIAKTRPAVHQSAPASFRKCAAMSEHGRQELRTNEYQLDDDDEPFWLAVVRDLAVGFKGLVAFLAEQPRQLKHLEWPGFLHTLKTATLTLCIGSLCLLLHYQLLMLPSATCWAWLPRKSALELCWEYQCIAWNMILARQDS

SEQ ID NO: 78270 - DNA, 829 bp, Zea mays
  misc_feature: Ceres CLONE 1563258
  misc_feature: Encodes the peptide sequence at SEQ ID NO. 78271
  misc_feature (532)..(532): n is a, c, t, g, unknown, or other
ggagctccccgcggtggcggccgctctagaactagtggatcccccgggctgcaggaattcgtctcacccctagaaaaagcgccgccgctggcgctgcgcggccgccgtgctccttctccactcgtgcttcccaagctgcttcggcggaagcaatgcgagggccctgccccggtggaggcgtctcggcgtcttttgccccgagcttcaacggctcccgcgccatgatctggccggcgacagtctattgcacgagacggatccgcatttacttcttcctgacaggccaaaacagggccgttacgcacagggcgacaggtctacgggcaggaatttgctatgctacccaggctggttgaattgctgcccactttgtaaccctgaaatcgtggtctctagacgcacggctcgaggactgctgggaaatggctgacactcagtgcatctcgttctttcctggttacaagtccccgttggacctctgttctccggattgatctctacattgctctcctctctggatttgagtctcacncaggcgcatgacgactcgacctggtggcgcctattcgagtcaggaaaatctattggcacatcgagtggagagatgcatctgatgccaactgtgagaattgcactctagtagagctccgtgcctcgaaatgctacacttggatacagtgaaaaactgaccttccaagaaggggaaccctgaaccggaaaaagggccgggtattccttaataaacaaacatcacgtttccggaaagaagaaacggcccaaaaagggtcccccaaaatttgtctttccaaaaccctcagggcagggcaac

SEQ ID NO: 78271 - protein, 67 aa, Zea mays
  misc_feature: Ceres CLONE 1563258
MRGPCPGGGVSASFAPSFNGSRAMIWPATVYCTRRIRIYFFLTGQNRAVTHRATGLRAGICYATQAG

SEQ ID NO: 78272 - DNA, 744 bp, Zea mays
  misc_feature: Ceres CLONE 1563259
  misc_feature: Translation starting site: 118
  misc_feature (391)..(391): n is a, c, t, g, unknown, or other
ctccccgcggtggcggccgctctagaactagtggatcccccgggctgcaggaattcgtctcacccctagaaaaaagttctccgcacccacccacccacccactcctttccccaacccatggccgccgccgccgccggcacccgggaggagatggtctacatggccaagctagcggagcaggcggagcggtacgaggagatggtggagttcatggagaaggtcgcggccgccgccgagctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtaccgcgcgncgcgtggaggccgagctctccgggatctgcgcggggatcctgcgcctcctcgacgagcgcctcgtgccggcggcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcaggctcggcctcgccctcaacttctccgtcttctactacgagatcctcagctcgcccggacgcgccctgctcgctggccaagcaggcccttcgacgaagctatttca

SEQ ID NO: 78273 - DNA, 836 bp, Zea mays
  misc_feature: Ceres CLONE 1563261
  misc_feature: Encodes the peptide sequence at SEQ ID NO. 78274
acccgcggtggcggccgctctagaactagtggatcccccgggctgcaggaattcgtctcacccctagaaaaaaccatcacagtacgcacgcacgcacacaccagcccagcagcagaagcgcccctcggccctcgctcccacaacaagctcaagccagccttctctctctgctccaatggcgcgcttccagctcgcagccgtggccatggccatgctcttcgccgcggcggcggcgcaggccccgaccgccaccccgacgccggctcccaaggcgtcccccccgccggcgacgccgccgccgacccccgcgccggtgtctccgcccgtgccgcccccgaccatgcctcctccggcgcccgcgcccgcccccaaggccccggccccggcgcccgaggcccccaccacggcgcccacggccgaagctcccagtccccacgtgagatccgcgccgatgcccaccgagaggacctgctcatacaccctgcgcggaggctcctccatccccaagtggccggggttaccaggtgctgcaccctcttcaaagagaatcacggccccccacgaccgtgggcttaccccaaggcccaccacgggattgggaaaagaaggacgaccatccaccaccccgctggttgaagctcgggctttaaacgcccttgagccgggtttccccctgttccctggcccttccctccgcgggccaaaggcaagggggcatcccccggactctgactcaaagagggatcggggaaaaaagggggcggggccccccatagggtggggcaaaaaaacggccaaatgtccgggattcgccatcccctccgcccaaggaaaat

SEQ ID NO: 78274 - protein, 220 aa, Zea mays
  misc_feature: Ceres CLONE 1563261
MARFQLAAVAMAMLFAAAAAQAPTATPTPAPKASPPPATPPPTPAPVSPPVPPPTMPPPAPAPAPKAPAPAPEAPTTAPTAEAPSPHVRSAPMPTERTCSYTLRGGSSIPKWPGLPGAAPSSKRITAPHDRGLTPRPTTGLGKEGRPSTTPLVEARALNALEPGFPLFPGPSLRGPKARGHPPDSDSKRDRGKKGAGPPIGWGKKTAKCPGFAIPSAQGK

SEQ ID NO: 78275 - DNA, 767 bp, Zea mays
  misc_feature: Ceres CLONE 1563265
  misc_feature: Encodes the peptide sequence at SEQ ID NO. 78276
ctccccgcggtggcggccgctctagaactagtggatcccccgggctgcaggaattcgtctcacccctagaaaaacttgacctcacataggcagtaaaggatacagttaatgtaagcgctggagatgttgcttctctcatatatttgtggaacccttgggcaatagtcacttgtgtgggatcatgtacatcaccaatcgagaatctaatggttgtaataatgatctacggatcctgttcacgtctggctcctcttgctgcttttggatatgttatgagccacacacctctctctttatcctgcaattctcatagtaccggtcattctgttgctaggttatggtctagatgctcctcctccaaaagtatttgttataaaagggtcaattgccagaaaaagtgatgtgtcagacaatgataaaacaagcagacagagagttgttcagcagttttcatggaaaccagtacttcactttatattttggctgttcatctggtcgtgccatgtgttgttattgagcagcgtgattctgaagaaagtcggcggcctccacgagatgtttgaaaagacgtatggttttatacttacagtgaaagacctatcaccagatatgggcgttatgtggtacttctttgctgaagtttccgacttctttagaaatttgcttcttatggtattcaatatgaacatcatttttatggtcttgacattggccatccgattgaaacatcgtccgtgcttttcttgcatttgtttacacggctattt

SEQ ID NO: 78276 - protein, 70 aa, Zea mays
  misc_feature: Ceres CLONE 1563265
  misc_feature (1)..(70): Pfam Name: PIG-U Pfam Description: GPI transamidase subunit PIG-U
MFEKTYGFILTVKDLSPDMGVMWYFFAEVSDFFRNLLLMVFNMNIIFMVLTLAIRLKHRPCFSCICLHGY

SEQ ID NO: 78277 - DNA, 813 bp, Zea mays
  misc_feature: Ceres CLONE 1563269
  misc_feature: Encodes the peptide sequence at SEQ ID NO. 78278
ctccccgcggtggcggccgctctagaactagtggatcccccgggctgcaggaattcgtctcacccctagaaaaagacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacatggagctgcaggaggccatcaaatcctacccggacgccttccaccgcgtcatcggcttcgaaacatcaagcagacgcagtgcgtcagcttcatcgcctactagcccccggggagcgactagaccgcggcctgccgccgccccccgccggctagctagctagcttagctcctgcgtgagctagtagctaatgccatgcgtcctctcggaacggtcggttttgccccgggtcaacgggtacccttggcatgcttggttttctcctatccttttttccatattttattctcct

SEQ ID NO: 78278 - protein, 183 aa, Zea mays
  misc_feature: Ceres CLONE 1563269
  misc_feature (58)..(163): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYMELQEAIKSYPDAFHRVIGFETSSRRSASASSPTSPRGATRPRPAAAPRRLAS

SEQ ID NO: 78279 - DNA, 741 bp, Zea mays
  misc_feature: Ceres CLONE 1563270
  misc_feature: Encodes the peptide sequence at SEQ ID NO. 78280
  misc_feature (686)..(686): n is a, c, t, g, unknown, or other
  misc_feature (730)..(730): n is a, c, t, g, unknown, or other
  misc_feature (731)..(731): n is a, c, t, g, unknown, or other
ctccccgcggtggcggccgctctagaactagtggatcccccgggctgcaggaattcgtctcacccctagaaaaaatccacaggattttctcctaaagatcacagactttacttaggccatcacaaggagacgtacgctctctgctagcacccatcgtcttgcagcaggcggagccgcccgacccgatccgtgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgccggcctcgtcgccatcctcagcgtctgcctcaccatgtacggcgtcgccctccttcaacgagggcgacccccgtcacgggngccccacgctcacgctcaccgggcgggaaagaaggaggccgacnnagctgcagaa

SEQ ID NO: 78280 - protein, 170 aa, Zea mays
  misc_feature: Ceres CLONE 1563270
  misc_feature (44)..(168): Pfam Name: PsaL Pfam Description: Photosystem I reaction centre subunit XI
  misc_feature (152)..(152): Xaa is any aa, unknown, or other
  misc_feature (167)..(167): Xaa is any aa, unknown, or other
MASQVMKSSPVHSRPRGLSGAALTRPRPRFSVVKAAIQPEKATYQVVQPINGDPFIGSLETPVTSSPLIAWYLSNLPAYRTAVSPLLRGVEVGLAHGYLLVGPFALTGPLRNTPVHGQAGALGAAGLVAILSVCLTMYGVALLQRGRPPSRXPHAHAHRAGKKEADXAAE

SEQ ID NO: 78281 - DNA, 769 bp, Zea mays
  misc_feature: Ceres CLONE 1563274
  misc_feature: Encodes the peptide sequence at SEQ ID NO. 78282
  misc_feature (595)..(595): n is a, c, t, g, unknown, or other
  misc_feature (743)..(743): n is a, c, t, g, unknown, or other
ctggagctcaccgcggtggcggccgctctagaactagtggatcccccgggctgcaggaattcgtctcacccctagaaaaagcgtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggctacgggaaccgtgggcgggcccaacggccacgccatcgctcccgccacagacaccaagtccaccgccgtcgagaccaccgtcgaagagggtgatcttcgacttccggttcctggcactcctcgccgtcgccgggtcactcgccggctccgtcctgtgcttcctcaatggctgtgtcttcatcaaagaggcgtaccaggtttactggtcgagctgtgtcaagggggttcatacggggcagatggtcctcaaggtcgtcgaggccatcgnatgtgtatcttgctggaacagtcatgctgatattttgggatgggtctctacggcctcttcatcagcaacgcttcccgccgggtgttcctcctggatccggaccgtgcccttcagcggctcgtcgttggttcggggatgttcgctttgnagaaaccgcccgaagtggatgaccca

SEQ ID NO: 78282 - protein, 255 aa, Zea mays
  misc_feature: Ceres CLONE 1563274
  misc_feature (198)..(198): Xaa is any aa, unknown, or other
  misc_feature (247)..(247): Xaa is any aa, unknown, or other
GAHRGGGRSRTSGSPGLQEFVSPLEKASHLHAAAAAKPLSSRAASATQTPDGAPAAARLRRAASRPRGPGGVPAAPSGAAAAAARGRRLFGLLRSVRRGGVVVPGRPRLREPWAGPTATPSLPPQTPSPPPSRPPSKRVIFDFRFLALLAVAGSLAGSVLCFLNGCVFIKEAYQVYWSSCVKGVHTGQMVLKVVEAIXCVSCWNSHADILGWVSTASSSATLPAGCSSWIRTVPFSGSSLVRGCSLXRNRPKWMT

SEQ ID NO: 78283 - DNA, 730 bp, Zea mays
  misc_feature: Ceres CLONE 1563275
  misc_feature: Encodes the peptide sequence at SEQ ID NO. 78284
  misc_feature (566)..(566): n is a, c, t, g, unknown, or other
ctccccgcggtggcggccgctctagaactagtggatcccccgggctgcaggaattcgtctcacccctagaaaaaaaaaatcacaaaactttcgcccaattccccactagcaaccgtccccacaatcctccgacgatgcctgccgcgccgacgctgttgcccccctgcgacgcggaggagccgctgctggcggagtcctccgaccgcttctccatgttcccgatccgtttcccgcagatctgggagttctacaagaaggcggtggcctccttctggacggcggaggaggttgacctctctgccgacgcccggcactgggacgaggctctgtcccccgacgagcggcactttatctcccacgtgctcgccttcttcgctgcctccgacggcatcgtgctcgagaacctcgcttcccgcttcatgaccgacgtgcaggtcgccgaggcgcgggccttctacggcttccagatcgccatcgagaacatccactcggagatgtattcgctgctgctcgagacttacatccgcgaccacgtcgaagaaggaccgcctggttccgcgccatcngacaccggtgccccgccggtccccccggcaaggggctgaactggggggcattgccggttgggatcccaaaccgggcgggggaaacccgtttccccctggaacgggcattcggtttggccttttccccctgggggtttcaagggggcctttttttccttccctcc

SEQ ID NO: 78284 - protein, 156 aa, Zea mays
  misc_feature: Ceres CLONE 1563275
  misc_feature (15)..(154): Pfam Name: Ribonuc_red_sm Pfam Description: Ribonucleotide reductase, small chain
  misc_feature: SWISSPROT Homolog: EC 1.17.4.1 Ribonucleoside-diphosphate reductase
MPAAPTLLPPCDAEEPLLAESSDRFSMFPIRFPQIWEFYKKAVASFWTAEEVDLSADARHWDEALSPDERHFISHVLAFFAASDGIVLENLASRFMTDVQVAEARAFYGFQIAIENIHSEMYSLLLETYIRDHVEEGPPGSAPSDTGAPPVPPARG

SEQ ID NO: 78285 - DNA, 648 bp, Zea mays
  misc_feature: Ceres CLONE 1563279
ctggagctccccgcggtggcggccgctctagaactagtggatcccccgggctgcaggaattcgtctcacccctagaaaaaattccgtcgtcgtcgtcagcagcttctgcttgctttgtgggggaaggagagagagagagagcgagagagagtctagtagagaggctagtaggtggtcctcgaacgaagatgttggcggtgttcagcgggcagggtggtggaggtgccggcggagctggtggcggcgggcagccgggacgcccgtcgccccagacgaaaggcgtcgcaagctccgtgggggcgccttcctgggccccccctccgaagccccggcccgtggtcccgtttgcaggttttgggggaaacccaagggggcccccccctggcctttttaatccccccccccccccaaacccggggggggcgggttttttttgggggggccccccccagggttggttttttttcccggggcgcccccaaaggggggcaccaaaagaggggggtgtttttttccccccccccctttttgtttttccaaaaaaaaagggggggggggggtttttctttttaaaaaaaaaaaaaacccccccccccgggggggggggcccccccccccccctttattttaaaaaaaaaaaaaaaaaaa

SEQ ID NO: 78286 - DNA, 830 bp, Zea mays
  misc_feature: Ceres CLONE 1563283
  misc_feature: Translation starting site: 107
  misc_feature: SWISSPROT Homolog: EC 1.11.1.15 Peroxiredoxin
  misc_feature (475)..(475): n is a, c, t, g, unknown, or other
  misc_feature (759)..(759): n is a, c, t, g, unknown, or other
agctccccgcggtggcggccgctctagaactagtggatcccccgggctgcaggaattcgtctcacccctagaaaaactcgaccgcatcgccacccaccccatctccatggctacctccgccctcgctgctctgtccgccaccgcggccgccgccggtaagcgcatcctcctgtcgcgccccgcctcctcctcctccctctccttcgcctcccgccgcctggccgccggggcacccctccgggggttccttggcgagccaatccgggccgtggcgtcgtcggcgtcggcggcccccgcggcggcggccaagaccatcgcggtcggggaccggctccctgacgcgacgctctcctacttcgacacgtcctcccccgacggcgagctgaagacggtgacggtccgcgacctcaccgcggggaagaaggtggtgctcttcgccgtgcccggcgcgttcacgcccacctgcacccagaangcacctcccggggttcgtggccaaggccggggagctccgcgccaagggcgtcgacaccgtggcctgcgtctccgtcaacgacgccttcgtgatgcgcgcgtggaaggagagtctggggaatcggggacgaggtgctgctcctgtcggacggcaacggcgagctggcgcgcgccatgggcgtcgagctcgacctctccgacaagccgtggggctcggcgtccggtcccgccgctacgcgctgctcgcggaagaaacgcgtggtcaaagtgatcaacctcgagaangggcggcgcgttcaccaacagcaagcgccaggaacatgctcacgcgctctgactcgcgaacgcctgggttg

SEQ ID NO: 78287 - DNA, 834 bp, Zea mays
  misc_feature: Ceres CLONE 1563285
  misc_feature: Encodes the peptide sequence at SEQ ID NO. 78288
  misc_feature (771)..(771): n is a, c, t, g, unknown, or other
ctccccgcggtggcggccgctctagaactagtggatcccccgggctgcaggaattcgtctcacccctagaaaaaggtccataggcccagttggcgccgggtcgggttttgctagggtttactgcttgtcttcctttctcggcagtcggcaccttcgcggcttcgcctgatcgcctacgccgcttcgtcctgattctgattctctggtgctcccaagaagaaagtcagggaatgaaggaccgccacctctcgctgaaccagacccagcgggtccgcctcgaggccgcgcttcaagagctccagtccgttgcgcccgccgccgcgtccgccgccgccgtcaccgtcgcggacaccattcccgtcaatcaagaggacaacatcctcaaggggcatgggacgtcggatcaggacggggaggtggttgcgacgctctgcggggtggtggagcgggtcaacaagctggtctacgtccgcactcttcgcgcgagatacaagccggaggttggtgatatcatagttggccgtgtgattgagattgctcctaagcgatggaggttggagataaattttagccaagatgctgttctgatgctttcatctatgaacttgccctgatggtattcagagaaggagaactgctgttgatgaactaaatatgcggagtacttggaagaaaatgatgttatcttgtgctgaagttcgaggcttcaaacatgatggatctctgcactacaggcagggagtgaaaagtatggaaagctggagagggccnatttgctgatggtacctccatactgggtttaacgaaagaagcagcatttcctccatcctggat

SEQ ID NO: 78288 - protein, 127 aa, Zea mays
  misc_feature: Ceres CLONE 1563285
MKDRHLSLNQTQRVRLEAALQELQSVAPAAASAAAVTVADTIPVNQEDNILKGHGTSDQDGEVVATLCGVVERVNKLVYVRTLRARYKPEVGDIIVGRVIEIAPKRWRLEINFSQDAVLMLSSMNLP

SEQ ID NO: 78289 - DNA, 781 bp, Zea mays
  misc_feature: Ceres CLONE 1563286
  misc_feature: Encodes the peptide sequence at SEQ ID NO. 78290
ctccccgcggtggcggccgctctagaactagtggatcccccgggctgcaggaattcgtctcacccctagaaaaaatcccatctgctatccttggttgccgcttcctccaaagccactccaaacccccgcttccagaaccttctcgaaactctccgcctcctcctctactcgctccgatggcgaaggaaccgatgcgcgtgctcgtcactggcgccgcagggcaaattggatatgctcttgttcccatgattgctaggggagttatgcttggtgcagaccagcctgttattctgcacatgcttgatattccgccagcagctgaagcccttaatggtgttaagatggagttggttgatgctgcatttcctcttctgaagggagtcgttgcgacaactgatgttgtggaagcgtgcactggcgtgaatgtggccgtcatggttggtggattccccaggaaggagggaatggagaggacagatgttatgtctaaaaatgtctcaatctacaaaacccaagcatctgctcttgaagcccatgcagcccccaactgcagggttctggtggatgccaacccagcgaacaccaatgctcttatcttgaaaagatttgctccatcaattgcctgataaggaacgtaactttgcctgacccgggcttggacacaaacagggcctcttgggccagatttctggaaaggattaaggggccaaggtcagggaatgggaaaaaatggtattcttcctgggggtaaccccctcgttcccctcagttccctgaaagg

SEQ ID NO: 78290 - protein, 149 aa, Zea mays
  misc_feature: Ceres CLONE 1563286
  misc_feature (6)..(149): Pfam Name: Ldh_1_N Pfam Description: lactate/malate dehydrogenase, NAD binding domain
  misc_feature: SWISSPROT Homolog: EC 1.1.1.37 Malate dehydrogenase
MAKEPMRVLVTGAAGQIGYALVPMIARGVMLGADQPVILHMLDIPPAAEALNGVKMELVDAAFPLLKGVVATTDVVEACTGVNVAVMVGGFPRKEGMERTDVMSKNVSIYKTQASALEAHAAPNCRVLVDANPANTNALILKRFAPSIA

SEQ ID NO: 78291 - DNA, 770 bp, Zea mays
  misc_feature: Ceres CLONE 1563289
  misc_feature: Encodes the peptide sequence at SEQ ID NO. 78292
  misc_feature (629)..(629): n is a, c, t, g, unknown, or other
ctcaccgcggtggcggccgctctagaactagtggatcccccgggctgcaggaattcgtctcacccctagaaaaagactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggccgaggcccccgcgtacctgcaccgcgacgacttcgcgcggtacctggacgggtacgccgcgcggttcgccgtccgcccgcgcctccgccgcgaggtccggtcggcgcggtacgaccccgcgagcgcgcggtgggaaggtggaggccgtggacctcggcacgggccaggccgagcggtacgcggcgaggttcctgggtggtcgcgtccggggagaacgccgagaagttcctgccggaggtgcctgggnctggaggcgttccccggccaggtgatgcacgcagtgggagtaccggtcggccgtagggatgcgcgggaaggccgtgctcgtccgtggggtcgggcaacccccggcatggagatcgcttacgaaactcgcgccgccggggcc

SEQ ID NO: 78292 - protein, 200 aa, Zea mays
  misc_feature: Ceres CLONE 1563289
MAAVAEEEVIVVGAGQSGLAVAACLSLRGVRALVLERDDCVGSLWRKRAYDRLHLHLTKKYCALPHAPHPAEAPAYLHRDDFARYLDGYAARFAVRPRLRREVRSARYDPASARWEGGGRGPRHGPGRAVRGEVPGWSRPGRTPRSSCRRCLGLEAFPGQVMHAVGVPVGRRDAREGRARPWGRATPGMEIAYETRAAGA

SEQ ID NO: 78293 - DNA, 713 bp, Zea mays
  misc_feature: Ceres CLONE 1563290
  misc_feature: Translation starting site: 259
  misc_feature (500)..(500): n is a, c, t, g, unknown, or other
  misc_feature (628)..(628): n is a, c, t, g, unknown, or other
ggagctccccgcggtggcggccgctctagaactagtggatcccccgggctgcaggaattcgtctcacccctagaaaaaattcatcccagccgaagagcaccaagcttcgctagcagcatatacgcatccatcccactggaaacagaccaaccctaccctaccctgcagcgcgcgcagagggggaaaggagctccagcaaaaagtttgtccagctcctcctcctactacagcgctacaaggatctgatcatcgagcagcatggcgcggcggccgcagcccatgcccaacctggtgcccacgctcctcctgctcgtcgtcgtggccgccgccgcggcggtcgtgagagccgacgacgacgagaagtgcagcaacccgtgcgggaacccctgcggcgagccgtgcgtgtacgccagcccgccgccgccgccgacgcccgtgtactcgcccccgcccccgccgcgacgcccgaagtactaccgcggcgaccccgacccgtactnacgcctactgcccgcgccgccgtcgggcggcggcggctacgagccgtcgcccgggtacacgcccgtcgacgccctacacgccccggctacaaccccacgcccctcccgggtcccggcttgttacgccnccgcccctaaaacggcccgccgtcccgcaaaggaaccccttttcccccccaagggaccccccggggttttccggggcccaaaagc

SEQ ID NO: 78294 - DNA, 767 bp, Zea mays
  misc_feature: Ceres CLONE 1563293
  misc_feature: Encodes the peptide sequence at SEQ ID NO. 78295
  misc_feature (573)..(573): n is a, c, t, g, unknown, or other
ctccccgcggtggcggccgctctagaactagtggatcccccgggctgcaggaattcgtctcacccctagaaaaatagccagcgccaaccccggaaaggcggaaacccatcgcaactaatccccaaccccaaacctccaatccacccatcccctcctcatccactccgggcggccatggcctgctccttcgccgccgcgaccgtcgtctcttccgcccccaccccggccgccaggcccctcgccgctgccccgcagtccgtctctgtttcccgctccgcggtcgccaccgccgccaggccgctccgcctcgtcgcctccagatccgcgcgggccatcagactcgtcgcccgcgccggcggcgtcgatgacttgccgctggtcgggaacaaggcgccagacttcgaagccgaagccgtgttcgaccaagagttcatcaacgtgaagctctctgattacatcgggaagaaatacgtcgttctgttcttctaccccttggatttcacctttgtctgcccgaccgagattactgccttcagtgacagatatgaagaattcgagaaagtgaacactgangttcttggtgtctctattgacagtggtgttcccccaccttgcatgggtgcagacagacaggaaagtctgtgggcttgggcgatcttaaaataccaacttaatttcctgatgtcacccaaatccatttcaaaggccctttcgggggttccggaatccctggaccagggggtatcgctccttgaaaaggaactgtt

SEQ ID NO: 78295 - protein, 197 aa, Zea mays
  misc_feature: Ceres CLONE 1563293
  misc_feature (69)..(190): Pfam Name: AhpC-TSA Pfam Description: AhpC/TSA family
  misc_feature: SWISSPROT Homolog: EC 1.11.1.15 Peroxiredoxin
  misc_feature (133)..(133): Xaa is any aa, unknown, or other
MACSFAAATVVSSAPTPAARPLAAAPQSVSVSRSAVATAARPLRLVASRSARAIRLVARAGGVDDLPLVGNKAPDFEAEAVFDQEFINVKLSDYIGKKYVVLFFYPLDFTFVCPTEITAFSDRYEEFEKVNTXVLGVSIDSGVPPPCMGADRQESLWAWAILKYQLNFLMSPKSISKALSGVPESLDQGVSLLEKEL

SEQ ID NO: 78296 - DNA, 846 bp, Zea mays
  misc_feature: Ceres CLONE 1563296
  misc_feature: Encodes the peptide sequence at SEQ ID NO. 78297
  misc_feature (741)..(741): n is a, c, t, g, unknown, or other
ctccccgcggtggcggccgctctagaactagtggatcccccgggctgcaggaattcgtctcacccctagaaaaaatcggtcgccctctcgccgacgccacccatggaggccgccgcgatcgccaccacctcccggtctctcccgctccccttctcatctacccagctccagctccagcgccggcgccgtgccgccttcctacacatcgccgcctccaagcgtcacgaagacgacaaggagaccgctaaaggttccggctcggaaccccggcgcgagcccactagcctggcgccgtacggcatctccatctcgccgctctccaaggacgcggctatggggctggtggtgagcgccgccacggggagcggctggaccacgggatcgtggaatggagggcccgccgacggcgagcaaagccggtggggcgggcaggccggaggtgtcgacgctgccttggtccctcttcacgaaatcaccacggcggcgcatgcgggtggccttcacctgcaacgtgtgcgggcagcgtacgaccagtgccatcaatcctcatgcctacactgatggaactgtgtttgttcagtgctgcggttgcaatgtgttccataagttggtcgacaacctgaacctgtttcatgagatgaagtgctacgtcggtccagacttccgctaccaaggggatgctccatttcaactaccttgacccaaacgaggataacgacactaccctcccctctcgaaagncctaaagccctccttttaatgtggccagtacaaaaattgggtcggggggcggtcctaatttgccccggaatagatggacttaaataaagcaaggggtacgttacc

SEQ ID NO: 78297 - protein, 103 aa, Zea mays
  misc_feature: Ceres CLONE 1563296
  misc_feature (34)..(99): Pfam Name: zf-DNL Pfam Description: DNL zinc finger
MEGPPTASKAGGAGRPEVSTLPWSLFTKSPRRRMRVAFTCNVCGQRTTSAINPHAYTDGTVFVQCCGCNVFHKLVDNLNLFHEMKCYVGPDFRYQGDAPFQLP

SEQ ID NO: 78298 - DNA, 683 bp, Zea mays
  misc_feature: Ceres CLONE 1563298
  misc_feature (42)..(42): n is a, c, t, g, unknown, or other
  misc_feature (55)..(55): n is a, c, t, g, unknown, or other
  misc_feature (93)..(93): n is a, c, t, g, unknown, or other
  misc_feature (580)..(580): n is a, c, t, g, unknown, or other
  misc_feature (581)..(581): n is a, c, t, g, unknown, or other
cacccgcgggtggcggccgctctagaactagtggatcccccngggctgcaggatnattcgtctcacccctagaaaaaaaaaaaaaaaaaaaancagcacttgcgagtggctttaaaaaaatcaatccagcacaacagcatcatggcgctcaccacgagcactaacaaccaagccttgcttgacgctcagctagagctctggcacactatcctttgctttcatcaagtccatgggctctcaagtctgcagtgggaccttggcatagcccgacgccatcccaacagccaccgggaaggaaaaggcccacccctggcccccaaaaaaagtttttcccaaggggggggggggttccccaacccgggttccaaaaaaaaaacccccccgtggccccggggggggtcccccccccctaaagggggggggggggggggttcccaaaaaaaaaccccccccgcggggggaaaatttttttttttttaaggggggggccggcccccccccccaaaaaccaaaatttttttttttcttcggggggggggaaaaaaaaaaaaaaccggggggggggggggggggggggggnnaaaaaaaaaaaaaaacccccccccccccccccccttctttgtggtgggggggggggagaggagggaatagaaaacccccccccccccggggggggggggggg

SEQ ID NO: 78299 - DNA, 835 bp, Zea mays
  misc_feature: Ceres CLONE 1563300
  misc_feature: Translation starting site: 132
  misc_feature (794)..(794): n is a, c, t, g, unknown, or other
  misc_feature (795)..(795): n is a, c, t, g, unknown, or other
  misc_feature (835)..(835): n is a, c, t, g, unknown, or other
ctccccgcggtggcggccgctctagaactagtggatcccccgggctgcaggaattcgtctcacccctagaaaaaacccatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaagcctgcaacaagttcggcgctaactgtggccctgaggctgtctgggtcaagaccggcgcgctgctcctggacggcaacaccctcaactacttcggcaacagcatccccatcaaactggtggtggccgtgatcgcggaggtcatcctcgtcggccgcgccgagtactaccggatcaccaacggactggacctagaggacagctgcaccccggtgggcccttcgaccccctgggcctgggcagcgaccccgaccaggcgnncatcctcaaggtgaaggagatcaaagacggccggctggcn

SEQ ID NO: 78300 - DNA, 808 bp, Zea mays
  misc_feature: Ceres CLONE 1563302
  misc_feature (198)..(198): n is a, c, t, g, unknown, or other
  misc_feature (361)..(361): n is a, c, t, g, unknown, or other
  misc_feature (368)..(368): n is a, c, t, g, unknown, or other
  misc_feature (369)..(369): n is a, c, t, g, unknown, or other
  misc_feature (380)..(380): n is a, c, t, g, unknown, or other
  misc_feature (381)..(381): n is a, c, t, g, unknown, or other
  misc_feature (392)..(392): n is a, c, t, g, unknown, or other
  misc_feature (419)..(419): n is a, c, t, g, unknown, or other
acccgcggtggcggccgctctagaactagtggatcccccgggctgcaggaattcgtctcacccctagaaaaactgccccctccttttcccctccctcccacacgcaccgccgcgtccgcccccttcgctgcccctgcccggtcggttccgatggggtacgtgctgtcggcggtggcgagggtgctggagcagcccacnggcgtggggggcggcccgggagatggcgctcctcgcgggccgctctgggcggggcctcctcggctctgctcgctgggctggcgccgcgctggcagctggctcgtcgccgcccccgccccccgcgcgctgcgcagccgcccttcgcacgctcggtttctggaanggccagnntcccgccagtnntcgcgccccgnttgggtccccgcgcgccgttgcgcacnggggaagaggaggaaggaagacccaagtcctcccctgccaagggccccccgaaagcggggaaaccaaagaacctgggccgggggggaaaacttggaaccctgggcaaaacctcttttaaaacccttggtggaaagggaaaagggaaaaggggggccccccggccctggaaaataaaaaaaaaaatggaaaagggttcccttttccccccccttttgaccctccccgggggggtgggggggaaaaggaaacccccccaaaaccccgggaaccccccccccggtttttcaaaaaaaggggcggccccatttttttttgggaaggcaccccccccccccccgcagaaaaaaatatgtggggcgccttcttttccctcggggggagaaaaaaa

SEQ ID NO: 78301 - DNA, 763 bp, Zea mays
  misc_feature: Ceres CLONE 1563305
  misc_feature: Encodes the peptide sequence at SEQ ID NO. 78302
ctggagctcaccgcggtggcggccgctctagaactagtggatcccccgggctgcaggaattcgtctcacccctagaaaaaatcaatgactcatttttaggctcgaggcacgatgatgaaacctgtggtgcccagcccaggctacctttacgacctggctccgccactgttggcaacttcgcccgttgcacccccggaggaccgacagcgacgacgccactactgatgccactggccaaccgtgaggacaggacaacggtcgcctctggccgcggatcggcagattcagtcttatttggtgccatggatccagtcgccggtacggcggagcatcggggaccggtggaagtgcgcgcccgcgcgcccggcaagatcatcctcacaggcgagcacgccgtcgtccacggctccgccgccgtcgccgctgccatcgatctctacaccaactcctccctcctcctccgccccgcaggcccaggagagggtggcggcgctggctccagcgcggtagagctggacctcagggactcgggcctgaccttctcatggccgtgctcgcgcctccgcgggggctggggggaagagatcagcgccaaccccggggctccggcgccgtgctccccccgacagcttgccgctattgccaggctcttgcaggaccaggacatccctggaggcaagatcttgctcctcgccggccttctcggctttcctttttcctctacactccattttttgggatgcaggcctggcaagggcagtga

SEQ ID NO: 78302 - protein, 153 aa, Zea mays
  misc_feature: Ceres CLONE 1563305
  misc_feature: SWISSPROT Homolog: EC 2.7.1.36 Mevalonate kinase
MDPVAGTAEHRGPVEVRARAPGKIILTGEHAVVHGSAAVAAAIDLYTNSSLLLRPAGPGEGGGAGSSAVELDLRDSGLTFSWPCSRLRGGWGEEISANPGAPAPCSPRQLAAIARLLQDQDIPGGKILLLAGLLGFPFSSTLHFLGCRPGKGS

SEQ ID NO: 78303 - DNA, 831 bp, Zea mays
  misc_feature: Ceres CLONE 1563306
  misc_feature: Encodes the peptide sequence at SEQ ID NO. 78304
  misc_feature (719)..(719): n is a, c, t, g, unknown, or other
  misc_feature (727)..(727): n is a, c, t, g, unknown, or other
ctggagctccccgcggtggcggccgctctagaactagtggatcccccgggctgcaggaattcgtctcacccctagaaaaagccccgtcccactattctctcgcctgcgcttccgcctcccgagttgcgccgccgtctccatctccacccctccatcctccgcggcgcccctgcactacggccatcgcactcccctcgctagcccttttcctctgtccccaccttgcccgcgcatcctccgtgcggccgtcgcggtttcttcgctggatctgcgcccgatcaccggcgggttcgcgctattcagcatggctgctgcctcctccgccacctccgtccacgacttcaccgtcaaggatgctagcgggaaagatgtggaccttagcacctataaggggaaggttctgctcatagtcaatgttgcatctcagtgtggcttaaccaattccaactacacagagctgagccagttgtatgagaagtacaaggaccagggttttgagatccttgcattcccatgcaaccagttcggtgggcaggagcctggcactaatgaggagattgtccagtttgcttgtactcgcttcaaggctgagtatccattttcgacaaaggtgatgtcaatggtgacaatactgcacccattttacaagttcctgaagtccagcaaaggtagtctcttttggcgataacataaatgggaacttctcccaaattcttggntgacaaanaggggcatgttgttggaacggtatgcaccaacaacttccccactgagcatccgagaggacatcagaaacctactagggagttcttaaaccttgtaattggatcc

SEQ ID NO: 78304 - protein, 127 aa, Zea mays
  misc_feature: Ceres CLONE 1563306
  misc_feature (10)..(118): Pfam Name: GSHPx Pfam Description: Glutathione peroxidase
  misc_feature: SWISSPROT Homolog: EC 1.11.1.12 Phospholipid-hydroperoxide glutathione peroxidase
MAAASSATSVHDFTVKDASGKDVDLSTYKGKVLLIVNVASQCGLTNSNYTELSQLYEKYKDQGFEILAFPCNQFGGQEPGTNEEIVQFACTRFKAEYPFSTKVMSMVTILHPFYKFLKSSKGSLFWR

SEQ ID NO: 78305 - DNA, 751 bp, Zea mays
  misc_feature: Ceres CLONE 1563307
  misc_feature: Translation starting site: 189
  misc_feature (70)..(70): n is a, c, t, g, unknown, or other
  misc_feature (71)..(71): n is a, c, t, g, unknown, or other
ctccccgcggtggcggccgctctagaactagtggatcccccggggctgcaggaattcgtctcacccctgnnaaaaaaaaaaaaaaaaaaaaaaaaaaaaaaaaaaaaaaaaaaaaaaaaaaaaaaaaaaggcccttgacagctgataggcaggcgataccgtaccgagagagttgaagctgaaaaagaatggcggggctctacaaaaagcagtcggaaacgtacgccaagaagcgtccgcagtaccccaaggagtggttctccatgctggccagcctcaccgcggggcaccagcgcgcctgggacgccgggtgtggcaccggccaggccgccatcagcatggcggagcactacaagagcgtggtggcgacggacgtgagcgaggggcagctccggcacgccaccgcgcacccgaaggtgcggtacctccacaccccggagcacctctcggaggacaagctggtgtcgctggtcggcggcgagggctccctggacctggtcgtggtggccacctccatccactggttcgacgtcccgctcttctacgccgtcgtgagccgcgccctgcggaagcccggcggcatggctcgccggtgtggggctacaactacgagatccacccgttcgaggacgcgctgcacgggcagctctacccgggcctgtgcggcgtacctggacccgcgggcggggactggccctggagcggtacaggtccctggccgttcccgttcgaccccccctcgggggggggg

SEQ ID NO: 78306 - DNA, 774 bp, Zea mays
  misc_feature: Ceres CLONE 1563309
  misc_feature (123)..(123): n is a, c, t, g, unknown, or other
  misc_feature (193)..(193): n is a, c, t, g, unknown, or other
  misc_feature (194)..(194): n is a, c, t, g, unknown, or other
ctcccgcggtggcggccgctctgaactgtggatcccccgggctgcaggattcgtctcacccctagaaaactctcttttcccctcccttttccagcacggggagcgacctgcgccgccgccacngatgccgaaagcactaccgccctgcgggtaagaagaagaagggatgcggcaaagtcatcacgaggaccannggcgtcactaccctgcagttagctcgcatctttaggaagctatgcatctaaaggtgtcttttcacgtcccccaagagaaaggtgaaaggtaccccaagacctactcccccccaaggaattttgcattccctcgcccctgacccctttgatccaaaaatttccgggaaatttaagggcccccccaaaggagggttaaaaaaaggctttttctaaaaaaaaaaaaggggatttttttcaaaaaaggggtttttttaattttgcccccccccaatttttaaaaaatttttaaaaggcggtttttcccttttaaaaaaaggtgccccccacacacccccgggagaaagcccccccccccccccaccttttaaaaaaacaccccccccccaaaaaggggggggcccctcttttttttttggggggaaaaaaccccgccgggtttttaaaagagaggaaaaaatttttttttgtggggtaaaaaaaaaaaattttttttttgtggcccccggggggggtttttcccccccccttttgggggggggggaggtttatttttttttccctcccaaaccccttttttttt

SEQ ID NO: 78307 - DNA, 818 bp, Zea mays
  misc_feature: Ceres CLONE 1563311
  misc_feature: Encodes the peptide sequence at SEQ ID NO. 78308
  misc_feature (532)..(532): n is a, c, t, g, unknown, or other
  misc_feature (570)..(570): n is a, c, t, g, unknown, or other
  misc_feature (598)..(598): n is a, c, t, g, unknown, or other
ctggagctcaccgcggtggcggccgctctagaactagtggatcccccgggctgcaggaattcgtctcacccctagaaaaaacggagctcgagcagccagcgacgacaacccacgcgcacaccaaccaacaagccacaccggcccacaggccacagctcaccagctaggctagcaaccacctcgatcgcagaggcagaggccgccggaagctcagccgtgaattcggcaggaaggaaaggaaaaagtcttgggtggtttcaacaagagatagaagatggagaaggcagggcagcacgagcatgtgatcggcatccccgtgaacaacagggcgttcggtatcgaggagccagatttccccagcaatggccccgccaagaacgcagccgccggcgccgggggacggcgccgggtgaccggggacagggtcgcccaaggcctgaaagagcacgtgacgctgggcccgaagctgtacgagaccgtgaagggcaagctgtcgctggggggcgaggatcctgcgggcgggcggcgtggnggaaagtgttccggcgcctgggttctcctcccccgtcngcgggggcggcgagcggctgctcagggncgtcgcagtgctacctgtcgaccacgcccggcccgatcgccggcatggctgttcgtgtccaccgaaaagggtcgcgttccggaacgaccgcttcgctggcgcttgccgcttgaagtcttccggccgggcggcggcagcggcagcggcaacaactacgggtggctgcggtggccctttacaaggtggtcaatccccctttcccaagggtcgcgggcggccc

SEQ ID NO: 78308 - protein, 181 aa, Zea mays
  misc_feature: Ceres CLONE 1563311
  misc_feature (99)..(99): Xaa is any aa, unknown, or other
MEKAGQHEHVIGIPVNNRAFGIEEPDFPSNGPAKNAAAGAGGRRRVTGDRVAQGLKEHVTLGPKLYETVKGKLSLGGEDPAGGRRGGKCSGAWVLLPRXRGRRAAAQGRRSATCRPRPARSPAWLFVSTEKGRVPERPLRWRLPLEVFRPGGGSGSGNNYGWLRWPFTRWSIPLSQGSRAA

SEQ ID NO: 78309 - DNA, 779 bp, Zea mays
  misc_feature: Ceres CLONE 1563312
  misc_feature: Translation starting site: 308
  misc_feature: SWISSPROT Homolog: EC 2.3.3.10 Hydroxymethylglutaryl-CoA synthase
tggagctccccgcggtggcggccgctctagaactagtggatcccccgggctgcaggaattcgtctcacccctagaaaaagacgacgctgacgcggctgaaaatttccacgaacacatagatccgcatcgtcgatccatccgtcctcctcccgacggtacgccagcctgccagagtccgacgcacgcctagggctcctggacacagcagagcccacgccttgactcgctccgttcgagtggagcgcacaggcaccggccggcgaccagagagggagcggatcgagggggctcggcttgagtggaggagatggaccgcaaggatgtcgggatcctcgccatggacatctacttcccgccctcctgcgtgcagcaggaagcacttgaggcccatgatggggcgagcaaaggcaagtacaccattgggcttgggcaagattgcatggccttttgcagcgagggtggaggatgtcatctcaatgagttttgacggttgtcaattctctgctgaaaaaatacaagattgatcccaagctaattggtcgcttggaaaggtggaaagtgaaacagttatagacaaaagcaaatccatcaaaaacttggctgatgcagattttttgaggaaagtgataatactgacatttgaaaggtgttgactccagcaatgcattgtttattggtgggacagcagcccttaccgaaattgggggggaattgggggcgaaaagtaactccctggggaatggccggtttgggggcccttgtcgttttgcaccggaaaa

SEQ ID NO: 78310 - DNA, 841 bp, Zea mays
  misc_feature: Ceres CLONE 1563313
  misc_feature: Encodes the peptide sequence at SEQ ID NO. 78311
  misc_feature (780)..(780): n is a, c, t, g, unknown, or other
  misc_feature (802)..(802): n is a, c, t, g, unknown, or other
ggagctccccgcggtggcggccgctctagaactagtggatcccccgggctgcaggaattcgtctcacccctagaaaaaagcaacgcgaccgctgccacccctttgcggaatcgcggcttcggcctccggcctcggcggctcagccaaccacgacgccgccgtgcgcgccagcctccgtgggacacggctgccggcttcggtccgctctcggctctcgcccctcaggcctcagccacgccgcacgcggccggcacggcggcgcccgcctccacggctccgcgccgcggccccagccacgctacacgcggccacgccgcacgccagcacgctcagccgcgcgcccgcccgcctgctcggctcctcccctgctcctgctcggctgctccgtggagcctgatccatggcggataaggatgcggcggctatgtggggcggcggcaacaagctcattctgcgcggtcttcagttcaatggcttccacagtgtccttcaggaggagaagacgttgggacagatgttcgtggctgacatcaacatctggatggacctcgccgctgccggcgagtccgactgcatcgctgacactgtcagctacacctatatctacagcattgcataggatgttgtcgagggcacgcgacgcaacctgttggtagtcggatagctcactcgatcgcagaggccacgctgctcgaggtccctcagatctccgcaggccagagtgatgcgtggcgagcctcacatcacgggggcgaggcgtactagaactgctggggctgnagataacgacgcccccaagaangatgcgatgctgttaacaatgtagtgaatggtgaccagg

SEQ ID NO: 78311 - protein, 72 aa, Zea mays
  misc_feature: Ceres CLONE 1563313
  misc_feature: SWISSPROT Homolog: EC 4.1.2.25 Dihydroneopterin aldolase
MADKDAAAMWGGGNKLILRGLQFNGFHSVLQEEKTLGQMFVADINIWMDLAAAGESDCIADTVSYTYIYSIA

SEQ ID NO: 78312 - DNA, 799 bp, Zea mays
  misc_feature: Ceres CLONE 1563314
  misc_feature: Encodes the peptide sequence at SEQ ID NO. 78313
  misc_feature (696)..(696): n is a, c, t, g, unknown, or other
  misc_feature (739)..(739): n is a, c, t, g, unknown, or other
ggagctccccgcggtggcggccgctctagaactagtggatcccccgggctgcaggaattcgtctcacccctagaaaaatccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcggggccggcgcggacccgagcgccatcgcgcccttctccttcgggtcgctgctgggcacgcagctgctgctgatggggtgggggtggaatccaacccggttgggtggacttcttcaacccggactcccaaggccgtggagtgggcccacgccgtggtcggcgcaccgctgagaacttcgccaatcttcaccggccgagcaggggctaccccgggncggcaagttctttcgaccccgttccgccctcgccggcacccgncaaaggacagcggtctaaaattcccccgaagtcgaacaagctcgaagcggctcaaggctg

SEQ ID NO: 78313 - protein, 170 aa, Zea mays
  misc_feature: Ceres CLONE 1563314
  misc_feature (54)..(171): Pfam Name: Chloroa_b-bind Pfam Description: Chlorophyll A-B binding protein
MALAPTSAAVLKTPFLGARRALAKPAPRRALVIAAAAAAKKSWIPAIKSDAEIVNPPWLDGSLPGDFGFDPLGLGKDPAFLKWYREAELIHGRWAMAAVLGIFVGQAWSGIPWFGAGADPSAIAPFSFGSLLGTQLLLMGWGWNPTRLGGLLQPGLPRPWSGPTPWSAHR

SEQ ID NO: 78314 - DNA, 753 bp, Zea mays
  misc_feature: Ceres CLONE 1563315
  misc_feature: Encodes the peptide sequence at SEQ ID NO. 78315
ctccccgcggtggcggccgctctagaactagtggatcccccgggctgcaggaattcgtctcacccctagaaaaaaaaccctacccgactccgccgccgctccgccgccgctccgcctcagcgcatcgccctccgccacagcgtaccgcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaagaagctgcgcaaggcgaaaaaggatgctcctgctggtgagaagccagagccagtcaagacacatctccgtaacatgatcattgtccctgagatgattgggagcattgttggggtctacaacggcaagacattcaaccaggttgagatcaagcctgagatgatcggccactacccttgctgagttctccatctcctataagccggtcaagcatggcaagccccggtatcgggtgccaccccactcctcgcggttttattccctctgaaaatgaggctgttaccccggtctcttgtagtcccccccaaaaaaatcccgtttgggcaaatgccccttttccagcttttttcccaacctgggtttgagaaaaaaatttaaag

SEQ ID NO: 78315 - protein, 125 aa, Zea mays
  misc_feature: Ceres CLONE 1563315
  misc_feature (55)..(123): Pfam Name: Ribosomal_S19 Pfam Description: Ribosomal protein S19
MADVDVEPEVAAGAPKKRTFRKYSYRGVDLDALLDMSTDDLVQLFPARARRRFQRGLKRKPMALIKKLRKAKKDAPAGEKPEPVKTHLRNMIIVPEMIGSIVGVYNGKTFNQVEIKPEMIGHYPC

SEQ ID NO: 78316 - DNA, 772 bp, Zea mays
  misc_feature: Ceres CLONE 1563316
  misc_feature: Encodes the peptide sequence at SEQ ID NO. 78317
  misc_feature (648)..(648): n is a, c, t, g, unknown, or other
ctcaccgcggtggcggccgctctagaactagtggatcccccgggctgcaggaattcgtctcacccctagaaaaaacccccacgtctcaactttatagccgccccctccccaccgccgcggccgccacgcgcagcagcaacccggtagcaggagcgcagccagcaagctcagccccccagccctactgccaccgcgccgaacgccatggccgagccggcagagcaccgtccagcggaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctaccggttcgacaaggaggggaaccagtggaaagagcgcggcacaggcactgtgaagctgctcaagcacaaagacaccgccaaggtccgcctcgtcatgcgtcaggcgaagacgcttaagatctgcgccaaccatctcgtggtggcgacgactaagatgcaggagcacgcggggagcgacaagtcgtgcgtgtggcacgcgctggacttcgccgacggcgagctcaaagaagagatgtttgctatccggttttggatctgtcgagaattgcaaggngttccaggaacactgttgaaaaagatagctggaccagccagggaaaggagcgaggggaaaaaaaaatggtggaagtcttccactggccggcttcctgatttttggcacaagaaagttaaacaat

SEQ ID NO: 78317 - protein, 189 aa, Zea mays
  misc_feature: Ceres CLONE 1563316
  misc_feature (38)..(164): Pfam Name: Ran_BP1 Pfam Description: RanBP1 domain
MAEPAEHRPAEEEEAAAAGEDEDTGAQVAPIVKLEEVAVTTGEEDEDALLDMKAKLYRFDKEGNQWKERGTGTVKLLKHKDTAKVRLVMRQAKTLKICANHLVVATTKMQEHAGSDKSCVWHALDFADGELKEEMFAIRFWICRELQGVPGTLLKKIAGPARERSEGKKKWWKSSTGRLPDFWHKKVKQ

SEQ ID NO: 78318 - DNA, 783 bp, Zea mays
  misc_feature: Ceres CLONE 1563322
  misc_feature: Encodes the peptide sequence at SEQ ID NO. 78319
ggagctccccgcggtggcggccgctctagaatagtggatcccccgggctgcaggaattcgtctcacccctagaaaaaaacctgctgctcgagctcgacctacgagcgcgcgcaccaccacccccacccacacccccacccgatcccgatctcaccgtctccaccccgaccccctcccaccaatctccaacagcatctaatcaatcaagacagccccgcgctagctcacccgccggggctcgccacgatgagaggcctcctcgcgtgcgccaccctcgcccgccgcgccgccgcctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtggcccacatgtgcggcctcagcctcaagggccgcgaggccatccccttcctcgagtccctcgtcgtcgccgacgtcgccgcgctctaggacggcaccggcaccctcaacgtcttcaccaacgagcaaggcggcgccatcgacgactccgtcatcgccaagggtcacgaacaacacattctacctcgtcgtccacgccggatgcaggggacaagaacctcgccaacatcggaggcgcccatggaggcccttcaacaaagaggggcgggggacgtcaagtgggac

SEQ ID NO: 78319 - protein, 113 aa, Zea mays
  misc_feature: Ceres CLONE 1563322
  misc_feature: SWISSPROT Homolog: EC 2.1.2.10 Aminomethyltransferase
MRGLLACATLARRAAASSAPARVRHLAGAAEAAEAELKRTALYDFHVAHGGKMVPFAGWSMPIQYRDSIMDSTVNCRANGSLFDVAHMCGLSLKGREAIPFLESLVVADVAAL

SEQ ID NO: 78320 - DNA, 858 bp, Zea mays
  misc_feature: Ceres CLONE 1563323
  misc_feature: Encodes the peptide sequence at SEQ ID NO. 78321
  misc_feature (645)..(645): n is a, c, t, g, unknown, or other
  misc_feature (650)..(650): n is a, c, t, g, unknown, or other
  misc_feature (760)..(760): n is a, c, t, g, unknown, or other
ctccccgcggtggcggccgctctagaactagtggatcccccgggctgcaggaattcgtctcacccctagaaaaaatgacaaatacaatacagaagaagttcaaggtatcttcgacacagctcctgtaccaatcgtgcccataccaagcattgactttgttcctcgtcggcccattccttgatgggtttttgactaaccaaaacgtctttgctttcgactacacaactcaagtcctgttcttcatcgtgctgtcgtgcctgatctcggtctcggtaaacttcagcactttccttgtgatcgggaagacgtcgcctgtaacctaccaagttctcggccacctgaaaacgtgcttggtcctcgccttcggctacgtcctgctccacgacccgtttagctggagaaacatacttggaatcctgatcgcggtgatcgggatggttctgtactcgtacttctgcactagagagactcagcagaagccggcagaggcctccccgcaagccatccaggcaaaggagggtgaatcgagccctctgatcttggattccctgagcgccgctgaaaacgggggcagtgccaccgacgacgagcctctgaaggtgccaatgtgggagctcgaagtaactccaagcgtgaaaggctgtncttgnttactggtgtactacggcgctatacagaatccagcttggtaggcagataccatactactactaggggtggaaggcaatccctgttccctgttcatgttccatttttgggnccctcaatttttttcctttcctggttttcctcccttttctgcatatacctaccaatatatttttgcctgctgggtgctgttttagaaatgggatctcc

SEQ ID NO: 78321 - protein, 205 aa, Zea mays
  misc_feature: Ceres CLONE 1563323
  misc_feature (1)..(126): Pfam Name: TPT Pfam Description: Triose-phosphate Transporter family
  misc_feature (191)..(191): Xaa is any aa, unknown, or other
  misc_feature (192)..(192): Xaa is any aa, unknown, or other
MTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLAFGYVLLHDPFSWRNILGILIAVIGMVLYSYFCTRETQQKPAEASPQAIQAKEGESSPLILDSLSAAENGGSATDDEPLKVPMWELEVTPSVKGCXXLLVYYGAIQNPAW

SEQ ID NO: 78322 - DNA, 746 bp, Zea mays
  misc_feature: Ceres CLONE 1563324
  misc_feature: Encodes the peptide sequence at SEQ ID NO. 78323
ctccccgcggtggcggccgctctagaactagtggatcccccgggctgcaggaattcgtctcacccctagaaaaaaaaaaagacgcaatacacatacagcccctcttgcccacaccacctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgctacgccgccgagatccgcgaccctgccaagaaaagccgtgtgtggctcggcacgtacgacacggccgaggaggccgccaaggcgtacgattccgccgcccgcgagttccgaggcgccaaggccaagacgaacttcccgttcccctcccagtgctccgtcgcctccggtgctgccggtagcgccagtagcaacagcaccgtggattcgagcggtggcggtagcggctgtggcatccaggcgcctatgcaggccatgccgcttcctccggctctcgatctcgacctcttccatcggggcggccgccgtgaacgcagtctccaccggcatgcggtttccgttcaagggctatcctgtcgcctgcccgacgccacagcagtactttttctacgagcaagcggctgccgcggcatccggataccggatgctcaaggtcgcctcaccgggccgtgactg

SEQ ID NO: 78323 - protein, 193 aa, Zea mays
  misc_feature: Ceres CLONE 1563324
  misc_feature (32)..(83): Pfam Name: AP2 Pfam Description: AP2 domain
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASGAAGSASSNSTVDSSGGGSGCGIQAPMQAMPLPPALDLDLFHRGGRRERSLHRHAVSVQGLSCRLPDATAVLFLRASGCRGIRIPDAQGRLTGP

SEQ ID NO: 78324 - DNA, 825 bp, Zea mays
  misc_feature: Ceres CLONE 1563325
  misc_feature: Encodes the peptide sequence at SEQ ID NO. 78325
  misc_feature (774)..(774): n is a, c, t, g, unknown, or other
ctccccgcggtggcggccgctctagaactagtggatcccccgggctgcaggaattcgtctcacccctagaaaaaaaccaaggcttggattagcctcgccgaggaggaggtggtggtcggcgaggggctcgcggggatggggatctcgaggccccttgtggtggcgatggcggtggcgctgctgatcgccgtcgccggtgcgaccgccgaggagcaggagcccctgctggcggcggacgcggtggccggcgcggtggaggcggcgctcagggccgagctggggcaactccgggcgaagatctcggcgctagagtcagacatagaagagcgatctcaagaactgaagaataaggatgatgccatcatgaacctggagaaagccattgaagagaagtcaaaggctattacctctatgctggacgagattgcttccctccaggcaaaagggtctgtagctgccgaggagcaggctaacaaggccaatgccaaggttgttgagcttgagaagcaggttgacaagatcaaaaaggatattgaagcacaaagcagccagaaagcagcactagagtatagggccaacgatgcagagaagaacgtggaagtactgaatgaaaagcttaatacaatccaaaaggaaagtgatgagaaaaaacgcaaaatcagaaggacagaacgtgctcttaaagtcgctgacgatgaattatggaggttgcagtttagagggacctgctaaatccaaacaccttgtcgaaggtccatggagcatgggttcccncccttggctaatggaaccattttgcttgttaatggcggaggttggtctccg

SEQ ID NO: 78325 - protein, 198 aa, Zea mays
  misc_feature: Ceres CLONE 1563325
MGISRPLVVAMAVALLIAVAGATAEEQEPLLAADAVAGAVEAALRAELGQLRAKISALESDIEERSQELKNKDDAIMNLEKAIEEKSKAITSMLDEIASLQAKGSVAAEEQANKANAKVVELEKQVDKIKKDIEAQSSQKAALEYRANDAEKNVEVLNEKLNTIQKESDEKKRKIRRTERALKVADDELWRLQFRGTC

SEQ ID NO: 78326 - DNA, 824 bp, Zea mays
  misc_feature: Ceres CLONE 1563327
  misc_feature: Encodes the peptide sequence at SEQ ID NO. 78327
  misc_feature (672)..(672): n is a, c, t, g, unknown, or other
ggagctccccgcggtggcggccgctctagaactagtggatcccccgggctgcaggaattcgtctcacccctagaaaaactcgcgtcgattgcttgcccagctcgcttcctcttcgtcttccttctcccccttctcctcgcctgccggttaaccgccacagcctggattcgccttctcccgcggcggcgcggccggccgctgctgctgcgtcggcgcgtgagatggatgattgcggcggcggcggcggcaagaggccgttccagctggcgcggtcgctgacgtaccaccaccacccggggcaccggccggcggccgcgtccaggtggcggcggcagcaccagcagcatcagctcgcggacgagccgcgcgcgccccggccgcaggcggtggttctgtacactacgtcgctgcgcggggtgcggcgcacgttcgcggactgcgccgcggtgcgcgccatcctgcgcggcttccgcgtggccgttgactagcgggacgtgtccatggacgcggcgctccagcgggaggtccatgagctgctggccgcgcgctgtcgcgccttcgcgctcccgcagctgctcatcggaggccgcctcgtctgcggcgcggacgaggtgcggcatctgtacgagaccggacagctccggcgcctactcaacagcgcggacggggcangaccctgaccttcgtctgcgacgactgtggacagacgtccggttcgtcactttgcagccggctgcggtagcggccgctaaggtgtttcgtcctaggatgtagggtcgccgtccttctgcctacgtccaattgcaaccaatcaactggcttgg

SEQ ID NO: 78327 - protein, 88 aa, Zea mays
  misc_feature: Ceres CLONE 1563327
MDDCGGGGGKRPFQLARSLTYHHHPGHRPAAASRWRRQHQQHQLADEPRAPRPQAVVLYTTSLRGVRRTFADCAAVRAILRGFRVAVD

SEQ ID NO: 78328 - DNA, 849 bp, Zea mays
  misc_feature: Ceres CLONE 1563334
  misc_feature: Encodes the peptide sequence at SEQ ID NO. 78329
  misc_feature (688)..(688): n is a, c, t, g, unknown, or other
ctacccgcggtggcggccgctctagaactagtggatcccccgggctgcaggaattcgtctcacccctagaaaaagcagcacttgttcctctgctgctcgcccacctactcctctgcgtccatggcgccaccgttacctcggtcgccacgccgccgcctctcccggtcctgcccgtcccgtcctacgcgcagctccggtggcagctctccgagatggcgctcttccttcacttcgggcccaataccttcacggactccgagtggggcaccggccacgctgacccctccgtgttcgctccctccgcactcgacgcgggccagtgggcgcgcatcgcggcgcagggcgggttcggccgcgtcgtgctcacggccaagcaccacgatggtttctgcctgtggccgtcggcactgaccgagtactcggtggccgcctcgccgtggcagggcggggctggggacgtcgtcgcagagctcgccgcagctgcgcgcgcggaggggcttgggctgggcctgtacctctcgccgtgggaccgccacgagccggtgtacggggacaccatcgcgtacaacgagcattacttgggacagatgacagaattgcttaccaggtatggagaatgtagaggaagtttgggctagatggtgcaaaaggcgacgccaagaagaatggattatatggtttgatgccntgtttttcacttatacatcagctaacaagaaagggtagttaatcttctcagatgctggaccagatactagatggggtggggagaatgaaggccaggatccccaaggctatactttgctgggtctccccttcaacaaagagctctgtggacattttgggcat

SEQ ID NO: 78329 - protein, 211 aa, Zea mays
  misc_feature: Ceres CLONE 1563334
  misc_feature: SWISSPROT Homolog: EC 3.2.1.51 Alpha-L-fucosidase
TRGGGRSRTSGSPGLQEFVSPLEKAALVPLLLAHLLLCVHGATVTSVATPPPLPVLPVPSYAQLRWQLSEMALFLHFGPNTFTDSEWGTGHADPSVFAPSALDAGQWARIAAQGGFGRVVLTAKHHDGFCLWPSALTEYSVAASPWQGGAGDVVAELAAAARAEGLGLGLYLSPWDRHEPVYGDTIAYNEHYLGQMTELLTRYGECRGSLG

SEQ ID NO: 78330 - DNA, 714 bp, Zea mays
  misc_feature: Ceres CLONE 1563342
  misc_feature: Encodes the peptide sequence at SEQ ID NO. 78331
  misc_feature (323)..(323): n is a, c, t, g, unknown, or other
  misc_feature (598)..(598): n is a, c, t, g, unknown, or other
  misc_feature (644)..(644): n is a, c, t, g, unknown, or other
ctccccgcggtggcggccgctctagaactagtggatcccccgggctgcaggaattcgtctcacccctagaaaaaagcagccagcagcgggggctggagcactcaccactcagcagcgatcgcagcaccgcggcgagataatgagcagcagcctgtcctccggcatctctgcctcgccatctgcagcggccagcaccgctcggcgccgccatgacgcagcgccgcagcagctgacgagggtgaaggcggcggcgcggccacagctgctgcacgccggccgccggcgttcgagtgtcgggaggaggccgggcggcggcgcggtgngtggtgagggccgggcctgggccactgtcggagatcgagccggacctggaggaggacgccatcgacgtgtaccgcaccaacggcatcagcccggaggacttcgagtacgggaagtatgacggacaccacacctatttcgaaggtcaagacaagaaggggcttctgggagggatgtctccgagtggtaccaagaagctgagcctcctcagggctttcaagcactcatctcctgggcatttcctcctgcgatcatcctcggcatggctttcaatgtngccgggggagtacctgtacatcggggcggccgtcttccatcgtggntgttctgcgtcatcgagatgggcaagcccgacaagctgcacaacttcgagccggagatctcatgggaagg

SEQ ID NO: 78331 - protein, 43 aa, Zea mays
  misc_feature: Ceres CLONE 1563342
  misc_feature (21)..(21): Xaa is any aa, unknown, or other
MAFNVAGGVPVHRGGRLPSWXFCVIEMGKPDKLHNFEPEISWE

SEQ ID NO: 78332 - DNA, 738 bp, Zea mays
  misc_feature: Ceres CLONE 1563343
  misc_feature: Encodes the peptide sequence at SEQ ID NO. 78333
ctccccgcggtggcggccgctctagaactagtggatcccccgggctgcaggaattcgtctcacccctagaaaacctactagaaaaatccattcccatcccattccccactctactcattcagcagatcccgtcactcgctctccacaagcagagcaccgcagcagaacgaggaaggatgctggccatcttccagaagcaggtggcgcacgcgccgcaggagctcaacagcccccgcgccggcgcgtcgcccagcaagccccggaaccccgacgagatcctgcgcgacttccacgccgcgcacccggccgccgccttctccgcctccttcggcggcggcgccgcgctcgcctgcgtcggcccctcctcctccgcaccgccaccggcaccgccacctaccagcggatgttctgcggcctggaccacatctactgcgtcttcctgggccgcctcgacaacctcagcggcctcatccgccagtacgggctgtgcgggcgctccacaacgaggcgatgctggtcatcgagggcctaccgcacgctgcgcgaccgcgggccctacccggccgaacaaggcgtcaagggacctcgccggggcttcgcccttcttcgtcttcaaaagccgcttccggggcccgtctttccccgccccttgggggccccccaaaaccccgggggaaacccccggggccccccttttattggggggggtccccgggcccaaaagggggcccccccggg

SEQ ID NO: 78333 - protein, 187 aa, Zea mays
  misc_feature: Ceres CLONE 1563343
MLAIFQKQVAHAPQELNSPRAGASPSKPRNPDEILRDFHAAHPAAAFSASFGGGAALACVGPSSSAPPPAPPPTSGCSAAWTTSTASSWAASTTSAASSASTGCAGAPQRGDAGHRGPTARCATAGPTRPNKASRDLAGASPFFVFKSRFRGPSFPAPWGPPKTPGETPGAPLLLGGVPGPKRGPPR

SEQ ID NO: 78334 - DNA, 784 bp, Zea mays
  misc_feature: Ceres CLONE 1563344
tgggctcccgcggtggcggccgctctagaactagtggatcccccgggctgcaggaattcgtctccccctagaaaaaatctcagtcttcacactcctcgccatcacataaaaccagtgcaagcagaagcagcgcaatgggcgagcagcaccatggccctctcctccacagccttcccggcaagcagtgaactgccgtctctctctcggcgagccgcgtgacatgcgcagacggcgcgaagcaagccggcgcgagctcggcagcccgtgtacggcccgacgcgtgctctacctgggccgctgtccgcgcgccccgagctactgacgggcaagtcccgggcgactacggctgggaaccgcgggggctgtccgcggaaccggaaaacgtcccccaaaaacggggaccgggaaggccacccctccccccctgggccattcctgggcccccttgggcctccctttttcccccgggaattgttccccccccaaaagggggttttaattttcggcaaaaaggcccctttgggttttaaagggccgggggccccaaaaaattttttcccaaaaggggggggggggtgaaaaaaaccccccggaaaacccccgaggccggtttttcacccgccccgaaaaaaactccccccccccccttgggggccccccccaagggtgttgcgcctttaggggggcccccccaaagggggggaaaaaatattccccgggggggcccccccttcaaaaaaagagggtgaaaaacccctttttccccgggcggggggtgtttttc

SEQ ID NO: 78335 - DNA, 834 bp, Zea mays
  misc_feature: Ceres CLONE 1563345
  misc_feature: Encodes the peptide sequence at SEQ ID NO. 78336
ctccccgcggtggcggccgctctagaactagtggatcccccgggctgcaggaattcgtctcacccctagaaaaactcgcgtcgattgctggcccaactcggcttcctctgcgtcttcctgatcccccttcacgtcgcctggggtggaccgccacagcctgcatgcgccttctgccgcggcggggcggcatgccgctgtctgctgcgtgcgagcgcgtgagatggatgattgcagaggccgcggccgatacaggccgttcctgctggcgctccctctggacattaccaccaccacccggggcacctgacggcggccgcgtcctggtggcggcggcagctccatcagcatcatctcacggacgagcctcgcgcagcactgccgcatgcagcggttctatacactacctccttgcacatggtgcggatcacattcacggactgcgccgctgtgcgctccatcctgcactgatgccaactgacctgtgactaacgcgaagtgtccatagacacgatgctcaagtgcgcagtccaggatctgctggactgcacgtgtcacgccttttgtcgtccgcagctgctcatacgaggccgactattctgcgtgcggatgaagtatcgcatccttaacgagacggaccacctcggagccctatgaaaatgggggaccggtagtacccggacctcggctgccaccaccggtaaagagcccccttttgttccattggaacagacctcccagggggccaaaagggttttcctgggagattcggtcccttcttttccttaggggcaagttaaaaaaaacaggttttgtaaaaaaaaattaatgtttgta

SEQ ID NO: 78336 - protein, 47 aa, Zea mays
  misc_feature: Ceres CLONE 1563345
MLKCAVQDLLDCTCHAFCRPQLLIRGRLFCVRMKYRILNETDHLGAL

SEQ ID NO: 78337 - DNA, 740 bp, Zea mays
  misc_feature: Ceres CLONE 1563346
  misc_feature: Encodes the peptide sequence at SEQ ID NO. 78338
ctcaccgcggtggcggccgctctagaactagtggatcccccgggctgcaggaattcgtctcacccctagaaaaaggccgttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaacctccaggtgtcgcacccgaccaaggaggcgcccgtcatcgactacaagctcgcgttgctcttccagcccatgcttatgctcggcataaccatcggcgtagagctcagcgtcatcttcccatactggctaatcactgtcctcattataatcctcttcgtaggcaccttcgtcc

SEQ ID NO: 78338 - protein, 193 aa, Zea mays
  misc_feature: Ceres CLONE 1563346
MVMEGRTGSLYGRLNKSSTRGFLAYTAAGAACAAVLACFVLSAADSPASAARNDGARLRLSSRSPRVWPDLAFNWRVVVATVVGFLGSAFGTVGGVGGGGIFVPMLNLVVGFDTKSAAALSKCMIMGASASSVWYNLQVSHPTKEAPVIDYKLALLFQPMLMLGITIGVELSVIFPYWLITVLIIILFVGTFV

SEQ ID NO: 78339 - DNA, 786 bp, Zea mays
  misc_feature: Ceres CLONE 1563348
  misc_feature: Encodes the peptide sequence at SEQ ID NO. 78340
ctggagctccccgcggtggcggccgctctagaactagtggatcccccgggctgcaggaattcgtctcacccctagaaaaagagcgctgagcagatctttccttgtttctccattccggtacgaaggggtggggtccaagtgaagggaagggaagggaagagaaggcctgctgcgagcgatgggcatcgtcgacgtcgtctccgagttctgctccttgccgaggactcgccggcatctcaagaagaggaagcagttccaggtatatataaaccatcttcttctgtttctgttcggggtcttatcccagccagcccaacagctgaactggactcgccgcagacggtggagatgaaggtgcgcatcgactgcgaagggtgcgagcgcaaggtgaagaaggcgatggagggcatgaagggcgtgagctccgtggaggtggcggccaagcagaacaaggtgacggtcacgggctacgtggacgccgccaaggtcatgcgccgcgtcgcctacaagacgggcaagcgggtggagccctggccctacgtgccctacgagatggtgcagcacccctacgcgccgggcgcctacgacaagaaggcgcccgccggctacgtccgcaacgtcgtcgccgaccccaccgccgcgccgctcgccaggtcctcctccaccgaggtccgctacaccgccgccttcagcgacgagtacccctacgcctgctccggtcatgtagtagtaccacccacacaccgaccgaccgacccacttgttttctagctactcctcgttttt

SEQ ID NO: 78340 - protein, 140 aa, Zea mays
  misc_feature: Ceres CLONE 1563348
  misc_feature (1)..(61): Pfam Name: HMA Pfam Description: Heavy-metal-associated domain
MKVRIDCEGCERKVKKAMEGMKGVSSVEVAAKQNKVTVTGYVDAAKVMRRVAYKTGKRVEPWPYVPYEMVQHPYAPGAYDKKAPAGYVRNVVADPTAAPLARSSSTEVRYTAAFSDEYPYACSGHVVVPPTHRPTDPLVF

SEQ ID NO: 78341 - DNA, 839 bp, Zea mays
  misc_feature: Ceres CLONE 1563349
  misc_feature: Encodes the peptide sequence at SEQ ID NO. 78342
ctccccgcggtggcggccgctctagaactagtggatcccccgggctgcaggaattcgtctcacccctagaaaaaaccacaccacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgccgccgagggctcgtgggtgcccgaccccgtcacgggccactaccgccccgccaactgggccgccgccgtcgaccccgccgacctccgcgccgcgcacctcgcccgcacctacgcccgggcctgagcggccccggctcccttcaccctgctccgcctcgtctcgtatgacatacgcgcaccgtaccagggtgagacgaggtgggggctggggggttcgtgtggcgaacggcgtgttgagccacgcgcgcgtgcggccgcgctctgcgacgcccgggacgttcttgggagagcgcgagcgaggtctcttgtcttctcgggtgcggtcgctgtgccatgagatgtgacgctgggttcgtttttggtccgaccaacgggagaaaagcggcctgtggtcggtggtcccccgcctgtgttgggctggaggcctgctctcctgtgctcctcctattaaataagatgtacctcctcccaag

SEQ ID NO: 78342 - protein, 95 aa, Zea mays; identical to SEQ ID NO: 58232
  misc_feature: Ceres CLONE 1563349
  misc_feature (1)..(89): Pfam Name: LEA_3 Pfam Description: Late embryogenesis abundant protein

SEQ ID NO: 78343 - DNA, 837 bp, Zea mays
  misc_feature: Ceres CLONE 1563351
  misc_feature: Encodes the peptide sequence at SEQ ID NO. 78344
  misc_feature (636)..(636): n is a, c, t, g, unknown, or other
  misc_feature (685)..(685): n is a, c, t, g, unknown, or other
  misc_feature (750)..(750): n is a, c, t, g, unknown, or other
  misc_feature (791)..(791): n is a, c, t, g, unknown, or other
agctccccgcggtggcggccgctctagaactagtggatcccccgggctgcaggaattcgtctcacccctagaaaaacagagactaccagcggaaagttcaggagatgaatgaggaaatgaaaactcttgatcgtgagctagctcgtgcaaaggtttcagcaaatagggttgcagtagtggtggcaaatgagtggaaagatggcgatgataaagtaatgcctgttaaacgatggctcgaggagcgaaggattctgcaaggagaaatgcagcaactccgggacaaacttgctattgcagaaagggctgcaagatcagaagctcaactgaaagagaagttccagctacgacttaaggtactcgaggaaggattgagaatgtctacatcgagaaccaatgtcagtggcacacgccgccagtctattggtggtgctgatggtttgtctaaggccaacggcttcctgtcaaaacgcccatcattccagatgagatcatcagtgtctaccacaacgactctagtgaaccatgcaaaaggagcgtccaagtcgtttgacggaggctgtagatcacttgaacgctataagggccatgtaaacggggaatggtatgaacgtatctaccgattccagtgaagataangattcaaacactcagatgagaagtgtaacgagtttgcatctgctgatcngaagatcggtgtcaggtgttctatttgatatgttgaaaaaagaagtcatttccctaaggaaagcntgcccccaaaaggatccgagctgaagaaaaggcaacccccnttgaattgtggcaaaaaaggaaaactttgaaaaaaccttgggatcc

SEQ ID NO: 78344 - protein, 174 aa, Zea mays
  misc_feature: Ceres CLONE 1563351
  misc_feature (1)..(175): Pfam Name: Myosin_HC-like Pfam Description: Myosin II heavy chain-like
MNEEMKTLDRELARAKVSANRVAVVVANEWKDGDDKVMPVKRWLEERRILQGEMQQLRDKLAIAERAARSEAQLKEKFQLRLKVLEEGLRMSTSRTNVSGTRRQSIGGADGLSKANGFLSKRPSFQMRSSVSTTTTLVNHAKGASKSFDGGCRSLERYKGHVNGEWYERIYRFQ

SEQ ID NO: 78345 - DNA, 821 bp, Zea mays
  misc_feature: Ceres CLONE 1563353
  misc_feature: Encodes the peptide sequence at SEQ ID NO. 78346
ggagctcaccgcggtggcggccgctctagactagtggatcccccgggctgcaggaattcgtctcacccctagaaaaaactaatctattctctatctctagcagtggtaccatttggcggcgatcgccgtgctattgcttgggccttggactgagtaggtttggaggtagcgatacgagacactcgcccccgattcccctcccgttgccgaagcctgtgttgcagggatcgttcgcggaagcggtttttgatcggagagagagaaagagagagcgaggaggaaggtgggggatggacgcggcggcagcggcggcggcgcagatggagaggcactcgtcagcggcagcgcacatggagaggaactcgtcggcgaccgccttcatggagggcggcgttcaagaccgctgcgatgacacctgcaggcatctgcctggagacattctccgacagtgaccactccgcggtgaccagctgcaagcacgagttccacctccagtgcatcctacgattggtgcagatgaagctccagtgccccatgtgatggccacggaatcaggatgcatcgatcctacgagccaaaaactcctctgaggccgccaagaaagagcggaacgacgtgcaggaaaaaccaggcgcgcactagcaccctttttccagcacccgacggctccgaaaacttcgaagggccccgtggatggctgaccaacccccaaattcagggagggggatcttgcagccaacttgggcccccgcccggggccctttttttcggggggtaaccgccccccgccccaaacaatataggccgccccctataaaggt

SEQ ID NO: 78346 - protein, 43 aa, Zea mays
  misc_feature: Ceres CLONE 1563353
MTPAGICLETFSDSDHSAVTSCKHEFHLQCILRLVQMKLQCPM

SEQ ID NO: 78347 - DNA, 791 bp, Zea mays
  misc_feature: Ceres CLONE 1563355
  misc_feature: Encodes the peptide sequence at SEQ ID NO. 78348
  misc_feature (605)..(605): n is a, c, t, g, unknown, or other
  misc_feature (658)..(658): n is a, c, t, g, unknown, or other
ctccccgcggtggcggccgctctagaactagtggatcccccgggctgcaggaattcgtctcacccctagaaaaagcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgcctttcacgccgttgacgaggcgaagcggcggctgaaggcggcggggttcgtgcagctgtcggagcgggaggagtgggcgggtctcgagcccgggcgcaagtacttcttcacacgcaaccactccactattgtcgcttttgccatcggcgcaaaatacgttgctggcaatgggttccacatcatcggtgcacacactgacagcccttgcctgaagctcaagcctgtctccaaggtaaccaaaggaggttaccttgaggttggggttcaaacgtatggtggtgggggttgtggtacacatggtttgaccgtgatcttactgtagctggtagagtgattatacgggagaagaaggatgggcgtggtctcttatgcacacaagcnttgtacgggtacagggaaccaattatgccggatacctacttttggctattcancttggacaggactatctccctcagaagggtctcaagggtaaacatcagagtccatctgtttcccaggtgcctggctacttggttccaggaatgaaaaggcagaaaattggtaccagaatatgggcccaaaagc

SEQ ID NO: 78348 - protein, 127 aa, Zea mays
  misc_feature: Ceres CLONE 1563355
  misc_feature: SWISSPROT Homolog: EC 3.4.11.21 Aspartyl aminopeptidase
MATVAPVVSDLVDFLNASPTAFHAVDEAKRRLKAAGFVQLSEREEWAGLEPGRKYFFTRNHSTIVAFAIGAKYVAGNGFHIIGAHTDSPCLKLKPVSKVTKGGYLEVGVQTYGGGGCGTHGLTVILL

SEQ ID NO: 78349 - DNA, 827 bp, Zea mays
  misc_feature: Ceres CLONE 1563356
  misc_feature: Encodes the peptide sequence at SEQ ID NO. 78350
  misc_feature (465)..(465): n is a, c, t, g, unknown, or other
  misc_feature (484)..(484): n is a, c, t, g, unknown, or other
  misc_feature (486)..(486): n is a, c, t, g, unknown, or other
ctccccgcggtggcggccgctctagaactagtggatcccccgggctgcaggaattcgtctcacccctagaaaaaatggagaagcttccttcagtgagtcctccctttccgtttaaggcagcaagcaggagcagacaggaggcgccgagagcccagcgtcggagatctccgccgccatggagacgctggccagcgccatgcggcgcgagaaccgccggtccaaggccccgccctcctcctctgcttcctccgccctcgcctcgggcagggtccctctcgtcatggccttcctctcctgcctcgcctggctctacgtcgccggccgtttgtggcaggacgcgcagacccgggcgatcctgtccggcctcctcgagaagagctctaccagcgtcccgaaggtgctctcggtggaggacaagcttaggaaccttgggtgcaaggcgattggaaggaaaattgtgaggcngagatggacctgaccaggncnagagcgaggggtacctgtggggggacaggactgcagctgtggactccgaacagagcagcagcctcttgccgtcattgaagtttacccgggtttggcctccgtctcagaagaaccgccttcctgggtccctgatgcccagaggggaagccccgaaaaacctggagaaaagggggaccctttcctttttgttttgggccggaggcaaatcgaggggataccttggaccctaaattttgagagaaaaatcgggaaaaaagggccttcttattttttaaaacctgaaaaaggcccaaaaaatttcccgccaaaaaaaattttttttcggggggcggtggaagccg

SEQ ID NO: 78350 - protein, 100 aa, Zea mays
  misc_feature: Ceres CLONE 1563356
  misc_feature (97)..(97): Xaa is any aa, unknown, or other
METLASAMRRENRRSKAPPSSSASSALASGRVPLVMAFLSCLAWLYVAGRLWQDAQTRAILSGLLEKSSTSVPKVLSVEDKLRNLGCKAIGRKIVRXRWT

SEQ ID NO: 78351 - DNA, 794 bp, Zea mays
  misc_feature: Ceres CLONE 1563357
  misc_feature: Encodes the peptide sequence at SEQ ID NO. 78352
ctccccgcggtggcggccgctctagaactagtggatcccccgggctgcaggaattcgtctcacccctagaaaaaaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcaggtgaattgacatacaactatggcgttgacaagtatgacattggaacgggctttgggcatttcgcaattgctaatgatgatgtgtacaagttagctgagaattcaaatccaagggtggtaagatcacccgcgaacctggtcctgtcaagggaggatgcatctgttattgccttcgcacaggatcctgatgggctacattgtttgaagcttatccagtaggctgacacaccctgagcctctttgccaagtcatgccttccgtgttggtgaacctttgagcggttctaatcaagtttatatgagaaggcccctaggggatgaagctccctaaaggaaaaaaggattgtccctgat

SEQ ID NO: 78352 - protein, 148 aa, Zea mays
  misc_feature: Ceres CLONE 1563357
  misc_feature (24)..(144): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
MATGSEASKAAEAVVDWHKHDSKRMLHAVYRVGDLDRTIKYYTECFGMKLLRKRDVPDEKYTNAFLGFGPENTNFAGELTYNYGVDKYDIGTGFGHFAIANDDVYKLAENSNPRVVRSPANLVLSREDASVIAFAQDPDGLHCLKLIQ

SEQ ID NO: 78353 - DNA, 808 bp, Zea mays
  misc_feature: Ceres CLONE 1563358
  misc_feature: Translation starting site: 214
  misc_feature: SWISSPROT Homolog: EC 1.3.3.9 Secologanin synthase
  misc_feature (542)..(542): n is a, c, t, g, unknown, or other
  misc_feature (543)..(543): n is a, c, t, g, unknown, or other
ctggagctccccgcggtggcggccgctctagaactagtggatcccccgggctgcaggaattcgtctcacccctagaaaaaagcgctcccgctccttgctcgcctccacccgcggccaccaccgccctgcggcccccgccgcttgccagcctccaccgcgccgcgagtcgcgccgttcctgcaccggctggtcctggagcacgggaggacgagcatgtactggttcggccccagccccaaggtgaccatcgtcgactcggacctggccgaggacgtgttgtccaacaagttcggccacttcgagaagctcaaggtcctggcgctgtccaagatgctgggctccggcgtggccagccacgagggcgagaagtgggtcaagcaccggaggatcctcaaccctgcgttccatcttgagaagctcaaggtactactaactactacatataattaattgcatataattaattggtccttgggattatctgggcatgtgcagcgcatgtgccggcgtttttctacgtgctgcgaaggactggtgagcanngtgggcggcgaatcccctgggctccaacagctcgtgcaaactggacgtctgggcggagctgcaagacctgacgggaaaagtcatttctctccacgggttcagcagcagctaccgcgaaggggaaaaggattcttcagcttacgggcgaggaactttcccttggtatggacaaaaattcggaaaaactgattcccggggtaaagtgtttttgcctaccggaaaacataggaaaatgcccggaaacacggggggggggggggccccc

SEQ ID NO: 78354 - DNA, 835 bp, Zea mays
  misc_feature: Ceres CLONE 1563360
  misc_feature: Encodes the peptide sequence at SEQ ID NO. 78355
  misc_feature (754)..(754): n is a, c, t, g, unknown, or other
  misc_feature (796)..(796): n is a, c, t, g, unknown, or other
ctccccgcggtggcggccgctctagaactagtggatcccccgggctgcaggaattcgtctcacccctagaaaaaaatctccccttaacaactccactcccgcggaaaaaaaacccatatccctccggcataaacccaaaaagctgcaagcagtgtgaccaaaagcaggcctgacggcgatcctcggctctctagccaggcagcaggagatggagcacgacgtgcaccaccagcaggccatggagctgccgccggggttccgattccaccccaccgacgaggagctcatcacgcactacctcgccaggaaggccgccgacgaccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacgggactgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaagggacgagtgggtgcctgtgcagggtgttcaagaagacatcgagccgccgccgtcagtgggcaagagtccntcggtcggtgtacgggaacaaggtgggggggaaaaaaaatcngggggaaccccctccatggtcattgaggacaaactcgcc

SEQ ID NO: 78355 - protein, 209 aa, Zea mays
  misc_feature: Ceres CLONE 1563360
  misc_feature (13)..(139): Pfam Name: NAM Pfam Description: No apical meristem (NAM) protein
MEHDVHHQQAMELPPGFRFHPTDEELITHYLARKAADDRFAPRAVGEADLNKCEPWDLPSRATMGEKEWYFFCVKDRKYPTGLRTNRATESGYWKATGKDREIFRSKALVGMKKTLVFYTGRAPRGGKTGWVMHEYRLHGKHASSSRLMPSSVRAGASRDEWVPVQGVQEDIEPPPSVGKSPSVGVREQGGGEKKSGGTPSMVIEDKLA

SEQ ID NO: 78356 - DNA, 753 bp, Zea mays
  misc_feature: Ceres CLONE 1563361
  misc_feature: Translation starting site: 136
  misc_feature (569)..(569): n is a, c, t, g, unknown, or other
acccgcggtggcggccgctctagaactagtggatcccccgggctgcaggaattcgtctcacccctagaaaaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcgggcaggccacgtacctgggcgccccgggtgccgtggggcacgctgccgaccatcctgggtngatcgagttcgtggccatcgcccttcgccgagcaccagcgcaccatgggagaaggaccccgagaagaagaagtaccccggcggcgccttcgacccgctcggcttcttccaagaccccgccaaggttcgaggagtacaggcctccaggaaaatcaagaacggccgccctcgccatgcctgggcca

SEQ ID NO: 78357 - DNA, 755 bp, Zea mays
  misc_feature: Ceres CLONE 1563362
  misc_feature: Encodes the peptide sequence at SEQ ID NO. 78358
  misc_feature (632)..(632): n is a, c, t, g, unknown, or other
  misc_feature (705)..(705): n is a, c, t, g, unknown, or other
ctcaccgcggtggcggccgctctagaactagtggatcccccgggctgcaggaattcgtctcacccctagaaaaaagccaagctagcaactctctcgagtcgattcctaagcagctagccagtgactcgatcttagcgtgctacaatggcggcagctgctagtgccctgctcctcctgctctgctcagccttctgctcccttgcccaccgggcggccggcgtcgactacggctcgtggcagagcgcccacgccacgttctacggcggcggcgacgcgtctggcacgatgggcggcgcgtgcggctacgggaacatgtacagcacggggtacggcaccaacacggcggcgctgagcacggcgctgttcaacgacggcgccgcgtgcgggtcctgctacgagctgcgctgcgacaacaacgggcagtcgtgcctgccgggcaccatcaccgtcacggccaccaacttctgcccgcccaactacggcctccccagcgacgacagcggctggtgcaacccgccgcgcccgcacttcgacatggcccagccggccttcctccagatcgcgcagtaccgcgccggcatcgtgcccgtcgcctacaggagggtgccgtgcgtgaaagaaggcgggatcangttcaccatcaacgggcactcctaccttcaccctggtgctgggtgaccaacgtgggccgggcggcgggggacnttgacaaatccgtgtccaatcaaggggctcccagcaaccgggttgggcaa

SEQ ID NO: 78358 - protein, 177 aa, Zea mays
  misc_feature: Ceres CLONE 1563362
  misc_feature (66)..(151): Pfam Name: DPBB_1 Pfam Description: Rare lipoprotein A (RlpA)-like double-psi beta-barrel
  misc_feature (163)..(163): Xaa is any aa, unknown, or other
MAAAASALLLLLCSAFCSLAHRAAGVDYGSWQSAHATFYGGGDASGTMGGACGYGNMYSTGYGTNTAALSTALFNDGAACGSCYELRCDNNGQSCLPGTITVTATNFCPPNYGLPSDDSGWCNPPRPHFDMAQPAFLQIAQYRAGIVPVAYRRVPCVKEGGIXFTINGHSYLHPGAG

SEQ ID NO: 78359 - DNA, 842 bp, Zea mays
  misc_feature: Ceres CLONE 1563363
  misc_feature: Translation starting site: 393
  misc_feature (694)..(694): n is a, c, t, g, unknown, or other
  misc_feature (791)..(791): n is a, c, t, g, unknown, or other
ctcaccgcggtggcggccgctctagaactagtggatcccccgggctgcaggaattcgtctcacccctagaaaactccagagccacgctgcttcccggccgaagcctccgtccgcgcccacggtttccattccatcccccaggcttgcgccgactcgccacttgcaccgccggccggtttcgccgaacgcctcgcgcccacccgcgcgcggagacctgcatataagccggccgcgtgtcgtccggcgctcccgggacaggcgatccgttcgtcatccgctgcaaaccaccaggcaccagctccgcgcgcagaggccggaggactacgaccgacgagggcgacgaacaccaaggctccgaagtccgaggaggcaggaagcggaagacgtcgggaatgggcgctgctcgtgactccacggcggcgggccagaagcgcggcaccggcacgcggtgcgagctctgcgggggcgcggcggccgtgcactgcgccgcggactcggcgttcctctgcctgcgctgcgacgccaaggtgcacggcgccaacttcctggcgtccaggcacgtgaggcggcgcctggtgccgcgccgggccgccgaccccgaagcgtcgtcggccgcgtccagcggctcctcctgcgtgtccacggccgactccgcggagtcgggcggcacgggcaccgggctcgtgccccttcnaggacgggcgggaaggaggctcccggctccgggcccggcggcccctccccgaagcggtgcttggaggggtgggccaaacagaatggggttcccaggngggggccggggcccccgggccccctcggggggaggacccccggtcttcggg

SEQ ID NO: 78360 - DNA, 798 bp, Zea mays
  misc_feature: Ceres CLONE 1563365
  misc_feature: Encodes the peptide sequence at SEQ ID NO. 78361
  misc_feature (560)..(560): n is a, c, t, g, unknown, or other
  misc_feature (637)..(637): n is a, c, t, g, unknown, or other
ctggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaagcccgtgtgggtcaaagccggggtcgcagaatcttcagcngagggtgggctggactacctcggcaacccggagcctgatcccacgcgcagagcatccctcgcccatctggggcttgncaggttcgtgcttcatgggcccccaatccaggggggtaacccgggtcccccggggggccccctttcgggaaaaaggtcttttaaaacccccttttaaaccccgggggggggaagtttttaaaaccccgttttgggccctttcccaaaaaaaaaaaccccgg

SEQ ID NO: 78361 - protein, 152 aa, Zea mays
  misc_feature: Ceres CLONE 1563365
  misc_feature (64)..(151): Pfam Name: Chloroa_b-bind Pfam Description: Chlorophyll A-B binding protein
  misc_feature (141)..(141): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEARVGQSRGRRIFSXGWAGLPRQPGA

SEQ ID NO: 78362 - DNA, 792 bp, Zea mays
  misc_feature: Ceres CLONE 1563370
  misc_feature: Encodes the peptide sequence at SEQ ID NO. 78363
  misc_feature (538)..(538): n is a, c, t, g, unknown, or other
tggagctcaccgcggtggcggccgctctagaactagtggatcccccgggctgcaggaattcgtctcacccctagaaaaaatccatctccattcatccgtcttgacagctccactcctaactccagcgaccaccgcgtccccaccatggccgctcgccggagcactagccccgcccggcacggcgtcctccccgccctccttctcatcctatgctcgtccctcccttccctcgccgccgcataccgcccaggcgacatcgtcccgatgctccgctcgggccagtaccacggctcgaggtcggtgtggttcgacgtggtggggcgccattgcccggccttcgcggtcaaccgggaggtgctgatgccgatcccaaagcctacggggttcactggtgctgatccgtacaagataacatttcaaattggacatgaaaagttccatgttccttggctttatgttataaatcgcaaaacctctgaagttccactgatcgatttccatttgaagtactctggaaatgatatacttggggtgacangctaaagttgtggacatgcctcaccacttacgtgggaagttcatcctgacataaagaagaattgtctgggatccacagaattggccaaaaatacgttcttggttagataatacatggggaggagcaatcagagatagatgttactgggaaaatttttatgtgggtaatttgggatcccggggctttgtttttggcccttcattccttggacaatattatgtccctacagtcatccctcaagagaaagtttggaa

SEQ ID NO: 78363 - protein, 131 aa, Zea mays
  misc_feature: Ceres CLONE 1563370
MAARRSTSPARHGVLPALLLILCSSLPSLAAAYRPGDIVPMLRSGQYHGSRSVWFDVVGRHCPAFAVNREVLMPIPKPTGFTGADPYKITFQIGHEKFHVPWLYVINRKTSEVPLIDFHLKYSGNDILGVT

SEQ ID NO: 78364 - DNA, 765 bp, Zea mays
  misc_feature: Ceres CLONE 1563371
  misc_feature: Encodes the peptide sequence at SEQ ID NO. 78365
ccccgcggtggcggccgctctagaactagtggatcccccgggctgcaggaattcgtctcacccctagaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattggttgactgtgccttgaccgcatcaggaagcttgcagataattgcactggtctcccagggcttcctcgtcttcaacgctgttgggtggaagaacggggctcggggcctgggttctctcctcctgggagcgccttgtctggttgactatgggcaagaattccaagctcgggttttcaccgttgtacccatccccccccaagggggcccaacatccggtgggtttgagc

SEQ ID NO: 78365 - protein, 115 aa, Zea mays
  misc_feature: Ceres CLONE 1563371
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIG

SEQ ID NO: 78366 - DNA, 794 bp, Zea mays
  misc_feature: Ceres CLONE 1563372
  misc_feature: Translation starting site: 144
  misc_feature (462)..(462): n is a, c, t, g, unknown, or other
ctggagctcaccgcggtggcggccgctctagaactagtggatcccccgggctgcaggaattcgtctcacccctagaaaaaagccatcacacgcatactgcatacacaacacagagcatcagaaggagctacgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaacccgcgagctggaggtgatccactgccgctggggcatgctncgcgcgctcggggtgcgtgttcccggagctgctcgcccgcaacggcgtcaagtcggccaagccggtgtggtccaagcgggctccaaatcttcacgaggcgggctggactcctcgcaacccgagcctggtccaccccaaacatcctgcccattgggcttccaggtggtccccatggcccctcaagggggtcccgttccccggggcccccttgaaaaaggggcaaaccccttgtccctggggggaatttaaaacccttggggtctccaaaaaaccagagggttcccccaaccccaggggaaagaaataaaaaaggcccccccccccttttctcc

SEQ ID NO: 78367 - DNA, 750 bp, Zea mays
  misc_feature: Ceres CLONE 1563373
  misc_feature: Encodes the peptide sequence at SEQ ID NO. 78368
  misc_feature (629)..(629): n is a, c, t, g, unknown, or other
  misc_feature (723)..(723): n is a, c, t, g, unknown, or other
ctcaccgcggtggcggccgctctagaactagtggatcccccgggctgcaggaattcgtctcacccctagaaaaaatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccantcaagatcgatctggagaccaaacagattgtggacttcatcaagtttgatgttggcaacgtcgtcattggtgactgggtggaagaaacactggncccgtggtgggtggtttatcaagaaca

SEQ ID NO: 78368 - protein, 175 aa, Zea mays
  misc_feature: Ceres CLONE 1563373
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (160)..(160): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTXQDRSGDQTDCGLHQV

SEQ ID NO: 78369 - DNA, 888 bp, Zea mays
  misc_feature: Ceres CLONE 1563376
  misc_feature: Encodes the peptide sequence at SEQ ID NO. 78370
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
ctccccgcggtggcggccgctctagaactagtggatcccccgggctgcaggaattcgtctcacccctagaaaaagcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaggaggcttcagctgccattactgccttggatggaaagactctcgatgaacggagcatacgtgttaatcatgctaacgagaagacaggtggctttcgtggcggcggtggctatggtggggcggctcggggtggggaaaaaaaannnnnnnnnnnnnnnnnnnnnnncnnngggggggggggtgaaggctaaaggggggtgttggcggcgggatgtggaatacgggtggggggggacttatggtggcaaccgcaacaagggtggggggtgtgaaaataggagttcccggtggaggagagggggaaaagccacctttaacgggtggggaggtagcgaccagcttttgcgaaaaagttatcttggggtttctgaaaaagaaatttttgggggaaaacgtagccttggtggcttataatgcaacccggggagtacaaaagggcaaaaaatagggtttcccagggccccccttgtaagataaaacttggagtgg

SEQ ID NO: 78370 - protein, 144 aa, Zea mays
  misc_feature: Ceres CLONE 1563376
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (130)..(130): Xaa is any aa, unknown, or other
  misc_feature (131)..(131): Xaa is any aa, unknown, or other
  misc_feature (132)..(132): Xaa is any aa, unknown, or other
  misc_feature (133)..(133): Xaa is any aa, unknown, or other
  misc_feature (134)..(134): Xaa is any aa, unknown, or other
  misc_feature (135)..(135): Xaa is any aa, unknown, or other
  misc_feature (136)..(136): Xaa is any aa, unknown, or other
  misc_feature (137)..(137): Xaa is any aa, unknown, or other
  misc_feature (138)..(138): Xaa is any aa, unknown, or other
MALANKLGGLLKKATSSNLSVYQAIRCMSSKLFVGGISYQTDDHSLRDEFAKYGQVIEARIIIDRESGRSRGFGFVTYTSSEEASAAITALDGKTLDERSIRVNHANEKTGGFRGGGGYGGAARGGEKKXXXXXXXXXGGGGEG

SEQ ID NO: 78371 - DNA, 797 bp, Zea mays
  misc_feature: Ceres CLONE 1563379
  misc_feature: Encodes the peptide sequence at SEQ ID NO. 78372
  misc_feature (768)..(768): n is a, c, t, g, unknown, or other
ctccccgcggtggcggccgctctagaactagtggatcccccgggctgcaggaattcgtctcacccctagaaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaagccaatgccaagcctgtcgctccctgcctgcgcgtcgcccaaaagccccggcggcgccccctccctatgttcggcctagaccttccgcctagggcctcccccgnccagggcatgccaagaagggcggctgccc

SEQ ID NO: 78372 - protein, 211 aa, Zea mays
  misc_feature: Ceres CLONE 1563379
  misc_feature (54)..(124): Pfam Name: Linker_histone Pfam Description: linker histone H1 and H5 family
  misc_feature (202)..(202): Xaa is any aa, unknown, or other
MSTEEAVVAEVPVTEVPAEVPAAQVAEAPKAKKAPKEKKAPKEKKLSAAKKPAAHPPYAEMIVEAIAALKERKGSSSVAISKYVEGKHGGKLPTNFRKQLTVQLKKLAAAGKLTRVKNSFKLPATDAKPKAAKPKAPKAAPKPKPSPKAKAKTAAKPKAASPKPKAKANAKPVAPCLRVAQKPRRRPLPMFGLDLPPRASPXQGMPRRAAA

SEQ ID NO: 78373 - DNA, 837 bp, Zea mays
  misc_feature: Ceres CLONE 1563382
  misc_feature: Encodes the peptide sequence at SEQ ID NO. 78374
ctggagctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaggccgagctggctgccatacataggtattgtgtggtgtgtgagaagagagagagaaacagagttcttcagtttgctatctctctctctgcatgtttggcgtcagtctttgtgctcatgtacgtgtgtctacatgcatgttggttgatccgattgcgtctgctgtaaccatatattaattggtccacgatgatatgatttgatactatatatatatatatatactaaaacgggacttcttattaaaaagtgtgaggtaggtgaaacaaagtcgtcgagcgctctttccctctctctatacctctctgtctgcgacgcggttggataggctaccgccgctaggtgccgactgccgaagccctaccggcggcgaagacgcccgcc

SEQ ID NO: 78374 - protein, 76 aa, Zea mays; identical to SEQ ID NO: 42649
  misc_feature: Ceres CLONE 1563382
  misc_feature (1)..(76): Pfam Name: Metallothio_2 Pfam Description: Metallothionein

SEQ ID NO: 78375 - DNA, 832 bp, Zea mays
  misc_feature: Ceres CLONE 1563384
  misc_feature: Encodes the peptide sequence at SEQ ID NO. 78376
  misc_feature (172)..(172): n is a, c, t, g, unknown, or other
  misc_feature (689)..(689): n is a, c, t, g, unknown, or other
  misc_feature (727)..(727): n is a, c, t, g, unknown, or other
ctggagctccccgcggtggcggccgctctagaactagtggatcccccgggctgcaggaattcgtctcacccctagaaaaaagcggtacgatggccgcttcgagaatggcgctcgtctcttgcgcccgccgcctcccgtccttaccctctccgctcaccctctcgaggccccncgccggcgccgtctcatttctggctgcccaaccgtcgccggcgacggcaccgagatccggcaggaatcttgctctcttctgttctttatcaccgacgtcgccatcgctaactgaggccgccgtagcactgccgccaccgaaggctgcggtggaagagacgaagccccctgtgccgaccggggacgagaagggggaaccgaccgtggaggagctagcgggcctgctggacgtccgggtgggccgagtggtgaaggcgtggaggcacccggaggcggacaccctctacgttgaggaggtggacgtaggtgaggcggagccccggaccatctgcagcggcctcgtcaacttcctccccatcgaagagctccaggacagaaacgtcattgttcttgctaacctcaaccaaggaacatgcgtggcatcaagtcaaatggcatgctcatggctgcctctgatgcttcccatgagaatgtggagctgctcatcccttcagaaggtccctttcctgtgaaaaaantaagggtccggttccgagaagaaaagaaacgttcatcntgaccctgcatcacccaatcaggccaaaaagaagagaatctgggaagctgttcagcctcatcttagaacacagataactgcattggccggtcttgtgaataaaca

SEQ ID NO: 78376 - protein, 192 aa, Zea mays
  misc_feature: Ceres CLONE 1563384
  misc_feature (100)..(185): Pfam Name: tRNA_bind Pfam Description: Putative tRNA binding domain
  misc_feature: SWISSPROT Homolog: EC 6.1.1.1
  misc_feature (23)..(23): Xaa is any aa, unknown, or other
MALVSCARRLPSLPSPLTLSRPXAGAVSFLAAQPSPATAPRSGRNLALFCSLSPTSPSLTEAAVALPPPKAAVEETKPPVPTGDEKGEPTVEELAGLLDVRVGRVVKAWRHPEADTLYVEEVDVGEAEPRTICSGLVNFLPIEELQDRNVIVLANLNQGTCVASSQMACSWLPLMLPMRMWSCSSLQKVPFL

SEQ ID NO: 78377 - DNA, 747 bp, Zea mays
  misc_feature: Ceres CLONE 1563385
  misc_feature: Encodes the peptide sequence at SEQ ID NO. 78378
  misc_feature (362)..(362): n is a, c, t, g, unknown, or other
ggagctcaccgcggtggcggccgctctagaactagtggatcccccgggctgcaggaattcgtctcacccctagaaaaaccgtcgtctcgcgctctcgtttcgtcgctacgctagcttccagtcccgggcttagcaactgtgctgctgttgcactgcacccggcgcacgcagagatgcgccgtgtcgggacgggtgtgaggatgctttgcggcgcggcgctgtcggtgcttctgcttctcgcgggcggcgcggcggcgtcgcactcgcgctcgtcgtgccccgccacgccgccggacgcggggaacacgctgcaggtgtcgcacgcgttcgggccgtgctcgccgctgggccccgggacggcngcgccgtcgtgggcggggttcctggggcgacagggcgtcgcgtgacgcgtcgcggctgctgtacctggactcgctgggcggtgcgtggcccgcgcccgcgcggtacgcgcccattccggttcggggccggcagcttgctgcaaaaacccgaacctaacgtggggggggggggcccaaccccttgggaacccccccccccaaaaaacttggtttcctggggccggttgaaaccccggaaaaagaacccccccggggggggaaccccctttggcccccccggtttgcccgggggttttccccccacattttttccccgggggggccccttttttaaaacccgggggggggggttccccccctcttttaaacccaaaggggggggccc

SEQ ID NO: 78378 - protein, 77 aa, Zea mays
  misc_feature: Ceres CLONE 1563385
MRRVGTGVRMLCGAALSVLLLLAGGAAASHSRSSCPATPPDAGNTLQVSHAFGPCSPLGPGTAAPSWAGFLGRQGVA

SEQ ID NO: 78379 - DNA, 783 bp, Zea mays
  misc_feature: Ceres CLONE 1563386
  misc_feature: Encodes the peptide sequence at SEQ ID NO. 78380
tccccgcggtggcggccgctctagaactagtggatcccccgggctgcaggaattcgtctcacccctagaaaaattttcctctctgctagctagctcttgtcttgtcactgagtgagcagcggggagctgtctagctagcctagtacaggtggagtggagtgtagtggtggagtgcaaaccaaatcaaacgaataaaagtgggagcgaggaagaagaaaagaagaagaacaagacgacgaccacacccaccaccagcatcaagcagcaatcaacagaacgaaatgtctatcaagtactgcgaccagcacaaggactgcgagcggaagcgtctgtaccgtcgcttctgcgccgccctggtgggcgtcatcgtgctcgtcctcctcatagtgctcatcgtctggctcgtcctccgacccaccaagcctcgcttcttcctcaacgacgtgagcatcgtgtgcatcaacgtcagctccgcctcctacctcaccgtcaccatgcaagccacgctggcgtcgcgcaacacagacaaccgcgtcggcatctactacgaccgcgccgacgtgtacgccgagtaccgggcgatgcatatcacagtgcccaccgcgctgccacccatgctccagccgcccaacgacgccggcagtatgagcgcccttcctctccgccatcaacgtaccgctgccgaactacctcggccagcgcgatcaatcaagtagagacggcggaggtacctgatcgtcagcatcccccgtcatactggatgatgacctctggataagccgg

SEQ ID NO: 78380 - protein, 144 aa, Zea mays
  misc_feature: Ceres CLONE 1563386
  misc_feature (40)..(145): Pfam Name: Hin1 Pfam Description: Harpin-induced protein 1 (Hin1)
MSIKYCDQHKDCERKRLYRRFCAALVGVIVLVLLIVLIVWLVLRPTKPRFFLNDVSIVCINVSSASYLTVTMQATLASRNTDNRVGIYYDRADVYAEYRAMHITVPTALPPMLQPPNDAGSMSALPLRHQRTAAELPRPARSIK

SEQ ID NO: 78381 - DNA, 820 bp, Zea mays
  misc_feature: Ceres CLONE 1563387
  misc_feature: SWISSPROT Homolog: EC 4.1.1.35 UDP-glucuronate decarboxylase
  misc_feature (492)..(492): n is a, c, t, g, unknown, or other
acccgcggtggcggccgctctagaactagtggatcccccgggctgcaggaattcgtctcacccctagaaaaaacaggtcaccaaccacgcacccgcctccgcctgcccgctctcccgccatgaagcagctccacaagtcttcccctacccacgcgccatcgccggcgcacgcaccggctcccaaggccgccaagccggcgcgccctgggccgcgctcctggatcggctacgtcctccgcgagcagcgcctcctcttcgtcctgctcggtgcgctcatcgcctccaccttcttcctcctccggccctacctctcgctctccccgtcttcccacctccccgacgcccgcccgctcttctccttcgccacccgctccggtgttcccgccggcttccgcccgccgcagcgccgcgtcgtcgtaacatgcggggcaggggtcgtcggcagccatctcgtcgaccggcttctggagcagggcgacagcgtgatcgtgnccgaacaactcttcacaggccagaaaggagaacgtcgcgcaccaacctcgggaaccccagggtcgagctgctcccgccacgatgtagtcgagcccatccttcctggagggggaccggaatttacaccctcccggggccccggagtggctggggccctaccaagtccaaccccagttaaggacaataaagaaaaaagggcgtggggaacctttgaaaaaatttgggggcccggggaaaaacgaaattgggggaaagggcttttgtttaaatataaaaaaaagggaaaatttttgggggggaaccccgcttttagaacaccccacaaaaa

SEQ ID NO: 78382 - DNA, 801 bp, Zea mays
  misc_feature: Ceres CLONE 1563389
  misc_feature: Encodes the peptide sequence at SEQ ID NO. 78383
  misc_feature (581)..(581): n is a, c, t, g, unknown, or other
  misc_feature (724)..(724): n is a, c, t, g, unknown, or other
  misc_feature (725)..(725): n is a, c, t, g, unknown, or other
ctggagctccccgcggtggcggccgctctagaactagtggatcccccgggctgcaggaattcgtctcacccctagaaaaagcctctcaaccactcatcatcgccttcgcaggcatcgccctctcgccgggccgtccgattccgccatggcttccgatgagagcaaaaattcaaaaccagagaagccatcttcagcagctggtgcaggcctccccaatccgtttgatttttcttctatgagcaacttgctcaatgacccatcgataagagagatggctgagcaaattgcaagtgaccctgtgttcaaccagatggctgaacagcttcagaaaagtgctcagggtgctggagaacagggtattcctgcattggatcctcaacagtatatggaaacaatgcaacaagtcatgcaaaaccctcagtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgagnatagagaatgggggtccatctgcaatggtgaagtattggaatggaccctgaggttcttcaaaagattggcagggcaatgggtgttaaccttcccgggagattctagtgtgtccactgtgctctctggacccgaagagactganngagaaaggaagggtatgacgattgagtccattgttcatcaacactggcaagtgttgggtgaattaaaaaaggggtt

SEQ ID NO: 78383 - protein, 218 aa, Zea mays
  misc_feature: Ceres CLONE 1563389
  misc_feature (146)..(146): Xaa is any aa, unknown, or other
  misc_feature (193)..(193): Xaa is any aa, unknown, or other
  misc_feature (194)..(194): Xaa is any aa, unknown, or other
MASDESKNSKPEKPSSAAGAGLPNPFDFSSMSNLLNDPSIREMAEQIASDPVFNQMAEQLQKSAQGAGEQGIPALDPQQYMETMQQVMQNPQFVSMAERLGNALMQDPAMSSMLENLTSPAHKEQLEERMARIKEDPSLKPILDEXREWGSICNGEVLEWTLRFFKRLAGQWVLTFPGDSSVSTVLSGPEETXXERKGMTIESIVHQHWQVLGELKKG

SEQ ID NO: 78384 - DNA, 803 bp, Zea mays
  misc_feature: Ceres CLONE 1563390
  misc_feature: Encodes the peptide sequence at SEQ ID NO. 78385
  misc_feature (333)..(333): n is a, c, t, g, unknown, or other
  misc_feature (450)..(450): n is a, c, t, g, unknown, or other
  misc_feature (480)..(480): n is a, c, t, g, unknown, or other
  misc_feature (486)..(486): n is a, c, t, g, unknown, or other
  misc_feature (487)..(487): n is a, c, t, g, unknown, or other
  misc_feature (491)..(491): n is a, c, t, g, unknown, or other
  misc_feature (496)..(496): n is a, c, t, g, unknown, or other
  misc_feature (611)..(611): n is a, c, t, g, unknown, or other
agctccccgcggtggcggccgctctagaactagtggatcccccgggctgcaggaattcgtctcacccctagaaaaaaccgcgccacgcagtaaacgaaaagacgggcccactccctcaatcctccgcacgccccttccatggggcagccgcacctcttgccgcagctctccccctccccggtcctctactccctcttctcgccgccggagacgggggccacgccctggcggcggccgctgaaccggggacgggccttccaaccgccgctctcctcgctgcgggagaccaacaaggccacgctccgcaaggccacgcccaacgcccccttccgncctcggcggtggcgggggcggcagccccaagggatcgccgccccgccgccgacgacaaggaggacgaggacgagggtcgcggcggcgccggggcactcacagggacgctgatcgcangagcattactggttgggttcgtaggggggntttggnngcgnccggntacgtgtacaaggacccagatcacaccttcctcacgcagttctcggggttccttgacggctatggtccagccggatatgctctgttcgtacttgtatatgcaagggttgggaggntctcgccaattcccgccaataccttttaccattgtcagctgggcctaattattttgggaaaggggaacttgggaacaaattattgggtttccaaacccggtgggaaaaacctaaacctggcaagggggtgggccccttccctttaattggcccaaaaaaacctttttgccaaaaagagaaagaaattatccc

SEQ ID NO: 78385 - protein, 101 aa, Zea mays
  misc_feature: Ceres CLONE 1563390
MGQPHLLPQLSPSPVLYSLFSPPETGATPWRRPLNRGRAFQPPLSSLRETNKATLRKATPNAPFRPRRWRGRQPQGIAAPPPTTRRTRTRVAAAPGHSQGR

SEQ ID NO: 78386 - DNA, 772 bp, Zea mays
  misc_feature: Ceres CLONE 1563393
  misc_feature: Translation starting site: 168
  misc_feature: SWISSPROT Homolog: EC 2.5.1.6 Methionine adenosyltransferase
  misc_feature (337)..(337): n is a, c, t, g, unknown, or other
ctggagctcaccgcggtggcggccgctctagaactagtggatcccccgggctgcaggaattcgtctcacccctagaaaaagccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatgggtgatggtgttcnggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagagccacatgttcgggtacgccaccgacgagacccccgagctgatgccgctcagccacgtgctggccaccaagctgggcgcgcgcctcaccgtagtgcgcaagaacggcacctgcgcctggctgaggcccgacgcaagacccagtggacggtggagtacgtgaacgaaggcggcgccatggtggcccgtccgccgtgcacaccgggctcatctcaacccaggacgacga

SEQ ID NO: 78387 - DNA, 837 bp, Zea mays
  misc_feature: Ceres CLONE 1563394
  misc_feature: Encodes the peptide sequence at SEQ ID NO. 78388
ggagctccccgcggtggcggccgctctagaactagtggatcccccgggctgcaggaattcgtctcacccctagaaaaacacctacgtgtcgagccgtcttcatccctccgaccggaaatcaaaggtgcgtttgcttctctcctccggaaggatctcggcttctctcatgcgcggcgaccgggttcaaccccaactcttcttcttcttcctcgcaaacttcaaacgggactagaaggaaacggacgcgagaggagactaaccgacctcggatccatcgactcgtgaagatgtcttctcccgccgagtactacaaatcacttcctcctataagcaaggcatatgggacattgtgtttctttacaaccgtgctagttcatctccaaattttgcacccattatttctttacttagattaccccttggtgttcaagaagtttgagatatggaagctattgacaagtttctttttcctggcaccattttccatgaaatttggtattcaccttctgatgataccaaggtatggtgtcatgttggataagggtgcatttgataagcggactgcagatttcttatggatgatgatatttggtgccatctcactattggtgctgtcaatcattcccctattcaattctgttgtcttaggaatacctatggtcagcatgctcctttatgtctggacccgacagaatcaaatgctcagatcaatatagacggcctcgtccaattgagtcctttttactttactggggctatgctcgtattgtatggccatattggggccatccctgaaggccggaacttctggggatcctggggtggacgtctcctccc

SEQ ID NO: 78388 - protein, 142 aa, Zea mays
  misc_feature: Ceres CLONE 1563394
  misc_feature (11)..(143): Pfam Name: DER1 Pfam Description: Der1-like family
MSSPAEYYKSLPPISKAYGTLCFFTTVLVHLQILHPLFLYLDYPLVFKKFEIWKLLTSFFFLAPFSMKFGIHLLMIPRYGVMLDKGAFDKRTADFLWMMIFGAISLLVLSIIPLFNSVVLGIPMVSMLLYVWTRQNQMLRSI

SEQ ID NO: 78389 - DNA, 772 bp, Zea mays
  misc_feature: Ceres CLONE 1563395
  misc_feature: Encodes the peptide sequence at SEQ ID NO. 78390
ctcaccgcggtggcggccgctctagaactagtggatcccccgggctgcaggaattcgtctcacccctagaaaaaaatcaaacaaacacagctctgacctctgaccgtaattaccaaccactgccagcgacctctcctcggaggcgtgaccgtaattgctccgcaactaccccgataccattcccaaatcctccgtcgacccctctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctgccgaggcacatgttcggcaacttgcagagcaagatgttcccggcctacttcacgcttatatctgcatgcgcagccatctccgtcgccgccttcgcgtaccttcacccgtggaagacggcgtccactgtgcagcgctaccagcttggattcctcctctcagcgctcggctgcaacctctccaaccttctagtcttcactcccatgaccatcgagatgatgaagaagaggcacaagatcgagcggggacctgagtatccggcgaagaaaatcgggatggtcaaaggaaccaagcaggtgggctaaattccaacccccacccctcggctgcaatggaacaaggagt

SEQ ID NO: 78390 - protein, 167 aa, Zea mays
  misc_feature: Ceres CLONE 1563395
MGWATRFLAAVCFFAAGVLFVPEAIGSPSGAGAVTAAKLAHVLSFATSWGAALWATFIGGIIMFKNLPRHMFGNLQSKMFPAYFTLISACAAISVAAFAYLHPWKTASTVQRYQLGFLLSALGCNLSNLLVFTPMTIEMMKKRHKIERGPEYPAKKIGMVKGTKQVG

SEQ ID NO: 78391 - DNA, 774 bp, Zea mays
  misc_feature: Ceres CLONE 1563399
  misc_feature: Encodes the peptide sequence at SEQ ID NO. 78392
ctccccgcggtggcggccgctctagaactagtggatcccccgggctgcaggaattcgtctcacccctagaaaaaaagacgcgctcgtgcccgcgccatgaagtgctggtgcgtgcacgcgccaaggggagcaatggcgacgccgctctccagccccttggctcccaccgccctccgctcccctctccggcaccgcgccctgctgctgctgctgccgctgccgttccctccccgtgcggcctcctccggcgaggacaccgccgcagcagccgaccaggagccggccccggcggccaccaagacggccaccgcggacgacgacttcgaggagcgcgtgctacggatcaagtcccgcgtcgggcccaagaagcgcggcgcgcgcaagaagaaggccgcggcgtccgcgtcagccagcgccgtgacgctcccgcccgtgccgctgcgggagccccggtcggcgctcggcgcgcccgtcgagctcggcttcaccgcgtacagcgagaggctcaacggcgcgctggccgcgctggggctcgccgcggtgctgctcgtggagctgggctccgggcaggcccctggtgaagtaccaccagccggccacgctgttcctgcaggcgtacaccgtcgctgcggccgccgcgctgttcatcaagtacgagaaggagcggatcagcacgtggccggggccgccggcaaagtgagataaatggcgttgtctccggtcgcggatcctttacttgtacttttacctccttggattgatgtgcactgcaag

SEQ ID NO: 78392 - protein, 202 aa, Zea mays
  misc_feature: Ceres CLONE 1563399
MKCWCVHAPRGAMATPLSSPLAPTALRSPLRHRALLLLLPLPFPPRAASSGEDTAAAADQEPAPAATKTATADDDFEERVLRIKSRVGPKKRGARKKKAAASASASAVTLPPVPLREPRSALGAPVELGFTAYSERLNGALAALGLAAVLLVELGSGQAPGEVPPAGHAVPAGVHRRCGRRAVHQVREGADQHVAGAAGKVR

SEQ ID NO: 78393 - DNA, 839 bp, Zea mays
  misc_feature: Ceres CLONE 1563400
  misc_feature: Encodes the peptide sequence at SEQ ID NO. 78394
ccccgcggtggcggccgctctagaactagtggatcccccgggctgcaggaattcgtctcacccctagaaaaaaacttgcgtagagagttgggcgcagagaatccccaagcaaacaaacagggtagagggagaggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaaccccatcctcttccaggtcctcatcagtccgatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgtttgctacgcccttcgcatctgtgctcgacgcctacccgcctgtgaaggcctggtggcctgttctgatggagaaggcgtctgtccaaaagtccctgccctgattaaccctctggcttgaaccgttccccttcatcggtc

SEQ ID NO: 78394 - protein, 208 aa, Zea mays
  misc_feature: Ceres CLONE 1563400
  misc_feature (2)..(77): Pfam Name: GST_N Pfam Description: Glutathione S-transferase, N-terminal domain
  misc_feature (110)..(201): Pfam Name: GST_C Pfam Description: Glutathione S-transferase, C-terminal domain
  misc_feature: SWISSPROT Homolog: EC 2.5.1.18 Glutathione transferase
MAPMKLYGAVMSWNVTRCATALEEAGSDYEIVPINFATAEHKSPEHLVRNPFGQVPALQDGDLYLFESRAICKYAARKNKPELLREGNLEEAAMVDVWIEVEANQYTAALNPILFQVLISPMLGGTTDQKVVDENLEKLKKVLEVYEARLTKCKYLAGDFLSLADLNHVSVTLCLFATPFASVLDAYPPVKAWWPVLMEKASVQKSLP

SEQ ID NO: 78395 - DNA, 771 bp, Zea mays
  misc_feature: Ceres CLONE 1563401
  misc_feature: Encodes the peptide sequence at SEQ ID NO. 78396
ctccccgcggtggcggccgctctagaactagtggatcccccgggctgcaggaattcgtctcacccctagaaaaagttcctttgtgtccaaaccaagtaaaggcggcaggctcctcacattctcctgccatatctgctgcccgctgctccccccctctctcttcaagctagccagtagctggctgaatggtcctcgcgcgagccatggtgatggagcacaggaagaagtcgaattatcttgttgccctcgtcttggcttcgctcttgctctccgccatggcaggagggcatcggaagaagcttctgaacaaagacgacgcatcagaatcaatggagacattggaatccacgcagcagctgcaggaagacgacgaaatggctgtggtggtccacgagagaattctcaggcaggcgaagatgaacgactacgggagctacgactcttcgccgaccatggctaagcctcacttcaaagacatacctaactagccagccccactagctactatatacatttgaggtgttgctttgctagtcgagtcgccctctcctccgtcctcatacacaagcatacttgccctaataaattcccatgtattcatccaccatggcataatatgggaagaaaatatatgtaccggccgcctggattgtatatgtgggccaacatgggcacacccctacccaaaatgggttttttttatattgggccaggtgttccccccccccccgccccattttttgaaaaaaaaacttttgggccgaagggggg

SEQ ID NO: 78396 - protein, 94 aa, Zea mays
  misc_feature: Ceres CLONE 1563401
MVMEHRKKSNYLVALVLASLLLSAMAGGHRKKLLNKDDASESMETLESTQQLQEDDEMAVVVHERILRQAKMNDYGSYDSSPTMAKPHFKDIPN

SEQ ID NO: 78397 - DNA, 845 bp, Zea mays
  misc_feature: Ceres CLONE 1563402
  misc_feature: Encodes the peptide sequence at SEQ ID NO. 78398
  misc_feature (736)..(736): n is a, c, t, g, unknown, or other
  misc_feature (801)..(801): n is a, c, t, g, unknown, or other
  misc_feature (815)..(815): n is a, c, t, g, unknown, or other
tggagctccccgcggtggcggccgctctagaactagtggatcccccgggctgcaggaattcgtctcacccctagaaaaaaagcggcaagggggatcgatcttgttcgcggagaggggtgacgtgcttgacagttttgactcgaatccatggtgtgcatctctaccagatagagagctgacctgaggtggagacgcggatcgtggctcctggggtggaggtacaagcgtacagctcaataggagatcaagagtaaagagtggtggggaggggaaggacgcgatatcgggggaggatggtgcttgtgcttgcgctgggggatctgcacatcccgcaccgggtgcccgacctgcccgccaaattcaagtccatgctcgtgcccggcaagatccaacacatcatctgcgctggcaacctctgcatcaaggaagttcatgactacctgaaaagcctttgccctgatctccacattaccggaggtgaatatgatgagtatgctcgatacccagagactaagacacttacaattggtcagtttaagcttgggctgtgccatggtcatcaggttgttccatggggcgacctggactccctggcgatgctccagcggcagctggacgtggacatcctggtgaccgggcacagccatcagttcaaggcatataagcacgaggggaggcgtggtgatcaaccctggctctgccacgggcgcctacagcagcatccacttacgacgtngaccccaagcttttgtgctgatggacatcgaaggactccctggtgggtggtgtacgtcttacaanctaattgacggccnaagtgaaaaggggaaaaaaaatcaacttcc

SEQ ID NO: 78398 - protein, 171 aa, Zea mays
  misc_feature: Ceres CLONE 1563402
  misc_feature (2)..(120): Pfam Name: Metallophos Pfam Description: Calcineurin-like phosphoesterase
  misc_feature (148)..(148): Xaa is any aa, unknown, or other
  misc_feature (170)..(170): Xaa is any aa, unknown, or other
MVLVLALGDLHIPHRVPDLPAKFKSMLVPGKIQHIICAGNLCIKEVHDYLKSLCPDLHITGGEYDEYARYPETKTLTIGQFKLGLCHGHQVVPWGDLDSLAMLQRQLDVDILVTGHSHQFKAYKHEGRRGDQPWLCHGRLQQHPLTTXTPSFCADGHRRTPWWVVYVLQXN

SEQ ID NO: 78399 - DNA, 789 bp, Zea mays
  misc_feature: Ceres CLONE 1563403
  misc_feature: Encodes the peptide sequence at SEQ ID NO. 78400
  misc_feature (695)..(695): n is a, c, t, g, unknown, or other
  misc_feature (700)..(700): n is a, c, t, g, unknown, or other
tggagctccccgcggtggcggccgctctagaactagtggatcccccgggctgcaggaattcgtctcacccctagaaaaatcccaaacacaacccacactactaccctacccgtccgcctctctcgaaagcgcagcaccagcgagcatgtcgcctgtcaccgcactcctggcgggcacggtggtgccgccggcctcggccccgtcgccagcgaggcacgcccgccattactccgtcggcttctccccgctccacggcggcgggcgcgcggcgctggcggtggagtgctcgtcgcggccgcagaagaaggggaccaagcaccacatgaagacgcggcccaagaagacgcagccgtgggacatcaagcgccgccccacgcagtacccgccgctgccgccgctcccgccggactggacgctcgtcgcctccggcgccacggtggacgtggaggaggcggaggccccggcacccgccgcgactctcgtcctcgacgtggccgcggccaccgactgaggccgccgcggcgtgtcgccaaagttgttcccttgaacctccgcataagctgtttttctttgagatttattatataataacaatggctgcccagattttgtgattataaattaagaatctttcattgctgtccagattgtggttgtcaccgcgtccaaatttagtgcgttgctagatgatttcntaggntgcatgctgtgtgcaacgcttattccatgcggtcagtggcagtgcagactgcagagtgattagctactccatctccatagtttgccagt

SEQ ID NO: 78400 - protein, 121 aa, Zea mays
  misc_feature: Ceres CLONE 1563403
MSPVTALLAGTVVPPASAPSPARHARHYSVGFSPLHGGGRAALAVECSSRPQKKGTKHHMKTRPKKTQPWDIKRRPTQYPPLPPLPPDWTLVASGATVDVEEAEAPAPAATLVLDVAAATD

SEQ ID NO: 78401 - DNA, 791 bp, Zea mays
  misc_feature: Ceres CLONE 1563406
  misc_feature: Translation starting site: 181
  misc_feature: SWISSPROT Homolog: EC 3.1.27.1 Ribonuclease T(2)
agctccccgcggtggcggccgctctagaactagtggatcccccgggctgcaggaattcgtctcacccctagaaaaaatctcccacctcgatccctgcgctgcaagcaacaaagttctactctgtccacccgtccatctagctcccaagaaccaacccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaaagccggcggcggacttcgggatccacggcctcttggcccaaccgcgacgacggcacgtacccgcagaactgcagcccccgacaaggccttcacccgtcaaagggaagcaacctgctgaacaccctcccggccaagtggccaaacctgggggggcccttccaaaaaaagggctggcctttcgggggccccaaatggggaaaaaaaaggggcccctgggcaaaccaaaaattttttaaaaaaaacagggttttttttcaaggggcggggtggggcccctcccaaaaaaaagggggggaattctctgggggcccctccctcccccccgggggggaaaaaccccccaaagggggggggttttaaccccctggtaaaaaaaaaaataaagggggggccccccccccccgcgagggggcaaccgggtttttttaccccccccccgcggggggg

SEQ ID NO: 78402 - DNA, 763 bp, Zea mays
  misc_feature: Ceres CLONE 1563407
  misc_feature: Encodes the peptide sequence at SEQ ID NO. 78403
  misc_feature (536)..(536): n is a, c, t, g, unknown, or other
ctcaccgcggtggcggccgctctagaactagtggatcccccgggctgcaggaattcgtctcacccctagaaaaaaagcgttccagatcgtactggaccaatctgccaccacactttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgttcccggaagccaagcccgcctcggcggcggcggcggcgagcaggagtgtggtcggggtggacagggactacctgtcctacgacgagccaaagacggtgttcccgggcgaggcgtgcgacgacctcggcggcgagttctgcgaggcgccgtaccangacggcgtctccagggagctggcgcacgcctgaagaccctgatccatccatgtctgtccacacgctatgtacgtatgtgtagcagatggtttacatctaccgtgttagaccaactccagcagcactccgcatgcggctccgggatccctattttgcggagcctagctcactattcatcagtccagcaggctcccgaatcggctccgtaaaaaccccggccctgtact

SEQ ID NO: 78403 - protein, 138 aa, Zea mays
  misc_feature: Ceres CLONE 1563407
  misc_feature (1)..(126): Pfam Name: Lir1 Pfam Description: Light regulated protein Lir1
  misc_feature (128)..(128): Xaa is any aa, unknown, or other
MQAAATAAGFSAVLPAKGRPAARSRVVARVPATRRSVRAAAVVATEAAQIDYSSSVSVFPMEACDLLGGDACNGPMFPEAKPASAAAAASRSVVGVDRDYLSYDEPKTVFPGEACDDLGGEFCEAPYXDGVSRELAHA

SEQ ID NO: 78404 - DNA, 838 bp, Zea mays
  misc_feature: Ceres CLONE 1563408
  misc_feature: Translation starting site: 141
  misc_feature (533)..(533): n is a, c, t, g, unknown, or other
ctggagctccccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaacccgcgagctggaggtgatccactcccgctgggccatgctcggcgcgctcggctgcgtcttccccgagctgctctcccgcaacggcgtcaagttcggcgaaggccgtctgggtcaaggccngctcccagatcctcagcgagggcgggctggactaccttggcaccccagcctgatcacgcgcaaaacaccctcccattcgggcctgccaggtctgcccatgggccccctcaagggttaccgtattccgggcggcccctcgggaaagccctcaaccccttttaaccctgggggaagtttaacccccctgggcttggcaaaaaaccccaaggcctttcccaaactccaggggaaaggacccaaaaaagcgcccccccccagtttttcccaggttggggttttttccaaaggccattttccccggggag

SEQ ID NO: 78405 - DNA, 756 bp, Zea mays
  misc_feature: Ceres CLONE 1563409
ggagctcaccgcggtggcggccgctctagactagtggatcccccgggctgcaggaattcgtctcacccctagaaaaatagactgacctctccatcgagtagtttactcactagtctacagctagctttttgctttgctctccagacaaaccgcagccgatcgcctccacgatcatggccgccacctcccccttcaccgcgggcaaaacgacgtttcttgtccatgaccaccaccacctccgcgccctcttatgaccgccccattccccaacgacgccgccgcgatgcctcgggcgcagatctccatgggtcatcgtacctgtgatactgcccggacctcaccaagtacgtgtcccccttctccaccgagactccacttctcctgacgtgcgacttccgctgcatactacggctggcatgcttccgggctgtccgcggacccataggcatccccgcagaacatgtctctggaggtgatccacgagccgagacctatcctggatcgacttgggctgcgtcaccacagatgagcatgataagtgtgtgcctcacggactcaaggagcccatgatgatcaggcccaagacgcacatcttcatcgagacctgctggacttcctagggatcaccatctggtgcactcgctgacattctggcaggacttgactacaagtatcctcataagcctcgtaagggctacgattcacgctttttgacgccttgacatgcaaacgactctgcccgatcgctgaaattaa

SEQ ID NO: 78406 - DNA, 770 bp, Zea mays
  misc_feature: Ceres CLONE 1563411
  misc_feature: Translation starting site: 190
  misc_feature (619)..(619): n is a, c, t, g, unknown, or other
  misc_feature (639)..(639): n is a, c, t, g, unknown, or other
  misc_feature (749)..(749): n is a, c, t, g, unknown, or other
ctccccgcggtggcggccgctctagaatagtggatcccccgggctgcaggaattcgtctcacccctagaaaaaagcgcctccagttgcagagtccagacgccagacgccctctacttctctctagttagtgtacatttcaaactcttggccgccgcctcgctctctgttcgccgcgccccgccgcagaaatggcgctgccgaatcagcaggttgtggattaccccagcttcaagctcgtcatcgttggcgacggtggaactggcaaaaccacatttgtgaagaggcatcttactggcgagtttgagaagaaatatgagcccaccattggtgttgaagttcaccctctcgattttagcactaactgtggcaaaattcgtttctattgctgggacactgctgggcaagaaaagttcggtggcctcagggatggctactacattcatggtcagtgtgccatcattatgtttgatgtcacttcgaggctgacatacaagaatgttccaacatggcacaggggacctgtgcagggtgtgtgagaacatccccatcgttctctgcggaaacaaggttgatgtaaagaacaggcaggtcaaagccaagcaagttacattccacggnaagaagaacttgcagtactnatgagatttctgccaaagagcattacaacttttgaggaagcccttcctttacctcgcaagggagcttgggcaggggatcaagaaccttcactttgggtcgaagccgttgnctctgaaagccaccgggaagg

SEQ ID NO: 78407 - DNA, 849 bp, Zea mays
  misc_feature: Ceres CLONE 1563412
  misc_feature: Encodes the peptide sequence at SEQ ID NO. 78408
ccccgcggtggcggccgctctagaactagtggatcccccgggctgcaggaattcgtctcacccctagaaaaatcccccggagctccacaaaaatctcccctcccaggctcccacccgcgcggagggggctgcaccgcagcagccagcagccgcgcggcgccactgccttgccctcacccaaacgcctcgctttggccgccccccacaaggccactcacccaaaaaatcttcactcctcgaccgcaccgagcagaggatcacatggcatccgccgtttcgcttctcctctcgcccccgcgcctgctccaccgcgacggcacatcccgcctcctcagcatcccgcaccggagggtcctcctcgccgcccccaacaacgcgacccctcgtcggctcctcgcccccgcgccgcgcgcctccaacaacaacgacaacagcggggccgtggaggcgcccgaccgcctcgtggccgcggtcgcctacctatacccgttcctcgacggcgcgcaccacgggcgcttccttctcacgcagttccccttcttcggcgcgctgctccgcccgctggcccccgcggctcggctcttcccactcatcgcgctcacgcccttcctcctcttcatcacgctctacttcggcgttgtgcggaaccagcaggcgttctcccgcttcggccgcttcaacgcgatgcaagccgtccgtgctcgacgtgctgctcatctttcccgacctgctcgcgcagtcgtcgcgccctccgggtggggttggggttccagatccttcaaaacatggaagaaaaagggccttcctccttccggcccgttctccctgggtgtaccgggcgggggccct

SEQ ID NO: 78408 - protein, 196 aa, Zea mays
  misc_feature: Ceres CLONE 1563412
MASAVSLLLSPPRLLHRDGTSRLLSIPHRRVLLAAPNNATPRRLLAPAPRASNNNDNSGAVEAPDRLVAAVAYLYPFLDGAHHGRFLLTQFPFFGALLRPLAPAARLFPLIALTPFLLFITLYFGVVRNQQAFSRFGRFNAMQAVRARRAAHLSRPARAVVAPSGWGWGSRSFKTWKKKGLPPSGPFSLGVPGGGP

SEQ ID NO: 78409 - DNA, 786 bp, Zea mays
  misc_feature: Ceres CLONE 1563413
  misc_feature: Encodes the peptide sequence at SEQ ID NO. 78410
  misc_feature (633)..(633): n is a, c, t, g, unknown, or other
  misc_feature (754)..(754): n is a, c, t, g, unknown, or other
ctccccgcggtggcggccgctctagaactagtggatcccccgggctgcaggaattcgtctcacccctagaaaaaagcgcacctcatctcgctccaagcacaccaccactccacagtgcacttcactctctacagcaacagaaaagtgagcagcagacagcagcagctgctgccatggaggcgtggagatctctcctcgcgagcttcgtgctcgccgtgctggccgcgcaggccttggtggccgtggtcgagtccaggaccggtcccgtggagcaggcgagcgaaggtgacgacgtgaagaagccggactgcgtgccggggatggacccgcgctcgttcccggggaccggcggcggccacggcatcacgcccgtgacgccatcgcacggaggctccagctccccgacgccgtcccacggcggcggcggcgggtacgttccaacgccgtcgcatggcgggacgctgcctttcccgtcccacggcggctccggctccggctcctctccgacgtcgccctccaccggcggcggcgcgtacggtgggtctccgtccacccccggcggtggcgcgtacggtggggctccctccgtccacccccagcggcaggcggcgcgtatgggtgggtctccgtctnactcccagcggtggcggcgcctaccggaggcaggtccccctcgcctgctcaatggtgctggtgggcgcctatgggagctctcccaaccgccgccgtacggcgattccccccttgcacggcnggcattcggtacctcgtcaaccaaacgacttt

SEQ ID NO: 78410 - protein, 204 aa, Zea mays
  misc_feature: Ceres CLONE 1563413
  misc_feature (154)..(154): Xaa is any aa, unknown, or other
  misc_feature (194)..(194): Xaa is any aa, unknown, or other
MEAWRSLLASFVLAVLAAQALVAVVESRTGPVEQASEGDDVKKPDCVPGMDPRSFPGTGGGHGITPVTPSHGGSSSPTPSHGGGGGYVPTPSHGGTLPFPSHGGSGSGSSPTSPSTGGGAYGGSPSTPGGGAYGGAPSVHPQRQAARMGGSPSXSQRWRRLPEAGPPRLLNGAGGRLWELSQPPPYGDSPLARXAFGTSSTKRL

SEQ ID NO: 78411 - DNA, 781 bp, Zea mays
  misc_feature: Ceres CLONE 1563414
  misc_feature (282)..(282): n is a, c, t, g, unknown, or other
  misc_feature (344)..(344): n is a, c, t, g, unknown, or other
  misc_feature (507)..(507): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (520)..(520): n is a, c, t, g, unknown, or other
  misc_feature (521)..(521): n is a, c, t, g, unknown, or other
  misc_feature (554)..(554): n is a, c, t, g, unknown, or other
  misc_feature (559)..(559): n is a, c, t, g, unknown, or other
  misc_feature (567)..(567): n is a, c, t, g, unknown, or other
  misc_feature (573)..(573): n is a, c, t, g, unknown, or other
  misc_feature (654)..(654): n is a, c, t, g, unknown, or other
  misc_feature (660)..(660): n is a, c, t, g, unknown, or other
  misc_feature (680)..(680): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (688)..(688): n is a, c, t, g, unknown, or other
  misc_feature (689)..(689): n is a, c, t, g, unknown, or other
  misc_feature (696)..(696): n is a, c, t, g, unknown, or other
  misc_feature (699)..(699): n is a, c, t, g, unknown, or other
  misc_feature (707)..(707): n is a, c, t, g, unknown, or other
  misc_feature (708)..(708): n is a, c, t, g, unknown, or other
  misc_feature (715)..(715): n is a, c, t, g, unknown, or other
  misc_feature (716)..(716): n is a, c, t, g, unknown, or other
  misc_feature (733)..(733): n is a, c, t, g, unknown, or other
  misc_feature (735)..(735): n is a, c, t, g, unknown, or other
  misc_feature (737)..(737): n is a, c, t, g, unknown, or other
  misc_feature (740)..(740): n is a, c, t, g, unknown, or other
  misc_feature (741)..(741): n is a, c, t, g, unknown, or other
  misc_feature (747)..(747): n is a, c, t, g, unknown, or other
  misc_feature (750)..(750): n is a, c, t, g, unknown, or other
  misc_feature (751)..(751): n is a, c, t, g, unknown, or other
  misc_feature (754)..(754): n is a, c, t, g, unknown, or other
  misc_feature (779)..(779): n is a, c, t, g, unknown, or other
ctccccgcggtggcggccgctctagaactagtggatcccccgggctgcaggaattcgtctcacccctagaaaaaagccgcctcatcctctagccgatctccttttttgtcgcctccgtgcgtgccccgggggccttgatcgcgcgcaccggtcagctcagcccgtctgattcgcgtgctgccagccctccgccgatcgtgaaacacaaccgtcggtggtttgcttgcttgatcgctgatcctcgcggacgctcacggtcatggcgcctcagcctttgcgcgnctccgagggctgagcggcccccccgcctggcgcccccccggggggtggcaagggggtctccngggccccccccccccctcttttttttggggaaaaaaagggggggcccccccccccccccgggggggggggggggtttttcccccccccccccccccccccccctaaaagagggggggggggggggcccccccccccccccccccccgtttttttttttttttnccccnncnnnggnngagagaagaaaaaaaaaaaaaaagtcccctttnttatntccccccncccccngccccccctttttcttttttttttttttaaaaaaaaaaaaaaaaaaaaaaaaaaatttattatttgctctccccccccccnccgccngggggggggggggggggggngnnnccanncaaaaanaanaaaaaaannaaaactnnaccccccccccccaccncncnctnnaaaaanaanntanaaaggtaggtaggagggggaggganct

SEQ ID NO: 78412 - DNA, 818 bp, Zea mays
  misc_feature: Ceres CLONE 1563415
  misc_feature: Encodes the peptide sequence at SEQ ID NO. 78413
tggagctccaccgcggtggcggccgctctagaactagtggatcccccgggctgcaggaattcgtctcacccctagtagtcccccccccccggattttcgacatacggaaaaaaaaaaaaaagatctacaaaaataaataatcaaaaaaattgttctctcgctttattccctttcaaagtccccgcttttggattcccaaaaacaagctgggagcttttttttcccggctgggggctcgtcgaaaaagctgccgccatgtttgccggaaaccagctcgccgctctggtcagaaacatgtaccccacgggtttgcttgaaaataagttccagaagctccagctgctccaggaccccagcgcccctgacttcgtctccaaggtcgtcacgctcttctgtcaggacggcgagcggatcatcaaaaagcgggccaaactgctggaaaaccccaacggggattttgacagggttgacccctttgggcatcagctcaagggaagcagggcaaatattggggctcaaaaggttaagaacacttgcattcagttccgcaaattctgtcagcaaaaaaccaaaaatgggggcctcagggtacgggagacaatgaggattaacttctatgagctgcgtggaaagtttcaaaccatgcttcagctggagcgtcaggtcaaagggctttccccccaacaagtaaacaagagggtgggagtggaaccttcatgttaagaaaagagccttgcccccttttaaaagtttcaaaaaaatttcgggaatggagcccccccaaattgggttttctggggaaaaatcctggttaaaat

SEQ ID NO: 78413 - protein, 155 aa, Zea mays
  misc_feature: Ceres CLONE 1563415
MFAGNQLAALVRNMYPTGLLENKFQKLQLLQDPSAPDFVSKVVTLFCQDGERIIKKRAKLLENPNGDFDRVDPFGHQLKGSRANIGAQKVKNTCIQFRKFCQQKTKNGGLRVRETMRINFYELRGKFQTMLQLERQVKGLSPQQVNKRVGVEPSC

SEQ ID NO: 78414 - DNA, 790 bp, Zea mays
  misc_feature: Ceres CLONE 1563416
  misc_feature: Encodes the peptide sequence at SEQ ID NO. 78415
ctccccgcggtggcggccgctctagaactagtggatcccccgggctgcaggaattcgtctcacccctagaaaaaccccccccccccatctctcctcccctccccatctcgctcttgcggagatcgaagagaagctgaggcctagcgccgcacccgccgccgcatcagccatcagccatggcgatggccgctcgcctcgtctcgcgctcccgtcagctacattcggttcaagcagcttttgcgaatggaggtgccactcaagttcgctcctttgccaaggatgcagctccagctgaccgtcctcctgttggtggggatgatctcctgaagggcatattctttgaggtaaagaagaagtttgagacagctctcgggcgtcccttaaaaaggaaaagatcactattgatccagatgacccagcggcagtttctcatatgctcaagtcatgaagactggtagggaaaaagcgggatctctttctgattctcaaggattaaatataccattgagaccttcacaagggcatccctgatgcaccggactacctggatactcttcaaccagcccagaaaaaaaaggggccttaaaaatcatattggaaacccaacccttggatgaatggagactcctttaaaaagatttgggaaaggaatttttaaaaaaccccttttttaaggggggggcaaaaaaaaaaacctggggccccccctcttatggggcaaaatttttgcaaaaaaatttaacccccaaaaacttttgtggttttctcggaaaaaggagggaactcctcc

SEQ ID NO: 78415 - protein, 93 aa, Zea mays
  misc_feature: Ceres CLONE 1563416
MAMAARLVSRSRQLHSVQAAFANGGATQVRSFAKDAAPADRPPVGGDDLLKGIFFEVKKKFETALGRPLKRKRSLLIQMTQRQFLICSSHEDW

SEQ ID NO: 78416 - DNA, 845 bp, Zea mays
  misc_feature: Ceres CLONE 1563418
  misc_feature: Encodes the peptide sequence at SEQ ID NO. 78417
  misc_feature (586)..(586): n is a, c, t, g, unknown, or other
ctccccgcggtggcggccgctctagaactagtggatcccccgggctgcaggaattcgtctcacccctagaaaaaggtcctgtacggcggcgtggtgaagaagaagtcgggccgtgaactcggccttcatggcgctgtacgcgttcccggcggtgtggaatctgctgggtgacctgcgcctacaacatgtccttcggcgacaggctgctgccgctgtggggcaaggcgcggcctgcgctgatccagggcgggctggtggggcaggccggcctccccgccacggcacaccacttcgccagcggcgccctggagacaccggccgcggagccgcttgtacccgatggccacggtggtgtacttccagtgcgtgttcgcggccatcaccctggtgctggtcgccgggtcgctgctgggccggatgaccttcgccgcgtggatgctgttcgtgccgctctggctcaacttctcctacaccgtcggcgccttctccgtatgcagcagctggttcctcttcaattggggcgtcatcaactactgcggcggctacgtcatccacctctacgctggcttcgccgggttcacggcancctactgggatgggcccgatgcacaaaatgaacggggataagttcccgcccaactacatcctgttcacactctccctctcgggcctgctttaggattgcggtgtgcatgcttcaccggtggccggccgtactcccccaacgaggctggccgtccatgtcggggctgaacacaaaatcggctccggcagggaaactcctcttttgaacttggcctaggacgtgttctccttaaagaaagcttccgtcttggtccccctcc

SEQ ID NO: 78417 - protein, 95 aa, Zea mays
  misc_feature: Ceres CLONE 1563418
  misc_feature (83)..(83): Xaa is any aa, unknown, or other
MATVVYFQCVFAAITLVLVAGSLLGRMTFAAWMLFVPLWLNFSYTVGAFSVCSSWFLFNWGVINYCGGYVIHLYAGFAGFTAXYWDGPDAQNERG

SEQ ID NO: 78418 - DNA, 776 bp, Zea mays
  misc_feature: Ceres CLONE 1563419
  misc_feature: Encodes the peptide sequence at SEQ ID NO. 78419
  misc_feature (359)..(359): n is a, c, t, g, unknown, or other
ggagctcaccgcggtggcggccgctctagaactagtggatcccccgggctgcaggaattcgtctcacccctagaaaaaaacaaaaggtttggatagaacactctgcttccccgtccttcggtctagcccgagtggacgtaggaagggacgaggggtcttgacgccggcgagccatggcgggggctctcctctcctctccgcacactctcccgagccccacatctcagtccccgttccgccccaggagcaggggaccactccacgctggggcagcgcgtgttctgccaccgaggaggagggcctttgtgctcgcttcgtgctctcgcgagcctgccgctaggaaccgcgggttggaggtnggagaggaggcgccttctcatgtccgggctcgtgtcttctttcgcaatcatgctccccatttcagaagcatatgctgtcatggagactgatgaagacgtgaagatgaacacacaaattgatgagatcaatgcatactcttttctttacccggtggaactgccagggaagaaatttgccttcaaatgggtagagtccagaaaaccagagcgatattcctctgcagcgccactatcgcctgatgcaaagcaacgtatcgtatcagagcgagttgacatgatacacaatgttgtcatctccgtctcgattgggccacccgaattcccgtttttttgcttcaaaagacagaacctcgtggggacccaaaaagatgttgcctgattgccattttatctggatagatccaccattgaaggggt

SEQ ID NO: 78419 - protein, 119 aa, Zea mays
  misc_feature: Ceres CLONE 1563419
MSGLVSSFAIMLPISEAYAVMETDEDVKMNTQIDEINAYSFLYPVELPGKKFAFKWVESRKPERYSSAAPLSPDAKQRIVSERVDMIHNVVISVSIGPPEFPFFCFKRQNLVGTQKDVA

SEQ ID NO: 78420 - DNA, 816 bp, Zea mays
  misc_feature: Ceres CLONE 1563420
  misc_feature: Encodes the peptide sequence at SEQ ID NO. 78421
ggagctccccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgtctcggcccatggtggtgcgcaagccggcgcacctgttcctgacgaactggggcgtggcgtacgacaagcccgaggactacgtggtcatcaggcacgccgcgctcttcacggtcacggtcatgagccctgctctgcgcgccccaacgtcagctgttcaacgcgtggccgtggaagactcatcctcaggggagggcccttcggcgcgtcgtcacaaatgggcgctcgtgtcatgaaccaca

SEQ ID NO: 78421 - protein, 212 aa, Zea mays
  misc_feature: Ceres CLONE 1563420
  misc_feature (64)..(211): Pfam Name: Thi4 Pfam Description: Thi4 family
  misc_feature: SWISSPROT Homolog: EC 1.1.99.1 Choline dehydrogenase
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLSRPMVVRKPAHLFLTNWGVAYDKPEDYVVIRHAALFTVTVMSPALRAPTSAVQRVAVEDSSSGEGPSARRHKWALVS

SEQ ID NO: 78422 - DNA, 766 bp, Zea mays
  misc_feature: Ceres CLONE 1563421
  misc_feature: Encodes the peptide sequence at SEQ ID NO. 78423
  misc_feature (554)..(554): n is a, c, t, g, unknown, or other
  misc_feature (580)..(580): n is a, c, t, g, unknown, or other
  misc_feature (625)..(625): n is a, c, t, g, unknown, or other
tggagctcaccgcggtggcggccgctctagaactagtggatcccccgggctgcaggaattcgtctcacccctagaaaaagctcgctccaagctccgagaacgcaaacagctcactgtaccagtgtacccgagctcgtggcctcgcctggcctggctagcgtttcttcgtgcgtgcgcaagcacctaggctgcatcctgcggccaccatgtcgtcgggcacgggcacgggcacgggcactggcaggtcgtccaccaggaggggaaagggcggcagcttcacgctgaggcatcagccgccggtggtggacatcggctgcaactgccgccgccccaagctgttctccgtcttctcgtcgtcgctgttccgcggcgggggcaagcccaagtcccccaacgcatcctccacctccaccaccacggcgttcacggccaccaccgcgggcgggcgcagccgcagccgcagcggcacgacgacggccacctccaccgactcctcctcctggggccccgcgtcgttcgtcgccaccaactcgctgtacgaggagccggtactngcccggcggcggtggcgccgccgcangagcgggagcagcaggaggcgaggcggcggcggaggcagcacagncagcagcgccggcgccgcagcaagcggtcgccgccgcccgcgccccacggcgcggttggcggaagaggacaagatctgggatccgggcggcggtgggccccgaaaaactgggcgttggcgggggggaatcccggcggaccc

SEQ ID NO: 78423 - protein, 186 aa, Zea mays
  misc_feature: Ceres CLONE 1563421
  misc_feature (125)..(125): Xaa is any aa, unknown, or other
  misc_feature (140)..(140): Xaa is any aa, unknown, or other
MSSGTGTGTGTGRSSTRRGKGGSFTLRHQPPVVDIGCNCRRPKLFSVFSSSLFRGGGKPKSPNASSTSTTTAFTATTAGGRSRSRSGTTTATSTDSSSWGPASFVATNSLYEEPVLARRRWRRRXSGSSRRRGGGGGSTXSSAGAAASGRRRPRPTARLAEEDKIWDPGGGGPRKTGRWRGGIPAD

SEQ ID NO: 78424 - DNA, 833 bp, Zea mays
  misc_feature: Ceres CLONE 1563422
  misc_feature: Encodes the peptide sequence at SEQ ID NO. 78425
  misc_feature (372)..(372): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (574)..(574): n is a, c, t, g, unknown, or other
ctggagctccccgcggtggcggccgctctagaactagtggatcccccgggctgcaggaattcgtctcacccctagaaaaaagtatcagttcgccaactactctgcgaactacatctactggggcaagggcagcatccggctgcagctcatcaaccagcgctccgacttctccttcgccctcttcaccggcggcctcagcaacccgaggctgatcgcggtgtcggagcccatatcgttcaagaaccccaaggcgcccgtgttcccgcgcctggcgcagggcacgtcccacgacgagatgacggtgacgtggaccagcggctacgccatcgatgaggcgtacccgttcgtggagtggggcgccctgtcgcagcngnnnnnnggggcggctgctcccggcacaccgcgcgcgcgcccgccgggacgctcaccttcaaccgcggcagcatgtgcggcgagccggcgcgcaccgtcgggtggagggaccccgggttcatccacaccgccttcctcagggacctctggcccaacaaggagtaccactaccggatcgtggcacgagctccccgacgggtcnggtgggtgtggggcaagccctactccgttccggggcgccgccgtcgccggggcagccgtctctgcagcgcgtgatcgtgttcggcgacatggggaaggcggagcgggacgggtcgaacgagtacgcggcgtaccagcccgggtcgctcaacaccacggacgcgctgatcgcggaactggacaactacgacatcgtgttccacatcggcgacatgccctacgccaacggctacatctcgcagtgggacagtttcacggct

SEQ ID NO: 78425 - protein, 168 aa, Zea mays
  misc_feature: Ceres CLONE 1563422
  misc_feature (15)..(15): Xaa is any aa, unknown, or other
  misc_feature (16)..(16): Xaa is any aa, unknown, or other
  misc_feature (17)..(17): Xaa is any aa, unknown, or other
  misc_feature (82)..(82): Xaa is any aa, unknown, or other
MRRTRSWSGAPCRSXXXGRLLPAHRARARRDAHLQPRQHVRRAGAHRRVEGPRVHPHRLPQGPLAQQGVPLPDRGTSSPTGXVGVGQALLRSGAPPSPGQPSLQRVIVFGDMGKAERDGSNEYAAYQPGSLNTTDALIAELDNYDIVFHIGDMPYANGYISQWDSFTA

SEQ ID NO: 78426 - DNA, 787 bp, Zea mays
  misc_feature: Ceres CLONE 1563423
  misc_feature: Encodes the peptide sequence at SEQ ID NO. 78427
  misc_feature (464)..(464): n is a, c, t, g, unknown, or other
  misc_feature (473)..(473): n is a, c, t, g, unknown, or other
  misc_feature (538)..(538): n is a, c, t, g, unknown, or other
ctggagctccccgcggtggcggccgctctagaactagtggatcccccgggctgcaggaattcgtctcacccctagaaaaagtccagacgtgcatcatatcctccgtgtgatccattcatccccgcgccgtgctagcttgctagttgcaagcaccagccgaccaccaaacggtagcgcacgcggacaatttaacagcatcaggtttaggccctgctgccgtcgtcgagcgcccgggccaccgcacacctgaaagcaatggagatcgtcgccacgcgctccccggcttgctgcgccgccgtgtccttctcccagtcgtacaggcccaaggcgtccaggccgccgaccacgttctacggcgagtcggtgcgggtgaacacagcgcggccgctctcggcgaggaggcagtccaaggcggccagccgcgcggccctcagtgcccggtgcgagatcggagacagcctggnagagttccntgacaaagcgacgccggacaagaacctcatcaggctgctcatctgcatggggggaagccattgangacgatcgcgtttcagggtcccggacgggcgtcctgcggcggcacgggcctgtgttcattttccttcggcgaacagccaacctggcccgtcaaacatgctccgctaacaaagctcccccctttgagggctttttggagaactccccaatgggggtgttaaaaattttgccgtgccccccccaaggaaaaatcccccccaaacctccccaagaaaaaggggggggtgggcccccactcccaaaaaggggg

SEQ ID NO: 78427 - protein, 93 aa, Zea mays
  misc_feature: Ceres CLONE 1563423
  misc_feature: SWISSPROT Homolog: EC 3.1.3.37 Sedoheptulose-bisphosphatase
  misc_feature (70)..(70): Xaa is any aa, unknown, or other
  misc_feature (73)..(73): Xaa is any aa, unknown, or other
MEIVATRSPACCAAVSFSQSYRPKASRPPTTFYGESVRVNTARPLSARRQSKAASRAALSARCEIGDSLXEFXDKATPDKNLIRLLICMGGSH

SEQ ID NO: 78428 - DNA, 879 bp, Zea mays
  misc_feature: Ceres CLONE 1563425
  misc_feature: Encodes the peptide sequence at SEQ ID NO. 78429
  misc_feature (658)..(658): n is a, c, t, g, unknown, or other
  misc_feature (777)..(777): n is a, c, t, g, unknown, or other
  misc_feature (822)..(822): n is a, c, t, g, unknown, or other
ctggagctccccgcggtggcggccgctctagaactagtggatcccccgggctgcaggaattcgtctcacccctagaaaaaaatctccccttaacaactccactcccgcggaaaaaaaacccatatccctccggcataaacccaaaaagctgcaagcagtgtgaccaaaagcaggcctgacggcgatcctcggctctctagccaggcagcaggagatggagcacgacgtgcaccaccagcaggccatggagctgccgccggggttccgattccaccccaccgacgaggagctcatcacgcactacctcgccaggaaggccgccgacgaccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacgggactgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctncatgccgtcgtcggtcagagctggcgcgtcaaaggacgagtgggtgctggtgcagggtgttcaagaagagcatcgagccgccgccgtcagtgggcaagaagtcgttcggtcgcgtgtangggacaataaggggggggggaaggaaaaactccctgggagaccgnccttccatggtcaatgggaaggagaaaacctccgccgcgttggcgccgttgccctcc

SEQ ID NO: 78429 - protein, 190 aa, Zea mays
  misc_feature: Ceres CLONE 1563425
  misc_feature (13)..(139): Pfam Name: NAM Pfam Description: No apical meristem (NAM) protein
  misc_feature (188)..(188): Xaa is any aa, unknown, or other
MEHDVHHQQAMELPPGFRFHPTDEELITHYLARKAADDRFAPRAVGEADLNKCEPWDLPSRATMGEKEWYFFCVKDRKYPTGLRTNRATESGYWKATGKDREIFRSKALVGMKKTLVFYTGRAPRGGKTGWVMHEYRLHGKHASSSRLHAVVGQSWRVKGRVGAGAGCSRRASSRRRQWARSRSVACXGQ

SEQ ID NO: 78430 - DNA, 839 bp, Zea mays
  misc_feature: Ceres CLONE 1563427
  misc_feature: Encodes the peptide sequence at SEQ ID NO. 78431
  misc_feature (239)..(239): n is a, c, t, g, unknown, or other
  misc_feature (370)..(370): n is a, c, t, g, unknown, or other
  misc_feature (641)..(641): n is a, c, t, g, unknown, or other
  misc_feature (678)..(678): n is a, c, t, g, unknown, or other
  misc_feature (679)..(679): n is a, c, t, g, unknown, or other
  misc_feature (682)..(682): n is a, c, t, g, unknown, or other
tggagctccccgcggtggcggccgctctagaactagtggatcccccgggctgcaggaattcgtctcacccctagaaaaaatatttgttaagtttcaggcagagagaaagatagaggagcaaacagcaactccagaagatgagtctccctcgccgccgccaccttgtcctgctcgcctgcctcctggtcttcctcgtcttcgccgcgtccgcgtcgacgagttccgccgaggtggccccnagcgtggcggtggacttcgtgcggcggtcgtgccggtcgacggagtacccgcgcgtgtgcgagagcacgctggtcccctgcgcggctggcgtggggcgcagcccgcgcctgctggcgcgagcggcgctggntggttggcgccgaccgcgcgcgcaactgctcctcctacatccgcggcggcggcggcggcgcgatgaaggactgcgcggagctggcgcgcgacgcggaggagcggctgcggcagtccgcggcagagatggagcggatgggccgtgccggcacaccgcgcttcgcttggtccctcagcaacgtccagacctgggccagcgccgcgctcaccgacacctccacctgcctcgactccctcgcccagcagtcccgcggtggcaggacagcgacacncctcgaaaaaaaaaagggggggggggggggggggggnngtngagaaagaccacaagaaaacgcgctggggctcgtcaacagggctccaagcgggcgccgcaacgggcggcgttctcctggtgacttctggtaccagcagctagccacggaaaaaccttgaatgggtccctccgttctccatccatggtcgaacatcat

SEQ ID NO: 78431 - protein, 122 aa, Zea mays
  misc_feature: Ceres CLONE 1563427
  misc_feature: SWISSPROT Homolog: EC 3.1.1.11 Pectinesterase
  misc_feature (70)..(70): Xaa is any aa, unknown, or other
  misc_feature (83)..(83): Xaa is any aa, unknown, or other
  misc_feature (84)..(84): Xaa is any aa, unknown, or other
MKDCAELARDAEERLRQSAAEMERMGRAGTPRFAWSLSNVQTWASAALTDTSTCLDSLAQQSRGGRTATXLEKKKGGGGGGGXXERPQENALGLVNRAPSGRRNGRRSPGDFWYQQLATEKP

SEQ ID NO: 78432 - DNA, 708 bp, Zea mays
  misc_feature: Ceres CLONE 1563428
agctccccgcggtggcggccgctctagaactagtggatcccccgggctgcaggaattcgtctcacccctagaaaaaaaagcaagcctagcaccgcaacgcaatcaaacccaagacaaatccaaccaaccaagctattccccatctccggaccagcgccgcctccagtcgctgtccacgggcaccccgggcgcgcctcctccgagcccagactcgagctccatcccgccgtggatcaccgcgtgaggtggggcgcaccgaccggaccccggagggccagatggtgtccggcgccggagggggcgagtagcgcggtcggcggccacgaacggattggcggcggcgcggcgaggcgtcggtcggagcggggccacctgtctgctgtagtggcggcaagaggtcctcctcatctcggcgacgagcttgtaccttcccttcctcccctcgtccctttccacaccatcaccccgccaagagggccgctgctcccgtccgctggaggaaggtctaatccacaccttcctacccttttccggaatggatccccagtttactgaaaaaactcttgaggccccgggaaatgacttggaccctgcaattaaaaagtttaaccgacctgcaaactggaattaggctgggggctttcccattcctggccccggggtttggggaattctggaaaaagggaaattttcctcccgcccccaaaa

SEQ ID NO: 78433 - DNA, 827 bp, Zea mays
  misc_feature: Ceres CLONE 1563430
  misc_feature: Encodes the peptide sequence at SEQ ID NO. 78434
  misc_feature (715)..(715): n is a, c, t, g, unknown, or other
  misc_feature (757)..(757): n is a, c, t, g, unknown, or other
  misc_feature (805)..(805): n is a, c, t, g, unknown, or other
ggagctccccgcggtggcggccgctctagaactagtggatcccccgggctgcaggaattcgtctcacccctagaaaaatcgccgcaacgaattcccggtctccaaccagccggccagccaccgcagacgacccctagttccgcgtccccgacccgaaccctcgagttcgcacgggctccggccagattcgcgcggtctaagcttcgaatcggcgcatggaggcagcagtagccgcggcactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaggcgaagcagtgtggtcagggcctcctggtccccctcggagtctctgccaccgtcctcgtcgatggcgccgctcaggatggaatcgcccgcggggcagctactctcccagattcttcacacgcacccgcacctactgcctgccgccgccgagcagcagctcgagctgctccagaccgaccgcgaggcagagaaggataaggataaggagagcgatgctggcgacaagctggctcccgacaggtgtcgacctcatgctgtacaggcggattgctcaagtaaaggagaaggaacgggaggagggactttggagagaactcctatggctctggtttngttgagaagtttgtttgaagccggcggttttccttggttccnggcactctcacgctcccatcgactccttctggggaaagagttgatcangtgggcagaaaactgtgggaag

SEQ ID NO: 78434 - protein, 128 aa, Zea mays
  misc_feature: Ceres CLONE 1563430
  misc_feature (91)..(91): Xaa is any aa, unknown, or other
  misc_feature (105)..(105): Xaa is any aa, unknown, or other
  misc_feature (121)..(121): Xaa is any aa, unknown, or other
MAPLRMESPAGQLLSQILHTHPHLLPAAAEQQLELLQTDREAEKDKDKESDAGDKLAPDRCRPHAVQADCSSKGEGTGGGTLERTPMALVXLRSLFEAGGFPWFXALSRSHRLLLGKELIXWAENCGK

SEQ ID NO: 78435 - DNA, 794 bp, Zea mays
  misc_feature: Ceres CLONE 1563431
  misc_feature (353)..(353): n is a, c, t, g, unknown, or other
  misc_feature (475)..(475): n is a, c, t, g, unknown, or other
  misc_feature (521)..(521): n is a, c, t, g, unknown, or other
ctccccgcggtggcggccgctctagaactagtggatcccccgggctgcaggaattcgtctcacccctagaaaaatggattgtggtagtagcttctaacacacctggcctggatttgtgcaggacaatgtttttgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaaggacgagatcgcaagggcggtggaggaagagcttgagaaggccatgtcggcttatggcntttgagatcgtgcagactctcatcgtggacatcgagccagacgagcatgtgaagcgcgcaatgaacgagatcaacgcagctgcgaggctcagggcggctgcaaacgagaaggcggaggcggnagaagatcgtgcaatccaaagcgcgcgggatgggggaggcagaaanccaagtacctgtccggggctgaggcattgcgcgccagcggcaggccccatcgtggacgggctcaaaggacagcggtgctggggggtctcccgtcaaacgtggccggacacacccgcccaaagacgtccttgggacatgggtgcctcatcaccccagtacttcgacaccatgggaaagaaaattcggcgcgtccttcccaagaggggccccccggggtttcatcccgcatggcccccccggaagcggggccgcgacaatcgcccaacgcagatc

SEQ ID NO: 78436 - DNA, 773 bp, Zea mays
  misc_feature: Ceres CLONE 1563433
  misc_feature: Translation starting site: 160
tccccgcggtggcggccgctctagaactagtggatcccccgggctgcaggaattcgtctcacccctagaaaaagtctctctaggttttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggagggacagaaggcagctgatgagcgtgccgccgctgccaaggcctcttctaaaagaaagaaagtgtaaatcctccgtccttatggatgtcaaaccatggggacgatgagactgatatgaagaagctggaggaagctgtccgcagtgtcagaattgagggtctgaactggggagcatcaaagcttgtgccctgttggatacgggcatcagaagatgactatcctgtttgacaattgtccaacaatccttgtgtccatcgacacctctaattggaaggaccaccctttacgcaggaa

SEQ ID NO: 78437 - DNA, 812 bp, Zea mays
  misc_feature: Ceres CLONE 1563434
  misc_feature: Encodes the peptide sequence at SEQ ID NO. 78438
  misc_feature (594)..(594): n is a, c, t, g, unknown, or other
ctccccgcggtggcggccgctctagaactagtggatcccccgggctgcaggaattcgtctcacccctagaaaaaactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcngcgtccgcctcgtcaaggcgttccagagcgcctacttcgacaggtacgggcggcggcgccaactcgctcgcctccggctactcccgcggcacgggcttcgggccgagatctcggggacctttgtgctcgtctaaaacggtcttctccgccaccgaccccaagggcaacgcccggactcccaagttccgggtctgggtccccttcccattggggttcct

SEQ ID NO: 78438 - protein, 187 aa, Zea mays
  misc_feature: Ceres CLONE 1563434
  misc_feature (34)..(188): Pfam Name: MIP Pfam Description: Major intrinsic protein
  misc_feature (144)..(144): Xaa is any aa, unknown, or other
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICXVRLVKAFQSAYFDRYGRRRQLARLRLLPRHGLRAEISGTFVLV

SEQ ID NO: 78439 - DNA, 852 bp, Zea mays
  misc_feature: Ceres CLONE 1563436
  misc_feature: Encodes the peptide sequence at SEQ ID NO. 78440
  misc_feature (623)..(623): n is a, c, t, g, unknown, or other
  misc_feature (750)..(750): n is a, c, t, g, unknown, or other
  misc_feature (751)..(751): n is a, c, t, g, unknown, or other
  misc_feature (791)..(791): n is a, c, t, g, unknown, or other
ctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggccntgccaggtcgtgctcatgggcgccatcgaggggtacccgcgtcgccgggcgcccgctcgggagaggtcgtcgacccgctctaccccggcggcagcttcgacccgctcggcctcggcgacgaccctgnnagcctcgccggagctcaaggtgaagagctcaagacggccngctcgccatggtctcccatgtcccgggttcttcgtcccaggcatcgtcaacgggcaggccc

SEQ ID NO: 78440 - protein, 238 aa, Zea mays
  misc_feature: Ceres CLONE 1563436
  misc_feature (64)..(218): Pfam Name: Chloroa_b-bind Pfam Description: Chlorophyll A-B binding protein
  misc_feature (163)..(163): Xaa is any aa, unknown, or other
  misc_feature (205)..(205): Xaa is any aa, unknown, or other
  misc_feature (219)..(219): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAXPGRAHGRHRGVPASPGARSGEVVDPLYPGGSFDPLGLGDDPXSLAGAQGEELKTAXSPWSPMSRVLRPRHRQRAG

SEQ ID NO: 78441 - DNA, 728 bp, Zea mays
  misc_feature: Ceres CLONE 1563438
  misc_feature: Encodes the peptide sequence at SEQ ID NO. 78442
  misc_feature (409)..(409): n is a, c, t, g, unknown, or other
  misc_feature (413)..(413): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
ggagctccccgcggtggcggccgctctagaactagtggatcccccgggctgcaggaattcgtctcacccctagaaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgccccgacgctgcgctggcggaactggcgggcnggcngaacagcccgggcggcgaacagcccgccggccagcctgcctggctcgtccgtggttgggccgccccgcccatccggggggggggtgcctggtaaaaaaaaatcccttgcaaaacccgggggccttaaaaacccagccttgaaaaccccgcattgggcccccaagaaaacccccaagggcccccctggggggcccccccccggggcccccgtgggggccccctttcggggggggcccccccccccgccccccgcnnnnnnnngagcggggaaaaaattgggggggggcccccccccccccccccccccaataaaat

SEQ ID NO: 78442 - protein, 121 aa, Zea mays
  misc_feature: Ceres CLONE 1563438
  misc_feature (74)..(74): Xaa is any aa, unknown, or other
MATIATMALLKPAAKAAARSAPSTSSGSVSLRVRTGQAAKKAALSVSASSTLAGAFLAALASSPRRCAGGTGGXAEQPGRRTARRPACLARPWLGRPAHPGGGCLVKKNPLQNPGALKTQP

SEQ ID NO: 78443 - DNA, 823 bp, Zea mays
  misc_feature: Ceres CLONE 1563439
  misc_feature: Encodes the peptide sequence at SEQ ID NO. 78444
  misc_feature (665)..(665): n is a, c, t, g, unknown, or other
  misc_feature (715)..(715): n is a, c, t, g, unknown, or other
  misc_feature (721)..(721): n is a, c, t, g, unknown, or other
  misc_feature (722)..(722): n is a, c, t, g, unknown, or other
ctccccgcggtggcggccgctctagaactagtggatcccccgggctgcaggaattcgtctcacccctagaaaaaaacgcccatctgcacgggccacgcgaagcgttcgagctcctcccacggcagccatggtcaccgccaccacctccccgctcttctccctctcctccctccgcgcctccctcccttcccccacccgatttcacacgtctctctcgctccgagccctctccccacgtgcccgtctctctgcctccctccctttcgcctccccactcgtttcaggcgggtacgggacctgggcggcgacttcagtgtcgtccgcgggaaggttgagacggcgggggctggaggtggtgtgcgaggccacgactgggcggcggccggactcggttaagaagagggagcgccagaacgacaagcaccgcatccgaaatcacgcgcgcaaggccgagatgcgcactaggatgaaaaaggtcttaagagctcttgaaaagcttaggaagaaacctgacgcgcagcctgaagaaataattgagatagagaagctgatcgctgaggcatacaaagccatcgacaagacggtgaaggttggcgccatgcataggaacacggcgaaccatcggaagtctcgactggcaaggaggaagaagccatcgagatacntccgtggttggtatgtcccaaacgctgacctgggttcgctgccaacctangattcnntgagaaaatcgctatcatgtgtcaagcttttcatttttgggcgactatgcttattcacggggcctcaacagctttgccaggttctctaatttgaaatggtt

SEQ ID NO: 78444 - protein, 227 aa, Zea mays
  misc_feature: Ceres CLONE 1563439
  misc_feature (84)..(176): Pfam Name: Ribosomal_S20p Pfam Description: Ribosomal protein S20
  misc_feature (180)..(180): Xaa is any aa, unknown, or other
  misc_feature (196)..(196): Xaa is any aa, unknown, or other
  misc_feature (199)..(199): Xaa is any aa, unknown, or other
MVTATTSPLFSLSSLRASLPSPTRFHTSLSLRALSPRARLSASLPFASPLVSGGYGTWAATSVSSAGRLRRRGLEVVCEATTGRRPDSVKKRERQNDKHRIRNHARKAEMRTRMKKVLRALEKLRKKPDAQPEEIIEIEKLIAEAYKAIDKTVKVGAMHRNTANHRKSRLARRKKPSRYXRGWYVPNADLGSLPTXDSXRKSLSCVKLFIFGRLCLFTGPQQLCQVL

SEQ ID NO: 78445 - DNA, 883 bp, Zea mays
  misc_feature: Ceres CLONE 1563440
  misc_feature: Encodes the peptide sequence at SEQ ID NO. 78446
ctggagctcaccgcggtggcggccgctctagaactagtggatcccccgggctgcaggaattcgtctcacccctagaaaaacaccacccaccagtccaccaccactgctcgcactcactccaccgctgcccacttcttgtttgtattgtatccagactccagaggaagccgagagggccaatgaggcaaggcatgagctccccttccgccgccgcggcgctcgtgctcctcctggccctgctcgccggaggccagtgccgagaggcccagctcgacgccgcggacgccggcaccggcacggagaactacaccgccagcgacgccgccgtgtactggggcccctggcagagggcccgggccacctggtacggccagcccaacggcgccggccccgacgacaacggtggcgcgtgcggattcaagcacaccaaccagtacccccttcatgtccatggggctcctgcgggcaaccagcccttggttcaagggacggcaaggggctgccggctcccggcttacaaaattccggtgcaaagaaggaaccggtccctgcctcccgggcgggacgggaagaccggggattcctcacccggacatggaaactaacctcccccgggtgggcccaagttacccacttttcgaacctccaggggggcacctgcggttttcgggcaaggcctgggcccaaagcccccggccccccaaagaaacaaagctccccgcccactctccgggatttttttcgaaaattcgagatttcaccaaggggggcccgtggccaaattttcccccggcccctgaaaaaaccaggtgtcccacactgggaaagaaaaacccccaaaccccccctcttaactttcagagaggctggagagagaataaag

SEQ ID NO: 78446 - protein, 137 aa, Zea mays
  misc_feature: Ceres CLONE 1563440
MSSPSAAAALVLLLALLAGGQCREAQLDAADAGTGTENYTASDAAVYWGPWQRARATWYGQPNGAGPDDNGGACGFKHTNQYPLHVHGAPAGNQPLVQGTARGCRLPAYKIPVQRRNRSLPPGRDGKTGDSSPGHGN

SEQ ID NO: 78447 - DNA, 667 bp, Zea mays
  misc_feature: Ceres CLONE 1563441
  misc_feature: Encodes the peptide sequence at SEQ ID NO. 78448
agctccccgcggtggcggccgctctagaactagtggatcccccgggctgcaggaattcgtctcacccctagaaaaactttttccggttcgttcccctacgcccgtttctctctcgtcgcgcaacatcagagcacaagcgaggaacccagtccagtcccgggaatggagtgcgtattgggcgtggttggccgcgacttcgtgctggtggcggccgacacctccgccgtgcagagtattctcgtccacaagaccgacgaggacaaggtgatggtgctcgactcgcaaaagctgatgggcgcttcaggggagcctggtgatcgggtgcaatttacggagttcatacagaagaacctccacctgtaccagttccggaacaccatcccgctctcaaccgccgccgccgccaacttcacacgcggcgaactcgccacagcccttcgcaagaatccatatatggtcaatattattctttggtggttatgataagggatgttggggtgcttccctctacctacatcggactacatttgcaaacctttggcaccaagatttggaccaaaaggtgccttttttgggggtaccggaatccaataacctttccgggtttttggtcccccggaaaggggaaccaaagttttggttacccccccccccggggaaaccttgt

SEQ ID NO: 78448 - protein, 106 aa, Zea mays
  misc_feature: Ceres CLONE 1563441
  misc_feature: SWISSPROT Homolog: EC 3.4.25.1 Proteasome endopeptidase complex
MECVLGVVGRDFVLVAADTSAVQSILVHKTDEDKVMVLDSQKLMGASGEPGDRVQFTEFIQKNLHLYQFRNTIPLSTAAAANFTRGELATALRKNPYMVNIILWWL

SEQ ID NO: 78449 - DNA, 826 bp, Zea mays
  misc_feature: Ceres CLONE 1563442
  misc_feature: Encodes the peptide sequence at SEQ ID NO. 78450
  misc_feature (655)..(655): n is a, c, t, g, unknown, or other
  misc_feature (674)..(674): n is a, c, t, g, unknown, or other
  misc_feature (678)..(678): n is a, c, t, g, unknown, or other
  misc_feature (738)..(738): n is a, c, t, g, unknown, or other
  misc_feature (757)..(757): n is a, c, t, g, unknown, or other
ggagctccccgcggtggcggccgctctagaactagtggatcccccgggctgcaggaattcgtctcacccctagaaaaatcgccgcaacgaattcccggtctccaaccagccggccagccaccgcagacgacccctagttccgcgtccccgacccgaaccctcgagttcgcacgggctccggccagattcgcgcggtctaagcttcgaatcggcgcatggaggcagcagtagccgcggcactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaggcgaagcagtgtggtcagggcctcctggtccccctcggagtctctgccaccgtcctcgtcgatggcgccgctcaggatggaatcgcccgcggggcagctactctcccagattcttcacacgcacccgcacctactgcctgccgccgccgagcagcagctcgagctgctccagaccgaccgcgaggcagagaaggataaggataaggagagcgatgctggcgacaagctgggctccgacaggtgtcgacctcatgctgtacaggcggattgctncagtaaaggagaaggaacnggangaggacttttggaggagatactctattgctctggttgtttgagaaagttgtttgaagccnggcgttttccttgggtccngggcactctcaccgctccatcgactccttctggaaaaaagttgatcagtggggcagaaaacttgtggaa

SEQ ID NO: 78450 - protein, 127 aa, Zea mays
  misc_feature: Ceres CLONE 1563442
  misc_feature (71)..(71): Xaa is any aa, unknown, or other
  misc_feature (79)..(79): Xaa is any aa, unknown, or other
  misc_feature (99)..(99): Xaa is any aa, unknown, or other
  misc_feature (105)..(105): Xaa is any aa, unknown, or other
MAPLRMESPAGQLLSQILHTHPHLLPAAAEQQLELLQTDREAEKDKDKESDAGDKLGSDRCRPHAVQADCXSKGEGTGXGLLEEILYCSGCLRKLFEAXRFPWVXGTLTAPSTPSGKKLISGAENLW

SEQ ID NO: 78451 - DNA, 788 bp, Zea mays
  misc_feature: Ceres CLONE 1563443
  misc_feature: Encodes the peptide sequence at SEQ ID NO. 78452
  misc_feature (742)..(742): n is a, c, t, g, unknown, or other
ctggagctccccgcggtggcggccgctctagaactagtggatcccccgggctgcaggaattcgtctcacccctagaaaaattctttgccggtcgtccaaccccaacccccgtccccgtcctccattcgcaaaagctaggcgattacgccatgcacgagccgacatgtcacattagtgtgcaccacgagaatatgttcttctccatcgtccataggccaaccacgcgcccacggctagcttaattcgccgcaccatcagttcgctcgcaaactctcctatcaagcacaggcacagcacacagcagcacagccatggctgctcccagactcgccgccgccagctgccacgctctgcgcggagtgctccacgacaagctccgcgccgttgagctgcagctgcgggcgtgccgccgctccctcgccggcgcgtccggctcttcgacgacgacggcagccgccgtggccgcgctcgtctgcgccgccgcggcgttcccgcgagccgcggccttcttcctgccactcgtggcctccacctccctctgctgcgcggcagcgttgcctgttcgccgccgtggagcggagcgcggcccaaggagctgtggaggccgtggtcgtggacgggcgaggggaaagcccaaggccgggcctgcttcagggtgatcggcgaaggcaaacacccagccccggttcgggcgacaaggctccgggcaagcctcccaagggggagtatggcttccattccnccaagggtccccccaaagcgcaatagactttgtgaaccaaaggaat

SEQ ID NO: 78452 - protein, 115 aa, Zea mays
  misc_feature: Ceres CLONE 1563443
MAAPRLAAASCHALRGVLHDKLRAVELQLRACRRSLAGASGSSTTTAAAVAALVCAAAAFPRAAAFFLPLVASTSLCCAAALPVRRRGAERGPRSCGGRGRGRARGKPKAGPASG

SEQ ID NO: 78453 - DNA, 774 bp, Zea mays
  misc_feature: Ceres CLONE 1563445
  misc_feature: Encodes the peptide sequence at SEQ ID NO. 78454
  misc_feature (642)..(642): n is a, c, t, g, unknown, or other
  misc_feature (736)..(736): n is a, c, t, g, unknown, or other
ctcaccgcggtggcggccgctctagaactagtggatcccccgggctgcaggaattcgtctcacccctagaaaaaatcaaacggactcacagctcgcagcacctgcaggacattgagaaccagccagctaaccaaccaaccaaccggcggagccaaagccaagaaggaaggcaacgtgcccatccagtcaggatgtgcaactccaacgtcaagtccgcgggggtggcccagatcgacggccgcccggtgctgcagccggcgggcaaccgcgtggcggcgccggagccggacgcctcccgcccgctcaagaagtccctccagaagtcgctctccatgccggcctactacgacagcaatgccaccgcgggcgcccgtcctgcgccggccgagaacaccacccgtgcagcggctaattcgtctccgctgcctcccgcgaaggcggcgacgaaggcagcgggcgctttccccgcggagaagagcggcaggtccaaggcagccaggaggccaggcgccgtgccgccgcccggtggtggcgttcgcggcgctggacgcgttggagccggcggggagcatcgccgcggcgcagcgggagcacgccgcgcaggcgcaggcgcagcgcaagctgcggatcgcgcactacggncgcacgcgtcttctcccggggggaggggggccaaaaaaattggggcccgcgggcgcccccccccgaaggggggcgttacgggctttcccccggngggggaagaaactaaaaaccccggccaccttccatcac

SEQ ID NO: 78454 - protein, 194 aa, Zea mays
  misc_feature: Ceres CLONE 1563445
  misc_feature (151)..(151): Xaa is any aa, unknown, or other
  misc_feature (182)..(182): Xaa is any aa, unknown, or other
MCNSNVKSAGVAQIDGRPVLQPAGNRVAAPEPDASRPLKKSLQKSLSMPAYYDSNATAGARPAPAENTTRAAANSSPLPPAKAATKAAGAFPAEKSGRSKAARRPGAVPPPGGGVRGAGRVGAGGEHRRGAAGARRAGAGAAQAADRALRXHASSPGGRGAKKIGARGRPPPKGGVTGFPPXGEETKNPGHLPS

SEQ ID NO: 78455 - DNA, 826 bp, Zea mays
  misc_feature: Ceres CLONE 1563446
  misc_feature: Translation starting site: 185
  misc_feature (582)..(582): n is a, c, t, g, unknown, or other
  misc_feature (625)..(625): n is a, c, t, g, unknown, or other
ctccccgcggtggcggccgctctagaactagtggatcccccgggctgcaggaattcgtctcacccctagaaaaagcactccgcaagacgcaagaccacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttctttggctgtccctggcgacnatggcaggctgaaatatattgaacgcattgcggagagatttgntgatttgactatggacataagggggaaatgaaaggttgtggtcaggacaagtattttctcccccaggaggagggagaaagactcaaggaaaaccttgcaggatttcctttgggaaaacaaaactatttttgtttgacagaaaattgactacagctcctgggggaagatattttgaattgattccgggcaaaaagggcttta

SEQ ID NO: 78456 - DNA, 825 bp, Zea mays
  misc_feature: Ceres CLONE 1563448
  misc_feature: Encodes the peptide sequence at SEQ ID NO. 78457
  misc_feature (766)..(766): n is a, c, t, g, unknown, or other
  misc_feature (787)..(787): n is a, c, t, g, unknown, or other
ggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtcaagctgttcaacgccgtgggcgtggaagaactcatcgtcaggggagggcgcgtcngcggcgtcgtcaccaactggncgctcgtgtccatgaaccacgacacgcagtcctgcatg

SEQ ID NO: 78457 - protein, 223 aa, Zea mays
  misc_feature: Ceres CLONE 1563448
  misc_feature (64)..(223): Pfam Name: Thi4 Pfam Description: Thi4 family
  misc_feature (204)..(204): Xaa is any aa, unknown, or other
  misc_feature (211)..(211): Xaa is any aa, unknown, or other
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVGVEELIVRGGRVXGVVTNWXLVSMNHDTQSCM

SEQ ID NO: 78458 - DNA, 799 bp, Zea mays
  misc_feature: Ceres CLONE 1563449
  misc_feature: Translation starting site: 241
  misc_feature: SWISSPROT Homolog: EC 3.2.1.39 Glucan endo-1,3-beta-D-glucosidase
  misc_feature (772)..(772): n is a, c, t, g, unknown, or other
ctccccgcggtggcggccgctctagaactagtggatcccccgggctgcaggaattcgtctcacccctagaaaaaaaaaaaatcctttcttgtctggggtccagctttgtcacgagccactgcatccaggaggaggaggcggcggcggcgttacctgccctgctccggtcgactggctcccgggagttcggagccgagatctcgccaggccccggtcggcggcggcgttgtgggaaacaggatgggggatctgcccgcgctgcgcctgtggctctgcttgctggcggcaatggcggcggccgcgtcggcgccgtggccggcggatgcgctggggatgaactggggcacgcaggccacgcacccgctgccgcccaagatcgtggcgcagctcctcagggacaacggcatcaagaaggtcaagctgttcgacgccgaccaggacacgctcagcgcgctcgccggcaccggcatcgaggtcatggtcgccatccccaacgtcatgctcgacaccatgacggactacgacaccgccaaggagtgggtgcgcccggaacgtgtcccgctacaacttcgacggcggcgtcaccatcaagtacgtgcccgtggggcaacgagccgttccttgcgggctacaacggcacgttcgacaaggtgacgttcccggcgctgcagaactcccagaacgcgctgaacgaggccgggctcggcgacaccgtgaaaggcaccgtccccgctgaccgcggacttgtacatgtccccgaaagaaaaacccngtgccttccggccgggcccggtggccc

SEQ ID NO: 78459 - DNA, 839 bp, Zea mays
  misc_feature: Ceres CLONE 1563451
  misc_feature: Encodes the peptide sequence at SEQ ID NO. 78460
ggagctccccgcggtggcggccgctctagaactagtggatcccccgggctgcaggaattcgtctcacccctagaaaaagattgcaatggtggcctccactgcttcccgcctctcgcccccgcgcttcagcaccccttccccgtctcttcatcctccaaaccgccgctcgcgcttctcccctgttcgcgcagccaagttggaagctgtgctgtctattggtgctcatctaatcccacacccaagaaaggctgcaagtggcggagaagatgctttctttgccaatagcgatgctggcggagtatttgccattgcagatggtgtctcgggatgggcagaaaagaatgtcaatccagctctattctctcgagagctcatgagaaacagctctaatttcctcaatgatgaggcggtcagtcatgatcctcagattcttctcatgaaagctcatgctgcaacttcttctattggatctgcaacagtaatcatcgccatgcttgagaagaccgggactctaaaaattgcaagtgtgggagaattgtgggttgaaagttattcgtaaagggcaagtaatgttctctatatcccctcaagaacatttattttgactgcccataccagataagctcagaggcagaaggtcaaacatataaggatgcattgggtttgcagtgtaaaccttatggagggtgatataatttggggaagtgtttcagaatggacttttttgacaatatctttgaaccaagaagatggttttcataaatttctggaatcgcccagtggtagatgaaagctgcaaaagcatttgggcggagctttgcagaaaaccacctcggggt

SEQ ID NO: 78460 - protein, 157 aa, Zea mays
  misc_feature: Ceres CLONE 1563451
  misc_feature: SWISSPROT Homolog: EC 3.1.3.16 Phosphoprotein phosphatase
MVASTASRLSPPRFSTPSPSLHPPNRRSRFSPVRAAKLEAVLSIGAHLIPHPRKAASGGEDAFFANSDAGGVFAIADGVSGWAEKNVNPALFSRELMRNSSNFLNDEAVSHDPQILLMKAHAATSSIGSATVIIAMLEKTGTLKIASVGELWVESYS

SEQ ID NO: 78461 - DNA, 785 bp, Zea mays
  misc_feature: Ceres CLONE 1563452
  misc_feature: Encodes the peptide sequence at SEQ ID NO. 78462
ggagctccccgcggtggcggccgctctagaactagtggatcccccgggctgcaggaattcgtctcacccctagaaaaagtccaattcatccaccttgtccctcccggagaaccagaaggctacccaccctccaaggcaggggaggggccatggacgaccccgtcgagcgcttgaaggacgggttccacaagttcaagaccgaggtctatgacaagaagccggagctgttcgagcctctcaaggccggccaggcccccaagtacatggtgttcgcctgctccgactcccgcgtgtgcccgtcggtgacactgggactgcagcccggcgaggcattcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaccttccacttcgttgagaactgggttaagatcggcttccctgccaagattaaggtgaagaaagaccacgcatcggtgccgttcgatgaccagtgctctattctagagtatggaggccgttaacctgtcccctggagaaccctcagacctaccccttcgtcaaggatgggctggccaacgggacgctcaagctggtcggcggcacctacaactcgtggtcaaggggaagtcctcacatgggacaataaagcagcatcatgaatctataaatat

SEQ ID NO: 78462 - protein, 161 aa, Zea mays
  misc_feature: Ceres CLONE 1563452
  misc_feature (31)..(157): Pfam Name: Pro_CA Pfam Description: Carbonic anhydrase
  misc_feature: SWISSPROT Homolog: EC 4.2.1.1 Carbonate dehydratase
MDDPVERLKDGFHKFKTEVYDKKPELFEPLKAGQAPKYMVFACSDSRVCPSVTLGLQPGEAFTVRNIAAMVPAYDKTKYTGIGSAIEYAVCALKVEVLVVIGHSCCGGIRALLSLQDGAPDTFHFVENWVKIGFPAKIKVKKDHASVPFDDQCSILEYGGR

SEQ ID NO: 78463 - DNA, 763 bp, Zea mays
  misc_feature: Ceres CLONE 1563454
  misc_feature: Encodes the peptide sequence at SEQ ID NO. 78464
  misc_feature (435)..(435): n is a, c, t, g, unknown, or other
  misc_feature (475)..(475): n is a, c, t, g, unknown, or other
  misc_feature (490)..(490): n is a, c, t, g, unknown, or other
  misc_feature (526)..(526): n is a, c, t, g, unknown, or other
ctccccgcggtggcggccgctctagaactagtggatcccccgggctgcaggaattcgtctcacccctagaaaaacaccagcgcagcgagctctctcctcgtagcggagtcccagcccctcacgccctcccgatcgcgctcgtcggcgccctgtcgactcgagcccgcttctgggccgatcgacagcgagagcgagagcgagcgcagcggcgcgccgaggagagctctttcggtgctgtataacgacgacgacagcaggcggcagataacacataaaggcgcgcgatgtgcgacgcggcggccgtggcggctccgcggtacaggggcgtgcggaagcggccgtggggccggttcgcggcggagatccgggacccggcgaagcgcgcgcgcgtctggctcggcaccttcgactccgctgaggccgcggcgcgcgccntacgacgtgggccgcgcggggccctgcgcggccccgctcngcaaggaccaacttnccccgcgctcaccttcccgcccttcttgccaaaagngccccgcggcccggggccccacggtggaagctcaaggctcccacccggtcggagttccttccaagcggggccccccgcgccccgggggttggccccaagggggggggggccagggcccccccttcctgggggaaaaacccccccgtggcccccccccgggacaggggggggccccgcgccccccccgccgaaaacccccccaaaaggggcccgtttaaagagaaattgtgggccccc

SEQ ID NO: 78464 - protein, 159 aa, Zea mays
  misc_feature: Ceres CLONE 1563454
  misc_feature (10)..(62): Pfam Name: AP2 Pfam Description: AP2 domain
  misc_feature (51)..(51): Xaa is any aa, unknown, or other
  misc_feature (64)..(64): Xaa is any aa, unknown, or other
  misc_feature (69)..(69): Xaa is any aa, unknown, or other
  misc_feature (81)..(81): Xaa is any aa, unknown, or other
MCDAAAVAAPRYRGVRKRPWGRFAAEIRDPAKRARVWLGTFDSAEAAARAXRRGPRGALRGPAXQGPTXPALTFPPFLPKXPRGPGPHGGSSRLPPGRSSFQAGPPAPRGLAPRGGGPGPPLPGGKTPPWPPPGTGGGPAPPPPKTPPKGARLKRNCGP

SEQ ID NO: 78465 - DNA, 823 bp, Zea mays
  misc_feature: Ceres CLONE 1563456
  misc_feature: Encodes the peptide sequence at SEQ ID NO. 78466
ctggagctccccgcggtggcggccgctctagaactagtggatcccccgggctgcaggaattcgtctcacccctagaaaaaattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcggatgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagttgtcccggggcacgagatcgtgggcgtggtgaccggcgtcggcggcggcgtcacgcggttcaaggccggcgacacggtcggcgtgggctactttcgtggggtcctgccgctcctgcgacagctgcggcaagggggacgaacaactactgccccggggatcgtgctcacttccaaagggcgtccgaccacgcgcacggcggcgcgcccaccagggggggatttcttcgaagtcctggtcccgaacgagccactacggtgggtccgggttccccaaaggcctgggggttggaccgaaaccgggccccttgtttggcccgggggttcaccgtggttaggcccccattgagggccccgggcttcaagaaaccgggaaaaacacccttgggggttttggggcctcggggggcctgggcccatttttcccctc

SEQ ID NO: 78466 - protein, 178 aa, Zea mays
  misc_feature: Ceres CLONE 1563456
  misc_feature (33)..(101): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
MEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFRGVLPLLRQLRQGGRTTTAPGIVLTSKGRPTTRTAARPPGGDFFEVLVPNEPLRWVRVPQRPGGWTETGPLVWPGGSPWLGPH

SEQ ID NO: 78467 - DNA, 744 bp, Zea mays
  misc_feature: Ceres CLONE 1563459
  misc_feature: Translation starting site: 322
  misc_feature: SWISSPROT Homolog: EC 2.5.1.6 Methionine adenosyltransferase
  misc_feature (289)..(289): n is a, c, t, g, unknown, or other
  misc_feature (317)..(317): n is a, c, t, g, unknown, or other
  misc_feature (418)..(418): n is a, c, t, g, unknown, or other
  misc_feature (478)..(478): n is a, c, t, g, unknown, or other
tcaccgcggtggcggccgctctagaacagtggatcccccgggctgcaggaattcgtctcacccctagaaaaagtgcacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcnctgcgagacctgcaccaagaccaacatnggtgatggtgttcggcgagatcacgaccaaggcgaccgtggactacgagaagatcgtgcgcgacacctgccgcgagatcgggttcacctccgacgacgtgngcctcgacgccgaccgctgcaaggtgctggtgaacatcgagcagcagtcccccgacatcncgcagggcgtgcacgggcacttcacgaagcggcccgaggagatcggcgcgggcgaccagggccacatggtccggggtacgcacccgacgagaccccccgagctgatggccgctcagccacgtgctgcccacccagctgggcgcccgccctcacccgagtgcgcaagaaacggcccctgccgcctggcttgaggcccgacgccaaaccccggtgaacgggggaatacctgaaaccaaggccggccccctgggggccccctcccccgc

SEQ ID NO: 78468 - DNA, 767 bp, Zea mays
  misc_feature: Ceres CLONE 1563461
  misc_feature: Encodes the peptide sequence at SEQ ID NO. 78469
  misc_feature (649)..(649): n is a, c, t, g, unknown, or other
  misc_feature (684)..(684): n is a, c, t, g, unknown, or other
ctggagctcaccgcggtggcggccgctctagaactagtggatcccccgggctgcaggaattcgtctcacccctagaaaaaatcaacccaacacggcgtccccgtcccgagtcaccaccgacccaagcaaaaccgcacgcaccctgccagcggccccccaactcccaacccaacccctactccagctagctcgcggcggcggccagcggccatggccttccggctgagcaacaacctgatcggggtcctaaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcctgctgccgcgtcacctggctgctctgggcctacctcctcgccatgttcgtcctcatcctcgtcctcttctgcttcaccgtcttcgccttcgtcgtcaccaacaggggcgccggcgaggccgtctccggccgcggatacaaggagtaccgcctcggggactactccaactggctgcagaagcgcgtcgagaacaccaggaactgggaccggatcaggagctgcctccaggaactccaaggtnctgcaagagcctgcaggacaagaacgagaccgtcngcccagttcatgaagttccagcctctccccccattcgagtctgggctgctgcaagcccccccaaccagctgcgggctacaccc

SEQ ID NO: 78469 - protein, 185 aa, Zea mays
  misc_feature: Ceres CLONE 1563461
  misc_feature (5)..(165): Pfam Name: Tetraspannin Pfam Description: Tetraspanin family
  misc_feature (147)..(147): Xaa is any aa, unknown, or other
MAFRLSNNLIGVLNFVTFLLSVPILGAGIWLGHRADGTECERYLSAPVIALGAFLLAVSLAGLVGACCRVTWLLWAYLLAMFVLILVLFCFTVFAFVVTNRGAGEAVSGRGYKEYRLGDYSNWLQKRVENTRNWDRIRSCLQELQGXARACRTRTRPSAQFMKFQPLPPFESGLLQAPPTSCGLH

SEQ ID NO: 78470 - DNA, 809 bp, Zea mays
  misc_feature: Ceres CLONE 1563463
  misc_feature: Encodes the peptide sequence at SEQ ID NO. 78471
  misc_feature (695)..(695): n is a, c, t, g, unknown, or other
ctggagctccccgcggtggcggccgctctagaactagtggatcccccgggctgcaggaattcgtctcacccctagaaaaaaggacgccattagcagcggttggccaccacccgacgccggaggcccggaggaggaggcggcgatggcggggaagcacgggcgcaacggcttcgacgacgacaacgtcaaccctttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagaggcggcatcccgagctggcgttgtgataggagagaaaaactggcctccctttttccccctcatccaccacgacatttccaatgaaatacctatccatctacaaaggatgcagtaccttgcattctcatcattcttgggattgatagcgtgtctcttttggaatgtcatagcaactacaacagcatggattaaagggggaagggtgttatgatctgggctgcttgccattatctactttcatatctggtgcgcctgggggcttatgtgctatggtatcgacctctttatatggcatgagaactgaaagcgcttgnaagttttggggtggtttttcctattttacatgattcatataaaccctccgggggggggggcagctgtgggctcctccattttcctttcaaaaggaaatccttttggcttggtat

SEQ ID NO: 78471 - protein, 149 aa, Zea mays
  misc_feature: Ceres CLONE 1563463
  misc_feature (90)..(149): Pfam Name: SCAMP Pfam Description: SCAMP family
MAGKHGRNGFDDDNVNPFAGGSVPPATNSRLSPLSHEPADFYNVDIPLDSSKDLKKKEKELQAMEAELNKRERELKRKEEAASRAGVVIGEKNWPPFFPLIHHDISNEIPIHLQRMQYLAFSSFLGLIACLFWNVIATTTAWIKGGRVL

SEQ ID NO: 78472 - DNA, 755 bp, Zea mays
  misc_feature: Ceres CLONE 1563464
  misc_feature: Translation starting site: 144
  misc_feature (472)..(472): n is a, c, t, g, unknown, or other
  misc_feature (528)..(528): n is a, c, t, g, unknown, or other
ctccccgcggtggcggccgctctagaactagtggatcccccgggctgcaggaattcgtctcacccctagaaaaaaagaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaagccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtgggtggtggttgaacaataataagcgaagccgagctggctgccatacatangtattgtgtggtgtgtgtgaaaaaagaaagaaacagagtttcttcagtttgctatnctctctctgcatgtttggcgtcagtctttgtgctcatgtaacgtacgtgtgtctacctgcatgttgggttgatcccaattgcatctgctgtaaacatatattaattgggcccccaatgaaatggaattggaacccttttatttccccaaaaaaaaaaaaaaaaccggggccccctgagggtaccccatttccccccaaaaggggaggcccaattacccccccccccc

SEQ ID NO: 78473 - DNA, 756 bp, Zea mays
  misc_feature: Ceres CLONE 1563465
ctccccgcggtggcggccgctctagaactagtggatcccccgggctgcaggaattcgtctcacccctagaaaaagttcactcctcagttgcttcgacgtatttctctctctatctatacgattccgaagaaggtagagagagaaactcgaaggggagaggacagaagagggagatacaggttaatttttaggtaccagatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttgggggaaggaaggctctgcctttttggccccaaaattacattacagcccatcttttgcttgtattccttatacttctgatgcttattatagtggcggttggggtcttgacaagatatcctccacatgcccattgtccatccccagcaaaatgatacaacgaaaccctccggggtatgttaccctggtggaaccggcagaagaaaccaatatatgttaatgcaaaaacaatac

SEQ ID NO: 78474 - DNA, 830 bp, Zea mays
  misc_feature: Ceres CLONE 1563466
  misc_feature: Translation starting site: 264
  misc_feature (529)..(529): n is a, c, t, g, unknown, or other
  misc_feature (797)..(797): n is a, c, t, g, unknown, or other
ctccccgcggtggcggccgctctagaactagtggatcccccgggctgcaggaattcgtctcacccctagaaaaaaaagacccccgcccacgaccacacgcaggcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccggccggccggctccatacccgcggctaccgctgccgtcgtcgtcatcctcgtcaggctacaggcactccaagtccgtctccgtgaagacgctcgccctgttcggcaaatccaaggtcaagaccgcgccggcgaagaaggctgctgcgcccaagcccaagccgaaggttgaggatggtatcttcggcacgtcccggcngggatcggtttcaccaaggagaacgagctgttcgtcggccgcgttgccatgcttggctttgcggcatcgctactgggagaggccttacccgggaagggcatcccttgccagctgaacttcgagacgggcatccccatctacgaggcggagcctctcctcctgttctcatcctcttcaccctccttgggcgcatcggcgctctcggggaccgccggcgcttcgtcgacgaagaagtcaacggcttcgacaagccgtcatccaactgggnaagggtttcccggggccctcgccctcacgaagg

SEQ ID NO: 78475 - DNA, 914 bp, Zea mays
  misc_feature: Ceres CLONE 1563468
  misc_feature: Encodes the peptide sequence at SEQ ID NO. 78476
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (285)..(285): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnntttcaaagctggaactccccgcggtggcggccgctctagaactagtggatcccccgggctgcaggaattcgtctcacccctagaaaaaaatccgcatccgctgcctccgcctctcgagtctcgtccacccgtcgtcctcctagctcctctactcgccagtcgccatgggcaagattaagatcggaatcaacggcttcngaaagatcggcaggctcgtggccagggtcgccctccagagcgaagatgtcgagctcgtccccgttcacgaccccttcatcaccccggactacatgacctacatgttcaaggtacaaacccgtcaccgggccctggggaggcccaggggaccttcccctttaaggaatccccaaaaccccttttctttcggggaaaaaaccgggggcccccccttttttgggcttcggaaaaccccctagggaaaaccccccgggggggggagggggcgcggcgccccaaaaaatttttcccggggaaagccccccccgggggggttttttctttctttaaaaaaaaaaaaaaaagaggggggcctcgccccactttctccaaggggggggtgggggcccccacaaaaaaagggtgttttttttttttttccccccccccccaaaaaaaaaaatgcccccccccccccttttttttttttttgggggggcccaaaaaaaaaagaaaaaaaaaaaacccccccccccggaggggggaaaaaaaccattttttgttctcccacaaaagagagggggggcccccccccaccaacaaaaaagagggggggggggcgcccccccccccttatagaaaaaagataa

SEQ ID NO: 78476 - protein, 90 aa, Zea mays
  misc_feature: Ceres CLONE 1563468
  misc_feature: SWISSPROT Homolog: EC 1.2.1.12 Glyceraldehyde-3-phosphate dehydrogenase (phosphorylating)
  misc_feature (12)..(12): Xaa is any aa, unknown, or other
MGKIKIGINGFXKIGRLVARVALQSEDVELVPVHDPFITPDYMTYMFKVQTRHRALGRPRGPSPLRNPQNPFSFGEKTGGPPFFGLRKTP

SEQ ID NO: 78477 - DNA, 834 bp, Zea mays
  misc_feature: Ceres CLONE 1563470
  misc_feature: Translation starting site: 282
ctggagctcaccgcggtggcggccgctctagaactagtggatcccccgggctgcaggaattcgtctcacccctagaaaaagagaatcaattgctagtacgatttcttctctcctccaaaccggccaagccaccaaccagcgccccccaccgccgcctttttatttcatccacgctgctcgtgctcgctgcctgcttctcgcgcgatcgtctcggcctctcgggattctagagtggcggccggctctccgcctgttcttgtcgtcgctgctcctttcccaggatgtcggaacgttctgagagcgcaactgaaaagattatgagcagcatcatggataccattgctgacaaccttcctaagcagaagtctgggaaatttgatccaggttcagtctctgacaaagtgaagaataagctgtttggtcgtcagaagaccttgcatggagttctgggtgggtggaaaacctgctgatgtgctgttatggaggaacaaaaagatatcatcgagtgttctggctcttgaacagctatttgggttttctttgagtggctcgactacacttactgacatttgttcatttgccctggtcttgggatgggtgtccagtttgtttgggtcaacttctcaacatgctaagcagcggatccccgtctcaggtgccccgaagtgaatggctgatgaagtatttgtggaacatggcggttgccatcggtgcccaaataaacaagttcctgtgcttccctcaagggagtttccttgggaaagaaacttgaagccttttgggaatggcaaatcccaggactggggcctcctgcgggggaattgaaaattggtc

SEQ ID NO: 78478 - DNA, 842 bp, Zea mays
  misc_feature: Ceres CLONE 1563471
  misc_feature: Encodes the peptide sequence at SEQ ID NO. 78479
  misc_feature (776)..(776): n is a, c, t, g, unknown, or other
ggagctccccgcggtggcggccgctctagaactagtggatcccccgggctgcaggaattcgtctcacccctagaaaaactctctgccccctccggcaactcaggagagaacgcggctcctacccggcggcggtgaagccgcgacgatccaacggagcagaggcgccatggctgctcccgaagcgcccacatgctacgtcgggatcgcgcggcagtccgccgccttccgccttatgaagcaaatgggatgggaagaaggtgaaggccttggcaaagacaagcaaggcataaagggtcatgttagggtgaaaaacaagcaggacacactaggtgttggtgtagatagccctcataacaaatgggtatacgataccacccaatttgacaacatattgaagaaactgaaagtgcaaacagctaatcctgttcaagaagaggttgcagctgtagaaagtgattcacctgacatcacacccaagaaagacaaatcagcaaaacatgaagttactaaagttactcgacctcaaggaagatacaagaaaagagagaggggggaaaagtgtgaactcttattcagcaacagatcttcaaggcatactcgtacgcaaaaatgaagataattccaaagtggatcagaaacttgaaccgacatgcttggacgaacctgatcccatcgtctgtccggacgcatatcccaggctgatgatgtgaactggtggggcacaaaattggattttatcaagagggtttctaggagcaaatcccgtaaaaataatnctcacaaaagaatcctgctatgtcccgcagactttgcagagaagatcagaaatttgtacatcctgt

SEQ ID NO: 78479 - protein, 148 aa, Zea mays
  misc_feature: Ceres CLONE 1563471
  misc_feature (15)..(59): Pfam Name: G-patch Pfam Description: G-patch domain
MAAPEAPTCYVGIARQSAAFRLMKQMGWEEGEGLGKDKQGIKGHVRVKNKQDTLGVGVDSPHNKWVYDTTQFDNILKKLKVQTANPVQEEVAAVESDSPDITPKKDKSAKHEVTKVTRPQGRYKKRERGEKCELLFSNRSSRHTRTQK

SEQ ID NO: 78480 - DNA, 807 bp, Zea mays
  misc_feature: Ceres CLONE 1563472
  misc_feature: Encodes the peptide sequence at SEQ ID NO. 78481
  misc_feature (457)..(457): n is a, c, t, g, unknown, or other
ctccccgcggtggcggccgctctagaactagtggatcccccgggctgcaggaattcgtctcacccctagaaaaaacagccatcacacgcatactgcatacacaacgcagagcatcagaagcagctgcgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctggggcatgctncgcgcgctcgggtgcgtgttcccggagctgctcgccccgcacggcgtcaagtcggcaaggcggtgtggttcaaggcgggctcccgaatctcagcgagggggggctcgactaccttgggaacccgaaccgggtcacccccaaaactccggccattctggcgtgcccggggggcctcatggcccctccaaggggtaacccggttccccgggccccccttggggggggggggccaccccccgtttcccctgggggaatttttaccccgttgggggccccaaaaaacccccagagctctccccccccccccggggggaaaagaaaataaaaaaacgcccccccccccctgtttc

SEQ ID NO: 78481 - protein, 170 aa, Zea mays
  misc_feature: Ceres CLONE 1563472
  misc_feature (63)..(166): Pfam Name: Chloroa_b-bind Pfam Description: Chlorophyll A-B binding protein
MAAATMAITSRALVGKPAAGTRDVFGEGRITMRKTAAKPKPAASGSPWYGADRVLYLGPLSGSPPSYLTGEFPGDYGWDTAGLSADPETFAKNRELEVIHCRWGMLRALGCVFPELLAPHGVKSARRCGSRRAPESQRGGARLPWEPEPGHPQNSGHSGVPGGPHGPSKG

SEQ ID NO: 78482 - DNA, 853 bp, Zea mays
  misc_feature: Ceres CLONE 1563477
  misc_feature: Encodes the peptide sequence at SEQ ID NO. 78483
  misc_feature (690)..(690): n is a, c, t, g, unknown, or other
  misc_feature (749)..(749): n is a, c, t, g, unknown, or other
ctggagctccccgcggtggcggccgctctagaactagtggatcccccgggctgcaggaattcgtctcacccctagaaaaattccccaataacataccgagctgcaagctgctctgcttcttttctagcatgggcatgagggtcttgttggtggtcgtgctcatctcgttcgccccccttattaccactaatgcagcagcaggtgtcaacgccacgagatctgctggtaggcagcagaagcagaagcagaagccgctggcgcctgccctcatcgtgttcagcgactccatcgtggaccccggcaacaacaacgacatccacaccatcatcaaggccgacttcccgccctacggcaccgacttccagaaccacagagccacgggaaggttctgcaacggcaggataccaaccgacttcatcgcctcccgcctcggcatcaaggagcttctgccgccctacctcacctccgagccgctcgacaagcacgacctcgtcaccggcgtcagcttcgcgtccggcggcacgggcttcgacccgctcacgccgcagctcgcctccgtgatctcgctcccggaccagctcaccatgttccacgactacctgggcaaggtgcgcgacgcctccgggaacgccagggtgtcggatatcctgtcccggggcgtcttcgccatctgcgccagcagcgacgacntgaccaacacctacttcaccctgcgagcgcgcagcagctacgtaacacgctcctacgcncgcctcctggtgcagcacgccatcgcctttcgtgaggacctgcatcgcgccggggcgcgccgcgtcgccttcatcagcatcccgcccattcggctgcgtcccgg

SEQ ID NO: 78483 - protein, 241 aa, Zea mays
  misc_feature: Ceres CLONE 1563477
  misc_feature (47)..(241): Pfam Name: Lipase_GDSL Pfam Description: GDSL-like Lipase/Acylhydrolase
  misc_feature: SWISSPROT Homolog: EC 3.2.1.51 Alpha-L-fucosidase
  misc_feature (188)..(188): Xaa is any aa, unknown, or other
MGMRVLLVVVLISFAPLITTNAAAGVNATRSAGRQQKQKQKPLAPALIVFSDSIVDPGNNNDIHTIIKADFPPYGTDFQNHRATGRFCNGRIPTDFIASRLGIKELLPPYLTSEPLDKHDLVTGVSFASGGTGFDPLTPQLASVISLPDQLTMFHDYLGKVRDASGNARVSDILSRGVFAICASSDDXTNTYFTLRARSSYVTRSYARLLVQHAIAFREDLHRAGARRVAFISIPPIRLRP

SEQ ID NO: 78484 - DNA, 776 bp, Zea mays
  misc_feature: Ceres CLONE 1563480
  misc_feature: Encodes the peptide sequence at SEQ ID NO. 78485
  misc_feature (742)..(742): n is a, c, t, g, unknown, or other
ctccccgcggtggcggccgctctagaactagtggatcccccgggctgcaggaattcgtctcacccctagaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaagcggtgtgggtcaaggccggcgcgcagatcttctcggagggcgggctggactacctggggaaccccaacctggtgcacgcacagagcatcctgcccatctgggcgtggccagtggtgctcatgggcttcgtcgaggggctaccgcgtcggcggcggcccgcctcgggggaaggctccaacagggggtaccccgggcggcgcccttcgacccgctggggccttcgnccgacgacccgggaacaccgcccgccgaaacttc

SEQ ID NO: 78485 - protein, 208 aa, Zea mays
  misc_feature: Ceres CLONE 1563480
  misc_feature (59)..(199): Pfam Name: Chloroa_b-bind Pfam Description: Chlorophyll A-B binding protein
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWVKAGAQIFSEGGLDYLGNPNLVHAQSILPIWAWPVVLMGFVEGLPRRRRPASGEGSNRGYPGRRPSTRWGLRPTTREHRPPKL

SEQ ID NO: 78486 - DNA, 806 bp, Zea mays
  misc_feature: Ceres CLONE 1563481
  misc_feature: Encodes the peptide sequence at SEQ ID NO. 78487
  misc_feature (525)..(525): n is a, c, t, g, unknown, or other
ctggagctccccgcggtggcggccgctctagaactagtggatcccccgggctgcaggaattcgtctcacccctagaaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttcngtagccggatcaacccactcgttcgcctcaaagccaaaggtatcgagccggacttcgggctctacggcctcaaggcgatcaccaaggtcttcaagagcggcatcaacgcgtagcccggttgatccagtgcagcaaaggcccccttccaacaagtaaatggctgttccaagctctaactcctgcgcggcggggaaacgcaacgtttaattcgaatggcccccggcccaaaaaaataaaccttcctccaaggaaatacctctttcaacccctttcaagaaagg

SEQ ID NO: 78487 - protein, 178 aa, Zea mays
  misc_feature: Ceres CLONE 1563481
  misc_feature (30)..(179): Pfam Name: Ribonuclease_T2 Pfam Description: Ribonuclease T2 family
  misc_feature: SWISSPROT Homolog: EC 3.1.27.1 Ribonuclease T(2)
  misc_feature (142)..(142): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFXSRINPLVRLKAKGIEPDFGLYGLKAITKVFKSGINA

SEQ ID NO: 78488 - DNA, 854 bp, Zea mays
  misc_feature: Ceres CLONE 1563483
  misc_feature: Encodes the peptide sequence at SEQ ID NO. 78489
tggagctccccgcggtggcggccgctctagaactagtggatcccccgggctgcaggaattcgtctcacccctagaaaaatccgtcgcatttcccgtccggtctttccgttacccggcggcttaaaccctagttcccattccatcttcgtttccgctccgccgccgtcgatggagttctggggtctcgaggtcaaacctggatccactgtcaagtgtgagcctggacatggctttatcctgcacgtttcccaggctgcccttggggaatcaaagaaaagtgacagtgccttaatgtatgtcaaagttgatgacaagaagcttgccattggaacgctctctatcgacaaatacccacagatacaattcgatttggttttcaataaagagtttgagctgtcacacacatcgaaaactaccagtgtatttttctctggttacaaggttgagcagccaattgagggagatgaaatggatcttgattctgaggatgaagaggaggagctaaacattccagtaatcaaggaaaatggtgatggggaaggaggagcagaaaaatcaagagaaggcagtagctgctacagcttcaaaatcaagtcttggccttgaaaagaaaagcaaggatgactctgatgattctgatgaggatgagtctgaatgatctgatgaggatgattctgatgattctgatgagggcgaggggatatctcctgacgaaggcgatgatgattcaagtgatgaggatgataccccgtgatgatgacgaggaagaaaccccaactcctaaaaagcagaggcagccaagaagagagtggctgaaatgctctgaaaacgccctcttctgaaaagaaaacaaa

SEQ ID NO: 78489 - protein, 145 aa, Zea mays
  misc_feature: Ceres CLONE 1563483
MEFWGLEVKPGSTVKCEPGHGFILHVSQAALGESKKSDSALMYVKVDDKKLAIGTLSIDKYPQIQFDLVFNKEFELSHTSKTTSVFFSGYKVEQPIEGDEMDLDSEDEEEELNIPVIKENGDGEGGAEKSREGSSCYSFKIKSWP

SEQ ID NO: 78490 - DNA, 821 bp, Zea mays
  misc_feature: Ceres CLONE 1563484
  misc_feature: Translation starting site: 136
  misc_feature: SWISSPROT Homolog: EC 1.1.1.37 Malate dehydrogenase
  misc_feature (594)..(594): n is a, c, t, g, unknown, or other
  misc_feature (613)..(613): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (660)..(660): n is a, c, t, g, unknown, or other
  misc_feature (668)..(668): n is a, c, t, g, unknown, or other
  misc_feature (669)..(669): n is a, c, t, g, unknown, or other
ctccccgcggtggcggccgctctagaactagtggatcccccgggctgcaggaattcgtctcacccctagaaaaaacctccctttccctgctctctcgttaacactcttagttcctgcatctgctccgcaccaaccatggatcaccaccacctgtggccggtggccaaacatgatggccacactctgatgccaactgcgccctcactacctatctcgccctcatatggaaaatgttcccctactcagaggatgctattgccatgctaaatgcgcagggcctcttctcattctctcgatcttctgggccacacgtggaataaggcaaactatatgcgaatgagatgaaaataaacccatcctgtctcaatgctccatctatacgatgtccatcaactcgcctcgtagaacaagctgacatcaatcagcgtgaacaatactcgctgcgagatcatgacttctcacctcactcctcagatgagaaaatgcccacacatggaatggatcaagatgatgattcgctgctgatgtccactcggatacctatggacgatctacgaatgtacttgtgcatacattgatactgggaataatccngtaccctgtgtgatagaantgctaatgctggcctatgaatgnnnnnnnnnnnnnnnnnnnnnnttntccggggnnaactttccccgcccaaatggctgctgaaatttcaaaaaagctggaaacttatgaccctaaccggcttttaggtgtgaccaacccttgacgtagtgagagcaaatacttttgtgggaaaaggtcctgggactgaccccagaaaagtaatgttc

SEQ ID NO: 78491 - DNA, 818 bp, Zea mays
  misc_feature: Ceres CLONE 1563487
  misc_feature (532)..(532): n is a, c, t, g, unknown, or other
  misc_feature (572)..(572): n is a, c, t, g, unknown, or other
  misc_feature (650)..(650): n is a, c, t, g, unknown, or other
  misc_feature (659)..(659): n is a, c, t, g, unknown, or other
ttggagctccccgcggtggcggccgctctagaactagtggatcccccgggctgcaggaattcgtctcacccctagaaaaacttccgtgctcccgctccacctcctgtcctgcgcgcgccgggccagcaccgccgcgcgcgcctccgcggccccggcggtggcggcgacgaccgcgcagtccctggaggagtcgttcggacggaagggcctgcggttcgtggccgacccggccggcgggcccctcgccgcggagctcagcgtgcggaacggcagctcgctgcatctccgcctcggcgacggcctcgtcacgtcctaccggcccaaggtgtactggaaggacgacgggtgccgggaggtgctgcacaccgtggcgggcaagggcggcgtcggcctcgtcctcaacgacgcgacgtcctcgtccgcccagccgtcgctggtcgacggcgccgagtgggccgtcagggacgccgactccgactcctacgacgccgtgcaggtggagctcgggtgcaccatagggaagctggacatnctcgtacgtggtgacgctgtactcgctgagcatggcgacnggcggtgatcgtccggaacacgggcagcaagcccgtggcgctgaaaaggcgcggtgctgagccacatcaagttcgacnagcgaggcngcacggccgttgaagggcctccgtggctgcccctactgctcctacccgccgccggccggagcctttcagctcctgtccccgggccaggccatgaagcggaggaccccccggttgtttcggcgggccctaagaacctgccccgggcggtctggaccctcc

SEQ ID NO: 78492 - DNA, 964 bp, Zea mays
  misc_feature: Ceres CLONE 1563489
  misc_feature: Encodes the peptide sequence at SEQ ID NO. 78493
  misc_feature (413)..(413): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
ctccccgcggtggcggccgctctagaactagtggatcccccgggctgcaggaattcgtctcacccctagaaaaacttcctcctctctcttctccagcgccttccccctgctccctcttatcgtctccgcgctctaaaatggcctcacactccgccacacagtaaacaaaacgacgggcccactccccgacggctgacgccctcccacggccccttccatgaggcagctgcacctctcgccgcagctctccccctccccggtcctctcctctcacttctcgccgccgccggcggaggcctcgtcctggcggcggcggctgcaccggggacgggccttccagccgccgctctcctcgctgcgggatcccaacaaggccacgctccgcaaggcctcgtccaacgtccccttcgctnggggggtgggggggggggaaannnnnnnnnnnnnngnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 78493 - protein, 72 aa, Zea mays
  misc_feature: Ceres CLONE 1563489
  misc_feature (66)..(66): Xaa is any aa, unknown, or other
MRQLHLSPQLSPSPVLSSHFSPPPAEASSWRRRLHRGRAFQPPLSSLRDPNKATLRKASSNVPFAXGVGGGE

SEQ ID NO: 78494 - DNA, 770 bp, Zea mays
  misc_feature: Ceres CLONE 1563490
  misc_feature: Translation starting site: 169
  misc_feature: SWISSPROT Homolog: EC 3.4.11.21 Aspartyl aminopeptidase
ctggagctcaccgcggtggcggccgctctagaactagtggatcccccgggctgcaggaattcgtctcacccctagaaaaagcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgcctttcacgccgttgacgaggcgaagcggcggctgaaggcggcggggttcgtgcagctgtcggagcgggaggagtgggcgggtctcgagcccgggcgcaagtacttcttcacacgcaaccactccactattgtcgcttttgccatcggcgcaaaatacgttgctggcaatgggttccacatcatcggtgcacacactgacagcccttgcctgaagctcaagcctgtctccaaggtaaccaaaggaggttaccttgaggttggggttcaaacgtatggtggttggggttgtggtacacatggtttgaccgtgatcttactgtagctggtagagtgattatacgggagaagaagggatggcgtggtctcttatgcacacaagctttgtacgggtacaggaaaccaattatggcggatacctacttttgggcttttcacctggacagggacttatctcctcaagaaggtctccaaggttaacaaatccagagtcatcctggttgccagtgcctgggctacatgttttcaaagaatgaaaatgcg

SEQ ID NO: 78495 - DNA, 767 bp, Zea mays
  misc_feature: Ceres CLONE 1563492
  misc_feature: Translation starting site: 116
ctcaccgcggtggcggccgctctagaactagtggatcccccgggctgcaggaattcgtctcacccctagaaaaaactactttgagctgcaaggtccgaactaaaaagcacaagaaatggcggccgccttctcctccaccgtcggagctccggcctccaccccgaccaggagcagcttcctcgggaagaagctcaacaagccgcaggtgtccgcggccgtgacctaccatggcaagagctccagcagcaacagcaggttcaaggcgatggctgccaaggaggtggacgagacgaagcagaccgacgaggacaggtggaagggcctggcctacgacatctcggacgaccagcaggacatcaccaggggcaagggcctcgtcgacaacctcttccaggcgcctatgggggacggcacccacgtcgccgtgctcagctcctacgactacatcagccagggccaaaagtcttacaacttcgacaacatgatggatggcttctacatagccaagggcttcatggacaagctcgtcgtccacctctccaagaacttcatgacccctgccaaacatcaaggttcccctcatcctgggtatctggggaggcaaaggccaggggaaatcgttccaatgcgagctggtcttcgccaagatgggcatcacccccatcatgatgagccgccgccaagctggagaacgggcacccccggaaagcccgccaagctcatcagggcagcgcctaccgttgagggcctccgacctcatcaaggag

SEQ ID NO: 78496 - DNA, 748 bp, Zea mays
  misc_feature: Ceres CLONE 1563493
  misc_feature: Encodes the peptide sequence at SEQ ID NO. 78497
ctccccgcggtggcggccgctctagaactagtggatcccccgggctgcaggaattcgtctcacccctagaaaaagtgctacattggaagcatatagcaatgatcttgcgtacttgaagagaaaggttgatgctggtgctgaccttattgttacacaacttttctatgataccgacatctttctcaagtttgtgaatgactgccgccaaattggtattacttgtcccattgttcctggcataatgccaataaataactacaaaggtttcctgcgcatgactgggttctgcaaaactaagataccttctgagatcactgctgcactagatcctatcaaagacaatgaggaggctgttagacaatatggaatccaccttggaactgagatgtgcaagaaaattcttgctactggcattaagactttgcacctttacacactaaacatggacaagtctgctataggaattttgatgaatcttggattaattgaggagtccaaggtttcaagccattacctttgaggcagcgactaatggtttcccgtgttaagaagaatgtcgacctattatctgggccaacagaccaaagagcttcttaaaaggacattaaggtggggatcagtatccccctggaccggggggggtgattctccggaacccatcctatgggagccctttcctggacaccagtttccaaaacccccaaggcccggggtaaaaaacccccaaaaagggaatgggcctgttccc

SEQ ID NO: 78497 - protein, 92 aa, Zea mays
  misc_feature: Ceres CLONE 1563493
  misc_feature: SWISSPROT Homolog: EC 1.5.1.20 Methylenetetrahydrofolate reductase (NAD(P)H)
MPINNYKGFLRMTGFCKTKIPSEITAALDPIKDNEEAVRQYGIHLGTEMCKKILATGIKTLHLYTLNMDKSAIGILMNLGLIEESKVSSHYL

SEQ ID NO: 78498 - DNA, 765 bp, Zea mays
  misc_feature: Ceres CLONE 1563494
  misc_feature: Translation starting site: 125
  misc_feature: Pfam Name: BAH Pfam Description: BAH domain
ctccccgcggtggcggccgctctagaactagtggatcccccgggctgcaggaattcgtctcacccctagaaaaactcctcttgctaggtttctacccctctaaatcgatcctcgctccacggccatggtgaggatgaagcaggtaaagatttcggtaaagaaggacgtggattcgtacacaatccgcggcaccaacaaggtcgtccatgtgggcgactgcgtgctgatgcgggcgtcggactcggacaagcagccgtatgtggcgcgggtggagaagatggaggccgacggacgcggcagcgtgcgggtgcaggtgcgctggtactaccgccccgaggaatccaagggcggtcgccggcagttccacggcgccaaggagcttttcctttccgatcatttcgacctacagagcgcccacaccatcgaggggaaatgtgttgtccactctttcaagaactacaccaagcttgataatgtcgggcctgaggactacttctcccgatttgagtacaaggcggccaccggttcgttcacccctgaccgcgtggcagtgtattgcaaatgtgagatgccatacaacccggatgacctccatggtgcagtgcgaaagcttgcaggactggttccatccatcttgcaatggctatgacccattgaacaggccaaaaaaactagatcactttgttttggctcaaaaccggttttaaaaaaaaaaaaagggggttcccaaacaaaaaaaaaaactcctctccaaaaagggggggt

SEQ ID NO: 78499 - DNA, 772 bp, Zea mays
  misc_feature: Ceres CLONE 1563496
  misc_feature: Encodes the peptide sequence at SEQ ID NO. 78500
  misc_feature (566)..(566): n is a, c, t, g, unknown, or other
  misc_feature (664)..(664): n is a, c, t, g, unknown, or other
  misc_feature (717)..(717): n is a, c, t, g, unknown, or other
ggagctccccgcggtggcggccgctctagaactagtggatcccccgggctgcaggaattcgtctcacccctagaaaaaagcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgaaaccagcgaggctgctgctgttatcgcgaaggccaaggaaggcccaaaccggtgcgcaacctgtaggaagcgtgttgggttgacgggttttaactgccgatgcgggaacacgtactgttcgatgcaccgctactccgacnaacacgactgccagttcgactatcgaactgcagctagggacgctatcgcaaggccaatcccagtggtgaaggcggagaagcttgactagatctgaggncggggcattgggtaaacgaaaatgggttgcgatctgcaagaattcaacatgtnctctttgctgctttatcattgaaacttcccatttcttgtccttggctgtcacgtc

SEQ ID NO: 78500 - protein, 169 aa, Zea mays
  misc_feature: Ceres CLONE 1563496
  misc_feature (112)..(152): Pfam Name: zf-AN1 Pfam Description: AN1-like Zinc finger
  misc_feature (14)..(38): Pfam Name: zf-A20 Pfam Description: A20-like zinc finger
  misc_feature (141)..(141): Xaa is any aa, unknown, or other
MEHKEAGCQQPEGPILCINNCGFFGSAATMNMCSKCHKEMIMKQEQAQLAASSIDSIVNGGDNGKGPAIAATVGVAVPQVEEKTIAVQPMHVAETSEAAAVIAKAKEGPNRCATCRKRVGLTGFNCRCGNTYCSMHRYSDXHDCQFDYRTAARDAIARPIPVVKAEKLD

SEQ ID NO: 78501 - DNA, 864 bp, Zea mays
  misc_feature: Ceres CLONE 1563501
  misc_feature: Encodes the peptide sequence at SEQ ID NO. 78502
  misc_feature (689)..(689): n is a, c, t, g, unknown, or other
  misc_feature (850)..(850): n is a, c, t, g, unknown, or other
ggagctccccgcggtggcggccgctctagaactagtggatcccccgggctgcaggaattcgtctcacccctagaaaaaactttaccatctgctccaagaaagcgtcttggagatggcgcgcaccgagaagctcaccggcgatggctgctccggcggcgaagtccaagtggaggtggagctcggcatgggggtggacgggaagggggtcatagagtgccggatatgccaggaggagggggaggaggccgctatggactcaccttgcgcttgcactggcacactcaagtttgcccacaggaaatgcatacagagatggtgcaacaagaagggaaatattacatgcgaaatctgcaaccaggtttactccccgaattatgtcatccctccaccgaaatgttgttcagatgaaatggacatgaatcttaggcaaaactgggtcggacgaatcgatccccatgattcccatttcctagccatcgccatcgcagagcagcagctgctgcaagctgaatttgatgactgtgtatctgcaaattctagcggtgccacatgctgcagatccatcgctttaattgtgatgttccttttgctcgtacgccatgtaattgtctttgtgagggatgttagcatgctacaagatgcaaacggtgctgttcagcgcaactcttcagtttgcgggatttcttctncctttgtatggtaatagctcgttcttgctacgctttgcagcatcggaaacgggagacagggtgtaggggaggctcacttgaccccttaaagaacacaaagacgccccatttgaagcgccgtcttcggcgttacccccggaaaattaggaggacttcctggnaagcttgcaaaagt

SEQ ID NO: 78502 - protein, 196 aa, Zea mays
  misc_feature: Ceres CLONE 1563501
  misc_feature (35)..(80): Pfam Name: zf-C3HC4 Pfam Description: Zinc finger, C3HC4 type (RING finger)
  misc_feature (193)..(193): Xaa is any aa, unknown, or other
MARTEKLTGDGCSGGEVQVEVELGMGVDGKGVIECRICQEEGEEAAMDSPCACTGTLKFAHRKCIQRWCNKKGNITCEICNQVYSPNYVIPPPKCCSDEMDMNLRQNWVGRIDPHDSHFLAIAIAEQQLLQAEFDDCVSANSSGATCCRSIALIVMFLLLVRHVIVFVRDVSMLQDANGAVQRNSSVCGISSXFVW

SEQ ID NO: 78503 - DNA, 786 bp, Zea mays
  misc_feature: Ceres CLONE 1563502
  misc_feature: Encodes the peptide sequence at SEQ ID NO. 78504
  misc_feature (647)..(647): n is a, c, t, g, unknown, or other
  misc_feature (731)..(731): n is a, c, t, g, unknown, or other
ctggagctcaccgcggtggcggccgctctagaactagtggatcccccgggctgcaggaattcgtctcacccctagaaaaactctcctctccctccctccctccttccccgccgccgtctaccagtacagctcgagcgaacgacgtctcgacagtcccgggccgctgagaacttgccgcgggagggagagcagcagcggcagcatcagacatgtcgtcggggcggtacatggcctactcgccctcgccgtcgaccaccccccactccccccgcatcgccggcctccgcgccccgtctgccgccatggccgaacaggagaagtaccttgccgaactgctcgcggagaggcagaagcttggcccgttcgtcccagtgatcccgcatagtgtacgcttgctgaatcaagaaattttacgtgtttccacactattggagaacgcatcccttttaaatcaaagtggccttgaacatggtagtccactaacaacaggaggattatattcaaatggagcagctactgacatgaatgtgtggacatcagcatttcaaccagaaagttcaccagcttatagctgggcttggaggatcccagggcagctcctctgggacttattgtcaagaaaccaatgtaaggtcgatatcccagtnagacaatatcaacatttgcattttcgttgggccgcatcccttggtccaagaagaaattcctttgaagcgggtggaggctaatcngggactgccgggtgctaattaagaggccgtggcagcatcaaagatccagcccggg

SEQ ID NO: 78504 - protein, 141 aa, Zea mays
  misc_feature: Ceres CLONE 1563502
MAEQEKYLAELLAERQKLGPFVPVIPHSVRLLNQEILRVSTLLENASLLNQSGLEHGSPLTTGGLYSNGAATDMNVWTSAFQPESSPAYSWAWRIPGQLLWDLLSRNQCKVDIPVRQYQHLHFRWAASLGPRRNSFEAGGG

SEQ ID NO: 78505 - DNA, 1345 bp, Zea mays
  misc_feature: Ceres CLONE 1563503
  misc_feature: Encodes the peptide sequence at SEQ ID NO. 78506
agttagttttgcttctttcgtttttatgctggtggtgggttgctgtttcgagcgcgtcagtttgattttgatctcgacaatgaacaggtagctgagacgtccgggccggacggccggatcgtcgccctcgtccggggaaccgtcaagtctgtcgcctccggcaagagccgccctggcgcgcccgccttcgccagagtcggctacattcttggcctccgcgtcgcgccttcccacaggcggatgggcatcgcgcggcagctggtgcatcggctggagcagtggttcgagctgatgggcgccgagtacgcgtacatggccaccgacaggtccaacgaggcgtcgctgcggctcttcaccggccgctgcggctactccaagttccggacgccgtcgctgctggtgcacccggtgcactcgcaccgcctcagggcgccgcgccgcgccacggtggtccgcctcggcgcccgcgacgccgagcggctgtaccgcagccggctcgcgcacgtcgagttcttccccgccgacatcggcgccgtcctgggcaacgcgctctcccgcggcacgttcctggccaccgtgggcggctacgagtggggcggcgtcgaccgcttcctggcgtgcccgccggcgtcgtgggccgtggccagcgcgtgggactgcggcggcgtgttccggctccaggtgcgcggcgcgtcgcgcctgcgccgcgccgccgcggccgccacccgcgcgctggaccgcgccgccaagtggctgcgcgtgccgtccgtgcccgacttcttccgccccttcgcgggctggttcgtctacggcctcgccgggagcggcggccgcgacgccgcgatggccgccgaggcggtcttcgcgtccatcgtcaacatggcgcgcggcagggcggccgccgtggcggtggaggttgccgccatggaccccctccgcgggcgcatcccgcactggcgccgactgtcgtgcaccgaggacctgtggtgcatgaagcggctcggcgctggtggtggcggccacgcggacggctgggactgggccagatcggccccgggtcaatccatcttcgtggaccctagggaggtgtgagggtgactcggcggccgcttctgagcagagctctagtgctctgtttttttttttgccactgagcttcattttgctcctctctctctttttctaacacttccaaattttgcgacccttcagttttgttctggttctggtagacgagatactgtctttttttttttgtagaaccaccagggagtacgacgatggaaaatctatgatgtagatacatttcccttgaaaaaaaaaaaaaaaaaaaaaaaaaaaaaaa

SEQ ID NO: 78506 - protein, 283 aa, Zea mays
  misc_feature: Ceres CLONE 1563503
MGIARQLVHRLEQWFELMGAEYAYMATDRSNEASLRLFTGRCGYSKFRTPSLLVHPVHSHRLRAPRRATVVRLGARDAERLYRSRLAHVEFFPADIGAVLGNALSRGTFLATVGGYEWGGVDRFLACPPASWAVASAWDCGGVFRLQVRGASRLRRAAAAATRALDRAAKWLRVPSVPDFFRPFAGWFVYGLAGSGGRDAAMAAEAVFASIVNMARGRAAAVAVEVAAMDPLRGRIPHWRRLSCTEDLWCMKRLGAGGGGHADGWDWARSAPGQSIFVDPREV

SEQ ID NO: 78507 - DNA, 791 bp, Zea mays
  misc_feature: Ceres CLONE 1563506
  misc_feature: Encodes the peptide sequence at SEQ ID NO. 78508
ggagctccccgcggtggcggccgctctagaatagtggatcccccgggctgcaggaattcgtctcacccctagaaaaaagtgagccgccccgccgctcctcagccatcctctccatctcggtgtcacacactccgcatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctctcctacgacttcggcgcgctggagccggccatctcgggggagatcatgcgcctgcaccaccagaagcaccacgccacctacgtcgccaactacaacaaggcgctggagcagctcgacgctgccgtcgccaagggcgacgcctccgctgtcgtccagctccagggcgccatcaagttcaacggcggcggtcatgtgaaccattcaatcttttggaagaacctcaagcctattagcgaaggtggtggggagccgccacatgggaaacttggctgggccatcgatgaggatttttggttcattttgaggcacttggtaaagaggatgaatgcagaaggcgctgcttttaaaggatcttgaaaggggtggtggttagcttttgggaataaagaggcaaaaaaagcttttcaggttgaaactacaggctaatcaggggatcctctggggtgactaaaggtggcaaagcttggggttccggcctggttggggggatt

SEQ ID NO: 78508 - protein, 156 aa, Zea mays
  misc_feature: Ceres CLONE 1563506
  misc_feature (32)..(113): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
MALRTLASKNALSFALGGAARPSAASARGVTTVALPDLSYDFGALEPAISGEIMRLHHQKHHATYVANYNKALEQLDAAVAKGDASAVVQLQGAIKFNGGGHVNHSIFWKNLKPISEGGGEPPHGKLGWAIDEDFWFILRHLVKRMNAEGAAFKGS

SEQ ID NO: 78509 - DNA, 852 bp, Zea mays
  misc_feature: Ceres CLONE 1563507
  misc_feature: Encodes the peptide sequence at SEQ ID NO. 78510
tggagctccccgcggtggcggccgctctagaactagtggatcccccgggctgcaggaattcgtctcacccctagaaaaaactccgctaccccctcatcctgccatccaccagcagcagtgcaagcagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgagatccggcggtacacggacgccatgtggatcaccacggcgcccatcgaggacatctccttcgtcgccgccacgcgcaccggcttcctccagctgttcgactacatccagggcaagaacgcgtacaacgagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttcgggggcttcgtggcggacgccgacgtcgggggagcatgcagcgcgcctcgaggccagccctcaggggcacccggtggggcccgcgctgtcaacgacgcgcgcaggtccgacccggcctcgccctacaacgtcgcgcagtacactccgcccttcgaggtcaccgggaggggtcaacgagatctggatgctcttcgacgccgacaacaaccccggtacttcctgatgcggattccaagcgtggctctgggggcacccccctggaggcgtttaccaaaaggccg

SEQ ID NO: 78510 - protein, 240 aa, Zea mays
  misc_feature: Ceres CLONE 1563507
  misc_feature (28)..(206): Pfam Name: SOUL Pfam Description: SOUL heme-binding protein
MARRASLLLAAALLVAVAAAAVPPTCERIECPAYEVVDSANGFEIRRYTDAMWITTAPIEDISFVAATRTGFLQLFDYIQGKNAYNETIEMTAPVLTRVSPSDGPFCASAFAVSFYVPAKNQADPPPAEGLRVDRWAGARYAAVRRFGGFVADADVGGACSAPRGQPSGAPGGARAVNDARRSDPASPYNVAQYTPPFEVTGRGQRDLDALRRRQQPRYFLMRIPSVALGAPPWRRLPKG

SEQ ID NO: 78511 - DNA, 715 bp, Zea mays
  misc_feature: Ceres CLONE 1563508
  misc_feature: Encodes the peptide sequence at SEQ ID NO. 78512
  misc_feature (641)..(641): n is a, c, t, g, unknown, or other
  misc_feature (662)..(662): n is a, c, t, g, unknown, or other
ggagctcaccgcggtggcggccgctctagaatagtggatcccccgggctgcaggaattcgtctcacccctagaaaaactctctttccccatccgtccaatcaaccgggctgctctgctgcctctccggcgccattgacgagcaagagagtgctccgacacctggtccgtcgcgtgccgtgcccacccgctaaggccagggcgccccgactcgagctcaccgcgtcgaactcgaaccgctgctgttcctcggcagggggcagggtcgtcgaggatgccggagcactcagagaacgcggcggcggacctgatgggcaacatcatggagaccatcgcggagaacctcccgaggcagaagtccgtgcggttcgacgacggcgacggctcctccatctccgagcaggccaagaagctgttcagcggcggcgagagcaggaagaagtcggtccaccacgtgctgggcggcggcaaatccgccgacgtgctgctgtggcggaacaagaagatctcgtccagcgtgctgggcgtggcgacgctgggtgtgggtggttcttcgagtggctggactaccacttcctcacccatcctctgcttcgtgctcgcgctcggcatgggccgtccagttcgccctggtccatcttcntcgtccagcgttgccctcgcngtggcagctgccgggaggaagctggtttcgcgagcgccggcccgcgggccgcc

SEQ ID NO: 78512 - protein, 147 aa, Zea mays
  misc_feature: Ceres CLONE 1563508
MPEHSENAAADLMGNIMETIAENLPRQKSVRFDDGDGSSISEQAKKLFSGGESRKKSVHHVLGGGKSADVLLWRNKKISSSVLGVATLGVGGSSSGWTTTSSPILCFVLALGMGRPVRPGPSSSSSVALAVAAAGRKLVSRAPARGP

SEQ ID NO: 78513 - DNA, 746 bp, Zea mays
  misc_feature: Ceres CLONE 1563509
  misc_feature: Encodes the peptide sequence at SEQ ID NO. 78514
  misc_feature (394)..(394): n is a, c, t, g, unknown, or other
  misc_feature (427)..(427): n is a, c, t, g, unknown, or other
  misc_feature (441)..(441): n is a, c, t, g, unknown, or other
  misc_feature (473)..(473): n is a, c, t, g, unknown, or other
  misc_feature (487)..(487): n is a, c, t, g, unknown, or other
  misc_feature (658)..(658): n is a, c, t, g, unknown, or other
ctccccgcggtggcggccgctctagaactagtggatcccccgggctgcaggaattcgtctcacccctagaaaaaacgagactgctcggccgacgaaataataaagcgcgcgcgcgcacgcggagaggctcggagagctgagtgagatggcacaaaccatggcgtccatgaccggcctctcgcagggcgttctgcccagcaggcgcgccgccaacagggccaggacggccgccgtcgtcagggcgtccgccgaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtgggactcccggnactctgaactctgaccagggcgagggactttcnacctccccttgaanggagcggttctacctgcagccgctgcccccgncggaggcgggtggnaagggttgaaaacgtccggcccagggaattcatcaaacctcaaagccggttattcaaaaagaaagcgtgggcccttacgtcccaagaagaaccccccgccctcccggggcccctccaaaccgggggctttagaaacctaaaaaaaccgggtttccgttttcccaacccccnggggggggaaaaaacaaaaacccccccggaggccccccccgggaaagttctttttccccccctttggaaaaattttttgaacccgcgc

SEQ ID NO: 78514 - protein, 93 aa, Zea mays
  misc_feature: Ceres CLONE 1563509
MASMTGLSQGVLPSRRAANRARTAAVVRASAEAQAGRRAVLGLVATGIVGGALSQAVHAETVKTIKIGAPPPPSGGTPGTLNSDQGEGLSTSP

SEQ ID NO: 78515 - DNA, 811 bp, Zea mays
  misc_feature: Ceres CLONE 1563510
  misc_feature (422)..(422): n is a, c, t, g, unknown, or other
  misc_feature (490)..(490): n is a, c, t, g, unknown, or other
ccccgcggtggcggccgctctagaactagtggatcccccgggctgcaggaattcgtctcacccctagaaaaaataccatacgccgcgccgccgccaagaacagcgacagccgcgagggcgacacgaccggcaaccggccgaggggagagacgataggcgagtgcgggcggcctatcgccgtgcgacagcggcaccccggtgtggtcgcgtgcgccgccggcgccgcgccaaggcgtcaagcgctgcccagtcccgattccgctctgcactgcctctcgccctgttctgtctgactgtccgagactctgactccgccctggtgagcgttcttcactcctccgattcttcacctcgcactggtccgatgggatccgacgccgaggaggaagcggctgcgaccccagcagcggctgcgaccccangcgctgggcgtctgaagggggacccgggaactgactgtgggaccccaacttgcgaaagattggcgaanaccggcccctgggaacgttcagtttccctgcaaagccgggaaaccgggtttccgggccctgggccgaaaaaaaaccctggaaacccttaatggggaattttgtaagggggggccacccccccccccggggggaacaaacccattttcccaaaaaaaggggggcccctccccccccccttttggccccccccgggggattttcaacgccccacacaaaagtttcaccccccgagaaaaattttcccctcccgcgggccgggggattggggtttccccccaccccctcaaggggaaaatttttaaaaggggggggaactcctc

SEQ ID NO: 78516 - DNA, 810 bp, Zea mays
  misc_feature: Ceres CLONE 1563511
  misc_feature: Encodes the peptide sequence at SEQ ID NO. 78517
ctccccgcggtggcggccgctctagaactagtggatcccccgggctgcaggaattcgtctcacccctagaaaaagtcaagtcatagaacggggttgcgaggtagcccaattctacagcactagtctttttcgtctcggtcgccatgtccttcagcgatgacgaaccgatcatcccttctccaaactcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctccagcccggcggcaacaccaacatcagcgacggcctccagacggggctcaaggtcctcgccgaccgcagctcagctccggtcgcgtcgttggcgtcatgctcatgtccgacggcagcagaaccggggcgagccagccgcaaacgtcaagatcgcaaacgtgccgggtaccacctcgggttcggcgcggactacgacccacggtgctgaacgcgggggccagaacagcatgggagggaccttctccgttcgtcacgacgtggaacttgctgag

SEQ ID NO: 78517 - protein, 200 aa, Zea mays
  misc_feature: Ceres CLONE 1563511
  misc_feature (63)..(190): Pfam Name: VWA Pfam Description: von Willebrand factor type A domain
MSFSDDEPIIPSPNSGPRPTPIVPGRVQLVSKNNNMAPLEENTQKVLLELTGGDSTSDRSGLDLVAVLDVSGSMQGEKIEKMKTAMKFVVKKLSSIDRLSIVTFLDTANRICPLRQVTEDSQPQLLKLIDALQPGGNTNISDGLQTGLKVLADRSSAPVASLASCSCPTAAEPGRASRKRQDRKRAGYHLGFGADYDPRC

SEQ ID NO: 78518 - DNA, 877 bp, Zea mays
  misc_feature: Ceres CLONE 1563513
  misc_feature: Encodes the peptide sequence at SEQ ID NO. 78519
ctccccgcggtggcggccgctctagaactagtggatcccccgggctgcaggaattcgtctcacccctagaaaaattcgcttccccacttctccattccattgcggttctgcgagcccctacctccctgtggtgcttggccatggcggactaccacttcgtgtataaggacgtggagggggcgagcacagagtgggacgacatccagcgccgcttcgggaacttgcccccgaagccggagcccttcaagccgccgcccttcgccccgaaggttgacgccgacgagcagcccaagtccaaggaatggcttgacgtgcgcgagcccgaagagctcgaggaactagaggacgatctggatgacgaccgcttcctcgagaagtacaggaagatgaggctcgcacacctgagggaagccgcaaaagccgcgcgatttggtactatacttcccatcactggctccgacttcgtgcgggaggtatcgcaggcacaatcaaatgtttggggtgtggccttccccctcaaggatgggatacccgaaatgtggattgcttccaaattgtttgggaagaattggctactaggtatcccgccgacaaagttttgttaaattatctcccacaaactgcatcccccaactacccaagatagggaatggtcccaccaatactgggggtataaacaacaaggcgtgttcaaagggactttatgttgggtttggcaaaaattttggtggaaaaaaaaaaacccaccccgaaatgtggtttggggttaccccctttgtcagatacaaaccccggaactgtatataatgggcgcctggggggccacccaatttcactctcggggggaaattgtcttccgaaaggagtttcccacgaa

SEQ ID NO: 78519 - protein, 154 aa, Zea mays
  misc_feature: Ceres CLONE 1563513
MADYHFVYKDVEGASTEWDDIQRRFGNLPPKPEPFKPPPFAPKVDADEQPKSKEWLDVREPEELEELEDDLDDDRFLEKYRKMRLAHLREAAKAARFGTILPITGSDFVREVSQAQSNVWGVAFPLKDGIPEMWIASKLFGKNWLLGIPPTKFC

SEQ ID NO: 78520 - DNA, 778 bp, Zea mays
  misc_feature: Ceres CLONE 1563514
  misc_feature: Encodes the peptide sequence at SEQ ID NO. 78521
  misc_feature (667)..(667): n is a, c, t, g, unknown, or other
  misc_feature (721)..(721): n is a, c, t, g, unknown, or other
ctggagctcaccgcggtggcggccgctctagaactagtggatcccccgggctgcaggaattcgtctcacccctagaaaaagagcccacccaccaaccaaattccgcgagaccgcgactgcttctccatccttccacgaactagacgagggaagagcgctgaagcctgaagctgtggaggaaaacgaaggatctccccgtgcttgtgtatgccaggtcgcctgctctccgtccgcatcccgtccctcgcgaaactcggcgctcccaggtgtgcaaaatccatggcttcagacactggcaagaagctcatccagatcgatgtgagctcggacacagtatgcccttggtgctttgtcggcaaaaagaacctcgagaaagcgatggagcaaagcagggacaagtttgacttcgaggtccgctggcatccgttctttctaaaccctgatgcgcctaaggagggcgtcaggaaatctgacttctacaaggcgaagtttggtcctgttcagtatgagcgtgtcatttctcgcatggccgagatatttcgaggactcgggcttgagtatgacatgtcggggctgacaggggatacgatggatagtcataggctcatagcacttgctggacaccaaggctatgacagcaaaatgctcttggttgaagattattccntaattacttttggtgaggaaaagtatattggtggacaagcaggttttgctggancttgcaagataggtgggcatagaagggggccgaagacttgtttcagaccctaacaaa

SEQ ID NO: 78521 - protein, 164 aa, Zea mays
  misc_feature: Ceres CLONE 1563514
  misc_feature (11)..(140): Pfam Name: DSBA Pfam Description: DSBA-like thioredoxin domain
  misc_feature (130)..(130): Xaa is any aa, unknown, or other
  misc_feature (148)..(148): Xaa is any aa, unknown, or other
MASDTGKKLIQIDVSSDTVCPWCFVGKKNLEKAMEQSRDKFDFEVRWHPFFLNPDAPKEGVRKSDFYKAKFGPVQYERVISRMAEIFRGLGLEYDMSGLTGDTMDSHRLIALAGHQGYDSKMLLVEDYSXITFGEEKYIGGQAGFAGXCKIGGHRRGPKTCFRP

SEQ ID NO: 78522 - DNA, 784 bp, Zea mays
  misc_feature: Ceres CLONE 1563516
  misc_feature: Encodes the peptide sequence at SEQ ID NO. 78523
tcaccgcggtggcggccgctctagaactagtggatcccccgggctgcaggaattcgtctcacccctagaaaaaggccgttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactgggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaacctcaggtgtcgcacccgaccaaggaagcgcccgtcatcgactacaagctcgcgttgctcttccagcccatgcttatgctcggcataaacatcggcgtagagctcagcgtcatcttcccatactggctaatcactgtcctcattataatcctcttcgtaagcacctcgtcgagatccttctacaggggaaatctgatgtgggagggaggagaccaga

SEQ ID NO: 78523 - protein, 86 aa, Zea mays
  misc_feature: Ceres CLONE 1563516
MHDHGGLGVIGLVQPQVSHPTKEAPVIDYKLALLFQPMLMLGINIGVELSVIFPYWLITVLIIILFVSTSSRSFYRGNLMWEGGDQ

SEQ ID NO: 78524 - DNA, 851 bp, Zea mays
  misc_feature: Ceres CLONE 1563517
  misc_feature: Translation starting site: 173
  misc_feature (589)..(589): n is a, c, t, g, unknown, or other
  misc_feature (654)..(654): n is a, c, t, g, unknown, or other
  misc_feature (805)..(805): n is a, c, t, g, unknown, or other
  misc_feature (810)..(810): n is a, c, t, g, unknown, or other
ctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtcnggtgtgggaggcgctggtgctggagatcgtgatgaccttccgggctggtggtacacggtgtacgncccacggcggtggtacccgaagaagggcatgcctgggcaccatcgcccccattgcccatcggcttcatcgtggggccaaattccctggggggggggggggcgcctttcaaaggcgcgtccatgaaaccccggccgtgtcttttcggcccgncctcnttaaagctggggagtgggccttcccaagggggtgttactgg

SEQ ID NO: 78525 - DNA, 773 bp, Zea mays
  misc_feature: Ceres CLONE 1563518
  misc_feature: Translation starting site: 383
  misc_feature: SWISSPROT Homolog: EC 3.8.1.3 Haloacetate dehalogenase
  misc_feature (649)..(649): n is a, c, t, g, unknown, or other
ggagctcaccgcggtggcggccgctctagaatagtggatcccccgggctgcaggaattcgtctcacccctagaaaaaacccgcgacaaccactgagccgagcgggggtggatatggcagcgctcgccgcccaccaccacctccacccctcctccgtcgctgcccgaactccaacacttggccgacgccaccgtttctcgtcgcttcctctcgccgcgcggccctcctcccaaggccgtttcagctcccgagccgcgacccgtgtcctcacgcgcgccggaagcactggcgccagcagcgccgcctcgcccgccgcgacgacggcgtcgtcgttgtcgctggaggagctgcgcgggggctgcaccacctggacgtggcgagggatgcgcgtgaactacctcgccagaggacaggggccgcccgtactgctcgtccacggcttcggcgcctccgtcgcgcactggcgcaggaacattgggggtgttgtctgaatcctataccgtctacgcgatcgatttgctggggtttggcgcgtcggacaagcctcctgggttttcttacacgatggagacatgggccgagctgatactggatttcttgggaggaggtggtcaggaggcccacggtgctcgtcggggaactcggttggnagcctcgcgtgcgtcattgctgcatcagagtccagcagaagaacccgtccggggggcttgtcctgctgaaactggcgccgtggcattgaccaacaaggcgatcgtcgaatgactgggcggatca

SEQ ID NO: 78526 - DNA, 768 bp, Zea mays
  misc_feature: Ceres CLONE 1563519
  misc_feature: Translation starting site: 144
ctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaacccgggagctggaggtgatccactcccgctgggccatgctgggcgcgctcggctgcgtcttcccggagctgctcgcccgcaacgcgtcaagttcggcgagggcgtgtgggtcaagccggctcccgatcttcagcaagggtggactggactacctcggggaacccgagcctcatccacgcgcagaaaatccctcgccatcggggccttgccagtccgggctcaatggggccccgtcaaaggggtaacccgattcgcgggggggcccgttttggggaaagaaggtttcaaaacccccttttttacccgggggggggaggttttttaacaccccggttgggggc

SEQ ID NO: 78527 - DNA, 759 bp, Zea mays
  misc_feature: Ceres CLONE 1563520
  misc_feature: Encodes the peptide sequence at SEQ ID NO. 78528
ctcaccgcggtggcggccgctctagaactagtggatcccccgggctgcaggaattcgtctcacccctagaaaaactccccaatctgattcactaccccctccgtcgtcgccgccgccgccgcaacagcagccatgtccccgtcgctcctcctgcttcactcctctgcgactccttgtagggggcttctgcctccgccatccagctgcttcgccactttctcgcgcgcctcctcccccctgcggccgcgacaccgcatccgcctcgtgtgcgccgccgagcagcccaacggtgccgcctctcctggctctggctctggaggcgacgccacggcaaacccaaccaacaacggactgcccaagaacaggagggttattctcctcgaatacgtcaaaaatgtccagccagagtttatggagctcttcataaaaagagctccagcacaggttgtcgaggccatgcgccaaacagtgactaatatgatgggcactttaccaccacaatttttcgctgtaactgtctcaacggtcgctgaaaatctggctcagcttatgtacagtgtcctaatgactggatacatgtttaggaatgcacagtaccgtctggaactgcaacagagtttggagcagattgctcttcctgaaccaaaagaagaaaaggattacgctcctggaactcagaaaaggtaaccgggggaaagtatccgttggaacaagggcactggacctgaagaaattgatgctgtaaaatatatagaatta

SEQ ID NO: 78528 - protein, 184 aa, Zea mays
  misc_feature: Ceres CLONE 1563520
MSPSLLLLHSSATPCRGLLPPPSSCFATFSRASSPLRPRHRIRLVCAAEQPNGAASPGSGSGGDATANPTNNGLPKNRRVILLEYVKNVQPEFMELFIKRAPAQVVEAMRQTVTNMMGTLPPQFFAVTVSTVAENLAQLMYSVLMTGYMFRNAQYRLELQQSLEQIALPEPKEEKDYAPGTQKR

SEQ ID NO: 78529 - DNA, 818 bp, Zea mays
  misc_feature: Ceres CLONE 1563521
  misc_feature: Translation starting site: 148
  misc_feature (439)..(439): n is a, c, t, g, unknown, or other
  misc_feature (738)..(738): n is a, c, t, g, unknown, or other
ctggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagnctggaggtgatccactcccgctgggccatgctgggcgcgctcggctgcgtcttccccgagctgctcgcccgcaacggcgtcaagttcggcgaagccgtgtggttcaaggccggctcccagatcttcagcgagggcgggctggactacctcgggaacccgagcctcatccacgcgcagagcatccttgctatctgggcctgcccagtcgtgctcatgggcgccgtcgaggctaccgcatcgccggcgccccgctggggaagtcgtcgacccgctctaaccccggcgcagcttcgacccgntcggcttcgcgaaaaccccaaggcctcgccgagctcaagtcaggacctcaaaacggccgcctccctgtttcccaggttcg

SEQ ID NO: 78530 - DNA, 800 bp, Zea mays
  misc_feature: Ceres CLONE 1563522
  misc_feature: Translation starting site: 161
  misc_feature (755)..(755): n is a, c, t, g, unknown, or other
  misc_feature (762)..(762): n is a, c, t, g, unknown, or other
tggagctccccgcggtggcggccgctctagaactagtggatcccccgggctgcaggaattcgtctcacccctagaaaaacccgtgccattgccattcacctccagccaggctacggaaccttatcaccaaaatcctcgtcccctacccgaggcgagcatcatggcggccgcgctcttctccagctcgctctcgccccgcttcctcgccctatcctccccgaagccggccgcgcccgcggccacagccttcctccccttcaggctgccgccgcgcgctgtctcggcgccgggtaggcgggtcttcgagcccgtggccgtcgcggtgtcgtcggagtacaagacggagggcgcggagcaggaagggggaggatggatccgaggagttctccgaggacctgaagctgttcgtcggcaacctaccgttcagcgtcgacagcgcgcagctcgcagggctcttcgagcaggccggctccgtcgagatggtcgaggttgtatatgacagaatgactggacggagccgaggatttggattcgtgacaatgtcttcggccgaagaagccgaagctgctgtcgagcagttcaacggttatgcatttcaaggaagacagctgaagggtgaactgcgggccaccgccacctagagatgaatccacaccagagcaccaggggttggttggttggtgggccgccggcggcctttgtcgattcagctaacaaaggtctacgtgggggaaccttggcgtggggcgttgacnactcaanctctggagaacctgttcagtgaagcaagggccagtgct

SEQ ID NO: 78531 - DNA, 802 bp, Zea mays
  misc_feature: Ceres CLONE 1563523
  misc_feature: Encodes the peptide sequence at SEQ ID NO. 78532
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
tggagctccccgcggtggcggccgctctagaactagtggatcccccgggctgcaggaattcgtctcacccctagaaaaagcgagtacgccgcgtgcgacctcgaggctcgagcttgacgcccgcgtgccatggctcccacggcgccgacgcagcggccgacgatgcgccactcctccgcgttcctcctcccttcaaccgcaccgtcatcgcccgcgcctggtcccgatgacgccgccgtcgcgctcgtcgtcctcaaccagccgctgccccgcttcgcgcccctcctctggtccagagcggcggtgcgggtgtgcgcggacggtggcgccaaccgcgtcttcgacggcatgccggccctgctccccggccaggaccccgacgaggttcgcgcgagttacaagccagatgtaatcaaaggggatatggactcagtaagaccagaagtgaaggagcattattccaacttgggcaccagaattgttgacgagtcacatgaccaggacacgaccgatttacacaaatgcatagcttttatagctgagaattattctgccactaacaaatctaacctcagcatcttggtccttggagcacttggggggaaggtttgatcacgagatgggaaacatcaatgtgcttcatctcttccaagcatcaatatcgtcctcctatcagatgattgtctgatctttctgctctcgaaaatgatacccacgagatcacgttggaaagcgatcgaggggccccactgtggattgatccggattggcatgcgtcgaaannnnccccagaaccccgggc

SEQ ID NO: 78532 - protein, 160 aa, Zea mays; identical to SEQ ID NO: 77665
  misc_feature: Ceres CLONE 1563523
  misc_feature (43)..(159): Pfam Name: TPK_catalytic Pfam Description: Thiamin pyrophosphokinase, catalytic domain
  misc_feature: SWISSPROT Homolog: EC 2.7.6.2 Thiamine diphosphokinase

SEQ ID NO: 78533 - DNA, 781 bp, Zea mays
  misc_feature: Ceres CLONE 1563524
  misc_feature: Translation starting site: 159
  misc_feature (638)..(638): n is a, c, t, g, unknown, or other
  misc_feature (675)..(675): n is a, c, t, g, unknown, or other
ctggagctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaaggcggtgtggttcaaggccggcgcgcagatcttctcggagggcgggctggactacctggggaaccccaacctggtgcacgcacagagcatcctggccatctgggcgtggcaggntggtgctcatgggcttcgtcaggggctacccgcgtcnggcggagcccgcctcggggaagcttcgacaaagtgtacccccggcggcgccttcgacccgctgggcctcgccgacgacccggtaacccgcgccctagctcaaaggg

SEQ ID NO: 78534 - DNA, 809 bp, Zea mays
  misc_feature: Ceres CLONE 1563527
  misc_feature: Encodes the peptide sequence at SEQ ID NO. 78535
  misc_feature (395)..(395): n is a, c, t, g, unknown, or other
  misc_feature (536)..(536): n is a, c, t, g, unknown, or other
  misc_feature (537)..(537): n is a, c, t, g, unknown, or other
  misc_feature (546)..(546): n is a, c, t, g, unknown, or other
  misc_feature (577)..(577): n is a, c, t, g, unknown, or other
ctcaccgcggtggcggccgctctagaactagtggatcccccgggctgcaggaattcgtctcacccctagaaaaaagaggaggcacaagagcgccatacatacacaaacagcgtacaagactcaaccactccctccttgtttgtttatataccttggcaccaccaaggcagcaccctgtaaactaaccaccaaagccgaagaaggcggcttgccctgcccgccgccttggtgccgcgcgcgccatggccaagagcaagtcgtccgccaaggccggccccccgctcctcggcaagtacgagctcggccacctcctcggccggggcaacttcgccaaggtataccacgcgcgctgcctcggcggaggcgaccccgtggccgtgaaggtgctggacaangccgggctggccgccacgggcatggcgtcgcggctcctgcgcgaggtgtccgccatgcgccgcctgagccacccaacgtgctccgcctccacgaggtgctggcgacgcgctcaaagtgtacctcgtgatgaagctggcccnnggcgggaantcctgtcccggctggcgtccctgccgtccgnaagctccccgagaaccggggcgggccgggttcctcccagttgggttggggctaatttaaagccaggggggcggggtgttcccccccgcacgtaaaccccaaaaaagttttgctggaaccccaagcaaacccaaggggtgccaattttgccccccggggcctcccggaatttgccccaaaaaaaggggcccgtaaccagggtgggggaacccccggttttcgggcccccaagt

SEQ ID NO: 78535 - protein, 142 aa, Zea mays
  misc_feature: Ceres CLONE 1563527
  misc_feature: SWISSPROT Homolog: EC 2.7.11.1 Non-specific serine/threonine protein kinase
  misc_feature (51)..(51): Xaa is any aa, unknown, or other
  misc_feature (99)..(99): Xaa is any aa, unknown, or other
  misc_feature (102)..(102): Xaa is any aa, unknown, or other
  misc_feature (112)..(112): Xaa is any aa, unknown, or other
MAKSKSSAKAGPPLLGKYELGHLLGRGNFAKVYHARCLGGGDPVAVKVLDXAGLAATGMASRLLREVSAMRRLSHPTCSASTRCWRRAQSVPRDEAGPXREXLSRLASLPSXSSPRTGAGRVPPSWVGANLKPGGRGVPPRT

SEQ ID NO: 78536 - DNA, 763 bp, Zea mays
  misc_feature: Ceres CLONE 1563528
  misc_feature: Encodes the peptide sequence at SEQ ID NO. 78537
ctcaccgcggtggcggccgctctagaactagtggatcccccgggctgcaggaattcgtctcacccctagaaaaagcaaccaactttcttctccgtcacctgactcacacctccactcacctccggtccaccaacccctgccggccatggcggctgcggcggcgcagaagctcctcgaggcgagcacgaagatcatcggcgtcgggcgcaactacatcgcccacgccgaggagctcggcaacccggtccccaaggagcccgtactattcctaaagccgacctcgtcgttcctccacgctggcgtggccaccgccgccgtcgagatcccggagccgctcgaatcgctacaccacgaggtcgagctcgccgtcgttatctcccggcgtgggcgtgacattcctgaagcgtctgccatggacttcgtcggaggctatgcacttgctttggacatgacagcaaggggccttcaatctgttgctaagtctgcaggccttccatggactttggctaaagggcaagacacattcactccaattagtgcagtagttccaaaatcatctgtcactaatcctgacgatctcgagttatggctaaagggtagatgatgaaactaggcagaaaggatccgacagtgacatgatattcaagatcccttttctgatcagctatatcagcttcatcatgacattaatggaagggtgatgtgatactaacggtactcccgaagggggtgggtccctgtgccagtaaggcagaagaatcaa

SEQ ID NO: 78537 - protein, 152 aa, Zea mays
  misc_feature: Ceres CLONE 1563528
  misc_feature (30)..(153): Pfam Name: FAA_hydrolase Pfam Description: Fumarylacetoacetate (FAA) hydrolase family
MAAAAAQKLLEASTKIIGVGRNYIAHAEELGNPVPKEPVLFLKPTSSFLHAGVATAAVEIPEPLESLHHEVELAVVISRRGRDIPEASAMDFVGGYALALDMTARGLQSVAKSAGLPWTLAKGQDTFTPISAVVPKSSVTNPDDLELWLKGR

SEQ ID NO: 78538 - DNA, 842 bp, Zea mays
  misc_feature: Ceres CLONE 1563529
  misc_feature: Encodes the peptide sequence at SEQ ID NO. 78539
ctccccgcggtggcggccgctctagaactagtggatcccccgggctgcaggaattcgtctcacccctagaaaaaattgcgggaactgaaagcaaaccaaaaaagaaagagagggggagagacacagaggcctcactccacacactgtcttgtctctcagtcccagagctttcttggatcgcgaggaatccactggaaattttgcaattgtagtagagaactgtatcgtccgacgaaggtgcatggtgttggccatgggtcacggcagggaacagagacgagcaggtcggcgctctccccccagctcattgatcctgtcctcgctataaggtagtcctgcggtggcctccgaatttcactcgatcgaacacgacatgaagcggccacgcggcgcctgtccccctctggctgcgatgaccaatccgaacgatgatggttacggcgtggtcgggatggaggcggacgcagacgcggacgcggacgaggagatgatggcgtgcggcggcggcggggagaagaagcggcgcctgagctccgagcaggtgcgcgcgctggagcggagcttcgaggtggagaacaagctggagccggagcgcaaagcgcggctggcgcgcgacctcggcctgcagccgcgccaggtccgccgtctggttccagatacgacgcgcccgctggaagaacaagcatctggagcgcgactactccgcggctccgccagtcctacgacgcgctggcgcacgaccacgacgcgctgcgccgcgacaagacgcccttcctcgcgagatcaaggagctcaaggcgaaactcgtggacgtaagaagcagctggccaaacttcacgtcg

SEQ ID NO: 78539 - protein, 143 aa, Zea mays
  misc_feature: Ceres CLONE 1563529
  misc_feature (35)..(78): Pfam Name: Homeobox Pfam Description: Homeobox domain
MTNPNDDGYGVVGMEADADADADEEMMACGGGGEKKRRLSSEQVRALERSFEVENKLEPERKARLARDLGLQPRQVRRLVPDTTRPLEEQASGARLLRGSASPTTRWRTTTTRCAATRRPSSRDQGAQGETRGRKKQLAKLHV

SEQ ID NO: 78540 - DNA, 872 bp, Zea mays
  misc_feature: Ceres CLONE 1563535
  misc_feature: Encodes the peptide sequence at SEQ ID NO. 78541
  misc_feature (527)..(527): n is a, c, t, g, unknown, or other
  misc_feature (593)..(593): n is a, c, t, g, unknown, or other
  misc_feature (645)..(645): n is a, c, t, g, unknown, or other
  misc_feature (650)..(650): n is a, c, t, g, unknown, or other
ggagctccccgcggtggcggccgctctagaactagtggatcccccgggctgcaggaattcgtctcacccctagaaaaaagaccgcaccgcggccacagcctcgcgtcgtcgccccacagccacgcgagccttcgccgatccgcgagcgcagatcgccgaagccaggcggcggagagggagctcgaggcggcggaggaaggcgttcgccacagtcgctgatttccctggggaagagatggggctctcctttggtaagctgttcagccgcctcttcgccaagaaggagatgaggattctcatggtcgggctcgatgccgccggtaagaccaccatcctctacaagctcaagctcggcgagatcgtcaccaccatccccactatcggattcaatgttgaaactgttgagtataagaacattagcttcactgtttgggatgttggtggccaggacaagatcaggcccctgtggaggcactactttcagaacacacagggacttattttgttgtagacagcaacgacagggnaacgtgttgttgaggctagagatgagctccacaggatgctgaatgaggatgagctgcgtgacgctngtgctgcttgtatttgcaaacaaacaagatcttcccaatgctatgaatgctngctgnattactgacaaagcttggtctgcattccctgcgacagcggcactggtacatccagagcacttggtgctcatcctgggtgaaggggttgtatgagggggcttgactggctttcccaagcacatctccagcaagtctttgaagctttttcggcagggctccctagccgagaagatgtcctgaacaacttatgggctgcctttttttttttacatattaatacaa

SEQ ID NO: 78541 - protein, 91 aa, Zea mays; identical to SEQ ID NO: 77239
  misc_feature: Ceres CLONE 1563535
  misc_feature (1)..(91): Pfam Name: Arf Pfam Description: ADP-ribosylation factor family

SEQ ID NO: 78542 - DNA, 666 bp, Zea mays
  misc_feature: Ceres CLONE 1563538
  misc_feature: Encodes the peptide sequence at SEQ ID NO. 78543
ctccaccgcggtggcggccgctctagaactagtggatcccccgggctgcaggaattcgtctcacccctagaaaaaaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaaagtttccttacgacccctaacctgatttacccggcatcccaaagccctggaaatcaagtacctggaagccaacattcaggttgccccccaagccaaccaaacgggggcaagaagcccagcctgggaaaagaaaccccccctggggaaaaagaaaggggcccggggggcccccgggccctccgggggcccttccaggggggaggaaaaaaaaacccttccctttcccaaaaaaaaatggggccccctttttttctcttttttcccggtaaaaacccgggggatttttaaaaacccccccatttttgtggtttttcccgcccccc

SEQ ID NO: 78543 - protein, 179 aa, Zea mays
  misc_feature: Ceres CLONE 1563538
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVLNATTDAAVTGCSNKSFLTTPNLIYPASQSPGNQVPGSQHSGCPPSQPNGGKKPSLGKETPPGEKERGPGGPRALRGPFQGGGKKNPSLSQKKMGPPFFLFFPGKNPGDF

SEQ ID NO: 78544 - DNA, 670 bp, Zea mays
  misc_feature: Ceres CLONE 1563539
  misc_feature (206)..(206): n is a, c, t, g, unknown, or other
  misc_feature (272)..(272): n is a, c, t, g, unknown, or other
  misc_feature (304)..(304): n is a, c, t, g, unknown, or other
  misc_feature (309)..(309): n is a, c, t, g, unknown, or other
  misc_feature (324)..(324): n is a, c, t, g, unknown, or other
tggagctccccgcggtggcggccgctctagaactagtggatcccccgggctgcaggaattcgtctcacccctagaaaaagtcccacgcgaaggcacccagcagcagccgctcccgaactgaggaaccctaccacgcgggcgacggcggtgcgcgaccggtgacgggacagcggcagcgccccctcctccatctgctggtcccaccngcctcctgacgtttccgatactgctatcccctctcgccgtgacgagctaccgatgaagaggcaggncatggcggagcttcgctttcgctcgtggctgnctcgncccataacccgcggntaggggtagggtggccgaaagatgaccaaccgccaccccgggagcagggccctggtgtcaaaaaaaccaaaaaccccccgccttttggggtccggaaaggaaaaccctgggtccgggaaaaaaaggccccccccccttatattgagcgtgttttccaaatttccccaaatgaaaaaaaaacacttttttttggggccttggggaaaaagggggagggctttccaaacccaaattttctcttttttttcccccccccaaaaaaacttttgggggggggtttttaaaaaagcgcacacaacgtggggtgaataaaattacccggggggaaaccacggggggggggtgt

SEQ ID NO: 78545 - DNA, 779 bp, Zea mays
  misc_feature: Ceres CLONE 1563541
  misc_feature: Encodes the peptide sequence at SEQ ID NO. 78546
ctcaccgcggtggcggccgctctagaactagtggatcccccgggctgcaggaattcgtctcacccctagaaaaatcagccccagccctcggaaacccatcgcaaattcgcaaactaaccccaaaccccaatccaccccatcccctcctcatccactccgggcggccatggcctgctccttctccgccgccatcaccgtctcttccgcccctaccccggccgccagacccctcgctgctgccacgcagtccgtctgcatcgctcgctccgcggtcgccaccactgccaggccgctccgcctcgccgcctcaaggtccgcgcgggctaccagactcgttgcccgcgccagcgtagtcgatgacttgccgctggtcgggaacaaggcgccagacttcgaagccgatgctgtgttcgaccaggagttcatcaacgtgaagctctctgattacattgggaagaagtacgtcattctgttcttctaccccttggatttcaccttcgtctgcccgaccgagattactgcgtttagtgacagatacgaggaatttgagaagttgaaacactgaggttcttggtgtttcaatttgacagtgtgttctcccacccttgcatgggtgcagacagacagggaagtcgggtggggctccggcgatcttaaatacccaccttgtttcctgatggtgacaaaatcaaatttcaaaggggccttttgggggttctgatcccctggacccaggttatggccttttgaagaagaacggtttcatcaattggacaaag

SEQ ID NO: 78546 - protein, 132 aa, Zea mays
  misc_feature: Ceres CLONE 1563541
  misc_feature (69)..(133): Pfam Name: AhpC-TSA Pfam Description: AhpC/TSA family
  misc_feature: SWISSPROT Homolog: EC 1.11.1.15 Peroxiredoxin
MACSFSAAITVSSAPTPAARPLAAATQSVCIARSAVATTARPLRLAASRSARATRLVARASVVDDLPLVGNKAPDFEADAVFDQEFINVKLSDYIGKKYVILFFYPLDFTFVCPTEITAFSDRYEEFEKLKH

SEQ ID NO: 78547 - DNA, 770 bp, Zea mays
  misc_feature: Ceres CLONE 1563542
  misc_feature: Encodes the peptide sequence at SEQ ID NO. 78548
  misc_feature (431)..(431): n is a, c, t, g, unknown, or other
  misc_feature (624)..(624): n is a, c, t, g, unknown, or other
ctccccgcggtggcggccgctctagaactagtggatcccccgggctgcaggaattcgtctcacccctagaaaaaagacgtctctgaaccgaggctgcgactgcgagggcatcagggcagcgaggcttcttgtcgcgtgaatcccctcgagagccgccggcggagccatggcgcggtccccagctgcctcctcctcctcctacacggatagcacgggatcctcctccgactcaggctccagctcatcgggaatcgaccgccgccgccgccgccaccgccatcggagcagccgccgcaaggagggcacgtcctcgtccgcgctgaaggcgcgcaaggaccggaggtcccgccacaagcgccgccgccacgagcgggagcggcggcggtccgcgtccgacgacgacagctacagcacaagctcttatgacagtngaccgtgaggtgtctggcagatctcggaaacataagaagagcagcagatcaagaaagtttagggagagggagcggagcaaagatagacatcatagacgagacaagagtaaacacaaagagcctgggattgggtgaacggggtgacaaccatggtgggattgggcctgctgcttgttcttgttggggggggggnttggggtgggggttccaattaataaaaaagggggggggaagccttttttttcccggaaagaaaaaggagaagtggaagcccttggccttaattggggccccttggttccaagccttttttcccaaaagttttttcttgggggaagg

SEQ ID NO: 78548 - protein, 90 aa, Zea mays
  misc_feature: Ceres CLONE 1563542
  misc_feature (89)..(89): Xaa is any aa, unknown, or other
MARSPAASSSSYTDSTGSSSDSGSSSSGIDRRRRRHRHRSSRRKEGTSSSALKARKDRRSRHKRRRHERERRRSASDDDSYSTSSYDSXP

SEQ ID NO: 78549 - DNA, 832 bp, Zea mays
  misc_feature: Ceres CLONE 1563543
  misc_feature: Encodes the peptide sequence at SEQ ID NO. 78550
  misc_feature (551)..(551): n is a, c, t, g, unknown, or other
  misc_feature (616)..(616): n is a, c, t, g, unknown, or other
  misc_feature (723)..(723): n is a, c, t, g, unknown, or other
ctggagctccccgcggtggcggccgctctagaactagtggatcccccgggctgcaggaattcgtctcacccctagaaaaaaaggaagagagagctctccgcctctcctccgccttagagcgacgtcgctgccggagctcgatacctatgggtggcttcgggacctcgcgccctgcctccgtcgccctctgcgccttcctcaccttcctcaacctcttcgccgtccttctcgccgtcggcgccgagcgccgccgcagcaccgggaaggtgatgccggacgagtacgacgagcggtcctactgcctatacgacactgacgcctcctcggtgtacggcgtctccgctttcttcgtgctcctgctccagcaggccattgtcaacgccgccacgtggtgcctctgcttcggacccgtgctctcctcccgcggctgtgccgtaacggcattcgtcctctcctggataacattcctcgtcgcagaagcttgtctcataggaggatcggtgaggaatgcaaagcacaccaagtatttaggctactacatgaagcatgancttggtgtcgtgcgccgcccttcgcaagggagtctttgcagcagcggctgcaatgatgatcatcnacctcctggcgtccctggtgtactactggagttactcaaaaagctgcgacggggtgggttcatgaagcaccaaaatggaggttgggtgtgggcatgaacggattacngcctttgaccaaggtgtttcctggccccctgagtgagatggaaatctattggccctctgtgccgtatttaatactatcgtccaaaatgattgtggaataaaatttgatt

SEQ ID NO: 78550 - protein, 188 aa, Zea mays
  misc_feature: Ceres CLONE 1563543
  misc_feature (52)..(144): Pfam Name: DUF1218 Pfam Description: Protein of unknown function (DUF1218)
  misc_feature (135)..(135): Xaa is any aa, unknown, or other
  misc_feature (157)..(157): Xaa is any aa, unknown, or other
MGGFGTSRPASVALCAFLTFLNLFAVLLAVGAERRRSTGKVMPDEYDERSYCLYDTDASSVYGVSAFFVLLLQQAIVNAATWCLCFGPVLSSRGCAVTAFVLSWITFLVAEACLIGGSVRNAKHTKYLGYYMKHXLGVVRRPSQGSLCSSGCNDDHXPPGVPGVLLELLKKLRRGGFMKHQNGGWVWA

SEQ ID NO: 78551 - DNA, 756 bp, Zea mays
  misc_feature: Ceres CLONE 1563544
  misc_feature: Encodes the peptide sequence at SEQ ID NO. 78552
  misc_feature (673)..(673): n is a, c, t, g, unknown, or other
  misc_feature (679)..(679): n is a, c, t, g, unknown, or other
  misc_feature (680)..(680): n is a, c, t, g, unknown, or other
  misc_feature (721)..(721): n is a, c, t, g, unknown, or other
ggagctcaccgcggtggcggccgctctagaactagtggatcccccgggctgcaggaattcgtctcacccctagaaaaagcctctcaaccactcatcatcgccttcgcaggcatcgccctctcgccgggccgtccgattccgccatggcttccgatgagagcaaaaattcaaaaccagagaagccatcttcagcagctggtgcaggcctccccaatccgtttgatttttcttctatgagcaacttgctcaatgacccatcgataagagagatggctgagcaaattgcaagtgaccctgtgttcaaccagatggctgaacagcttcagaaaagtgctcagggtgctggagaacagggtattcctgcattggatcctcaacagtatatggaaacaatgcaacaagtcatgcaaaaccctcagtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgagatagagaaatgggggtccatctgccaatggtgaagtattggaaatgaccccctgaggtcttttcaaagatggccagggcaatgggggtgttaccnttcccnnggagattctagttgtgtccacctgtggctctcctgacccgnaagagacctgaggaagaaaaggaggggaattgaca

SEQ ID NO: 78552 - protein, 155 aa, Zea mays
  misc_feature: Ceres CLONE 1563544
MASDESKNSKPEKPSSAAGAGLPNPFDFSSMSNLLNDPSIREMAEQIASDPVFNQMAEQLQKSAQGAGEQGIPALDPQQYMETMQQVMQNPQFVSMAERLGNALMQDPAMSSMLENLTSPAHKEQLEERMARIKEDPSLKPILDEIEKWGSICQW

SEQ ID NO: 78553 - DNA, 825 bp, Zea mays
  misc_feature: Ceres CLONE 1563546
  misc_feature: Encodes the peptide sequence at SEQ ID NO. 78554
  misc_feature (695)..(695): n is a, c, t, g, unknown, or other
ctccccgcggtggcggccgctctagaactagtggatcccccgggctgcaggaattcgtctcacccctagaaaaaagttctccgcacccacccacccacccactcctttccccaacccatggccgccgccgccgccggcacccgggaggagatggtctacatggccaagctagcggagcaggcggagcggtacgaggagatggtggagttcatggagaaggtcgcggccgccgccgagctcaccgtcgaggagcgcaacctgctctccgtcgcctacaagaacgtcatctgcgcgcgccgcgcctcctggcgcatcgtctcctccatcgagcacaaggaggagacgcggggcgcggcggggcacgccgccgccgccagggggtaccgcgcgcgcgtggaggccgatctctccgggatctgcgcggagatcctgcgtctcctcgacgatcgcctcgtgactgcggcggtgaccgtggacacttgggtctgctcctcgggatgataggggactccacgcgctaccttcccaaagtttcagaccggctccaatcccaaggtaggccaagagtatccacgattccgggctagcagggcggagatgaaattggctttccaggagctgccgcccccggttgcccttcagggttggcccttccccctaaggtttttccccccttgtaacccaaattccccagncttgcccgggaacggggccgggctttggtgggcaaaaaagggctttttaaagaaaagttttttgaaactgaaattcccctggggggaaaagaatttcccccgggatttcccccccctccccttggggcgt

SEQ ID NO: 78554 - protein, 127 aa, Zea mays
  misc_feature: Ceres CLONE 1563546
  misc_feature (9)..(127): Pfam Name: 14-3-3 Pfam Description: 14-3-3 protein
MAAAAAGTREEMVYMAKLAEQAERYEEMVEFMEKVAAAAELTVEERNLLSVAYKNVICARRASWRIVSSIEHKEETRGAAGHAAAARGYRARVEADLSGICAEILRLLDDRLVTAAVTVDTWVCSSG

SEQ ID NO: 78555 - DNA, 780 bp, Zea mays
  misc_feature: Ceres CLONE 1563547
  misc_feature: Encodes the peptide sequence at SEQ ID NO. 78556
  misc_feature (764)..(764): n is a, c, t, g, unknown, or other
  misc_feature (765)..(765): n is a, c, t, g, unknown, or other
ggagctccccgcggtggcggccgctctagaactagtggatcccccgggctgcaggaattcgtctcacccctagaaaaatctctcatggcactcggtgtctcctgatagctgctgcttcgatctactccacctaaccgaaagagcgtcgtgtagggtcttggattcttggtccagtgctgttggcctgtttcttgagatcgaagatccaggagatgatcctgcggcggagatcgaggtcgatgaacagcagcgccggcgcccagaggagccacgtccccgatcagtccgcgagatcgtcgaccagtccatgcgacggtgacagttggcggggccggcgccgccggcagcaagaatgcgaccgcgcgtgccctgttcgcttccccgaggctgctgcactcttcttccctgcccgccggcaccgtcgccttcgccaagagccccgcgccggacgccgagccccagacggccttctccatgagcccgacctccgtgctcgacgcggcggcggccttcgcgcggggcacggacggcgccggcaagcgcctgccccccgtggcgggcgcgggacaacaactggctcgcggaacgcgctggactgcagcgaccaccaccaccagcagcagcgcaagtagcggatcgtcctcgcgggcgacccccgtcgtcgtgctcgccttgccaaaatcgtgctccctggggacgccccccgcccaagttccggcgtcaagaaacaggagctccgtgggctggccccctccgcggccccnnaagggccccaggggc

SEQ ID NO: 78556 - protein, 139 aa, Zea mays
  misc_feature: Ceres CLONE 1563547
MILRRRSRSMNSSAGAQRSHVPDQSARSSTSPCDGDSWRGRRRRQQECDRACPVRFPEAAALFFPARRHRRLRQEPRAGRRAPDGLLHEPDLRARRGGGLRAGHGRRRQAPAPRGGRGTTTGSRNALDCSDHHHQQQRK

SEQ ID NO: 78557 - DNA, 872 bp, Zea mays
  misc_feature: Ceres CLONE 1563548
  misc_feature: Encodes the peptide sequence at SEQ ID NO. 78558
  misc_feature (645)..(645): n is a, c, t, g, unknown, or other
  misc_feature (647)..(647): n is a, c, t, g, unknown, or other
  misc_feature (660)..(660): n is a, c, t, g, unknown, or other
  misc_feature (800)..(800): n is a, c, t, g, unknown, or other
  misc_feature (801)..(801): n is a, c, t, g, unknown, or other
ggagctccccgcggtggcggccgctctagaactagtggatcccccgggctgcaggaattcgtctcacccctagaaaaaaccgcaaggatccaccacaacagcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcaggtaatattttccgtgatccgcttagtgcgccgcacagcattggccgcctgctgaacctgatggacgacttggcggtggcggcgccaggtcgtgctgtgcgccgtggctggaacgcgaaggaggacgaggaggcgctgcacctgatggtggacatgccgggcctggtggaagagcaacgtcaaggtgtgggcggagcaaaacaagcttggtgatcaagggcgagggcnanaaggatgatagcntaggacgatgccgccccgcctccgagatacggcggtcgcatcgagctccgcgcagaaggtttacaggatgacaagatcaatggcggagatgaagacggcgtgcgttaaggtggtccctgccccaaagtgaaggatcaccnncccccaaggacgtgttcccagttcaaaatccgaggtaattgttccaaattaaaaaagaagtgcccggtacg

SEQ ID NO: 78558 - protein, 153 aa, Zea mays
  misc_feature: Ceres CLONE 1563548
MASIVASRRAVPLVRALEKLIAASSAPGTGSALRPVAVAGGLRGYNTGAPLRRYEGAESEDDSVREYDGRHGGRDYAVPSLFSGNIFRDPLSAPHSIGRLLNLMDDLAVAAPGRAVRRGWNAKEDEEALHLMVDMPGLVEEQRQGVGGAKQAW

SEQ ID NO: 78559 - DNA, 772 bp, Zea mays
  misc_feature: Ceres CLONE 1563549
  misc_feature: Encodes the peptide sequence at SEQ ID NO. 78560
  misc_feature (634)..(634): n is a, c, t, g, unknown, or other
  misc_feature (695)..(695): n is a, c, t, g, unknown, or other
  misc_feature (758)..(758): n is a, c, t, g, unknown, or other
ctccccgcggtggcggccgctctagaactagtggatcccccgggctgcaggaattcgtctcacccctagaaaaaaggttaaagcgacgccgccgccgcaagccgtccgccttgcccttcacgaaggcttggtcctcctccttgtatctccactccccccttcacagatccgttcctccagctagggttagcgttcctctgcagcgatggcgatcaagcggactaaggcggagaagaagatcgcgtacgacaagaagctgtgcagcctgctcgatgagtacaccaaggtgctcatcgccctggccgacaacgtcggttccaagcagctccaggacatccgccggggcctcaggggcgactcggtggtgctcatggggaagaacacgctcatcaggcgttgcatcaaggtgtacgccgagaagaccggtaaccacacctttgacccgctcatggacctcctggtcggcaacgtaggcctcatcttcaccaagggagacctcaaggaggtgcgcgaggaggtcgccaagtacaaggtgggggctcctgctcgtgtttggtctggttgctccagttgaatgtttgttgtgccccctggcaacactggggctggatccgtcccagacctctttcttccnaggtgcttaacatccccaccaagattaaccaagggtaccgtgggaaattatcaccccctgntggagctgaaatcagaaaggggtgaaaaaggtggggcttcgtcccgaaatctggccctgctcngccaaaactggggt

SEQ ID NO: 78560 - protein, 122 aa, Zea mays
  misc_feature: Ceres CLONE 1563549
  misc_feature (6)..(110): Pfam Name: Ribosomal_L10 Pfam Description: Ribosomal protein L10
  misc_feature: SWISSPROT Homolog: EC 4.2.99.18 DNA-(apurinic or apyrimidinic site) lyase
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEVREEVAKYKVGAPARVWSGCSS

SEQ ID NO: 78561 - DNA, 821 bp, Zea mays
  misc_feature: Ceres CLONE 1563550
  misc_feature: Encodes the peptide sequence at SEQ ID NO. 78562
  misc_feature (497)..(497): n is a, c, t, g, unknown, or other
ctccccgcggtggcggccgctctagaactagtggatcccccgggctgcaggaattcgtctcacccctagaaaaaacgcctcccaacctcctctgctctcccccacctcccggtccggcagcagagagcgggggtgcagagagatcgagatccggaggccgcgagtgggagcgccaccaccagcgactgcggcaatggcgggcacggtgacggtcccggggtcgtcgaccccctccacgccgctgctcaaggacgagctcgacatcgtgatcccgacgatccgcaacctcgacttcctggagatgtggcggcccttcttccagccctaccacctcatcatcgtgcaggacggcgacccgaccaagaccatcaaggtgcccgagggcttcgactacgagctctacaaccgcaacgacatcaaccgcatcctcgggcccaaggcctcctgcatctccttcaaggactccgcctgccgctgcttcggctacatggtctccnagaagaagtacatctacaccatcgacgacgactgcttcgtttgccaggacccatctgggcaggatatcattgctcttgagcagcacatcaagaaacctcctaagcccatcccaccccggttcttcttcaaaaccctggtaggaacccctaccgggaggggggctgaactttggggccgtggaaacccccttcagcccccaggaaaggggggttcaacccggcgtttccccaaggccgtggggtggaaaatccccggaacattaaaggcccccccaccaagggttgcaaaccccaggagagagaaaaaaaaaggttttttttaaa

SEQ ID NO: 78562 - protein, 208 aa, Zea mays
  misc_feature: Ceres CLONE 1563550
  misc_feature (13)..(209): Pfam Name: RGP Pfam Description: Reversibly glycosylated polypeptide
  misc_feature (102)..(102): Xaa is any aa, unknown, or other
MAGTVTVPGSSTPSTPLLKDELDIVIPTIRNLDFLEMWRPFFQPYHLIIVQDGDPTKTIKVPEGFDYELYNRNDINRILGPKASCISFKDSACRCFGYMVSXKKYIYTIDDDCFVCQDPSGQDIIALEQHIKKPPKPIPPRFFFKTLVGTPTGRGAELWGRGNPLQPPGKGGSTRRFPKAVGWKIPGTLKAPPPRVANPRREKKKGFF

SEQ ID NO: 78563 - DNA, 848 bp, Zea mays
  misc_feature: Ceres CLONE 1563551
  misc_feature: Translation starting site: 108
  misc_feature: Pfam Name: RNA_pol_Rpb5_C Pfam Description: RNA polymerase Rpb5, C-terminal domain
  misc_feature: SWISSPROT Homolog: EC 2.7.7.6 DNA-directed RNA polymerase
  misc_feature (620)..(620): n is a, c, t, g, unknown, or other
acccgcggtggcggccgctctagaactagtggatcccccgggctgcaggaattcgtctcacccctagaaaaaaaccagaggagccaagcagaggaagcgaggcggagatgtcggcggggctggtgaccgacgaggccaccgtggggcggctgtaccggatccggcgcacggtgatgcagatgctgcgtgaccgtggctacctggtggtggaccacgagctcgccaccagccgccgcgacttcctccgcaagttcggcgagtccttccaccgcgaggacctcctcatcaacaagtacaagaagaacgacccatccgaccagatatatgtcttcttccccaacgatgacaaggtagggatgaagcacatcaagaagtacgtcgaaatgatgacgcacgagaacgtctccagagctgtgctggttctccagcagaacctaactccgtttgcgaagtcgtttctcatagagttggagccaaagatccatctggaaattttccaggaggccgagatgcttataaacatcaaggaacatgtccttgttcctgagcatcaggtgctcacaaacgaggagaagaaacgcttctgggagcgtacaccttgaaggaaactcagcttccangaatacagatcacgggatcaatttgctagatactacggcctcaggcggaggaacagtcgtgaagatcatcaggcccagcgagacggcggggcagatacgttacatacccggctacgttgttatgacagaaccgtccagaacacctgaagaaggaagagaaccccccgatatgttcaaaaaaaatcaagattccccttggggcccacgtgcttggcagacattcaagtt

SEQ ID NO: 78564 - DNA, 833 bp, Zea mays
  misc_feature: Ceres CLONE 1563553
  misc_feature (501)..(501): n is a, c, t, g, unknown, or other
ctccccgcggtggcggccgctctagaactagtggatcccccgggctgcaggaattcgtctcacccctagaaaaagagcttatcacttatcatccccatccgcacctctctccgtctccctgctcctccgcctccttcttgatccagccaagccagggatcgccgtgtcggactcggaggagcaccacttcaaatcgaaggccgacgccggagcgtccaagacctacccgcagcaggctggcaccgtcagtaagaacggcttcatcgtcatcaagaaccgcccctgcaaggttgtggaggtgtctacctcaaagactggtaagcatggccatgccaaatgccactttgttgccatagacatattcaacgggaaaaagctcgaagatattgttccttcatcacacaactgtgatattccgcatgtgaaccgtactgagtaccagctgattgatatatcagatgatggatctgtgagccttcttacttcagatggcaacactcnggatgatgctagactcccaactgatgagactcttgtggccagatcaaggaagggtttcgaagcggcaaggatcttggtgtgacctgtcagtctgctattggggaggagcacatctgcgcgcttgatgatgttgggccccaggtgacttacctgccttggaaaactggggcccaaaacgtaattggaaaaagcactgtttcatggattggctaaagagaaattccctcgggcttgaagctggccttttgctatgggcaaaacaaggggaagggaatgcgtggggggttgaccccggggaatagctttaaaccgggggttacattcccggaacc

SEQ ID NO: 78565 - DNA, 764 bp, Zea mays
  misc_feature: Ceres CLONE 1563554
  misc_feature: Translation starting site: 162
  misc_feature: SWISSPROT Homolog: EC 2.1.2.11 3-methyl-2-oxobutanoate hydroxymethyltransferase
ctcaccgcggtggcggccgctctagaactagtggatcccccgggctgcaggaattcgtctcacccctagaaaaacccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaacaaggacatttgagatagaattggcgatgttgtcaagtgctcaccatgtggagatgacccccagtgatgctggctttcaggacaggtatgttgttcaggaggtcatcaaagagatggcgaagaacaggccaattgatgccaaaggcaagagagcatttaaagtccttgtgttaaatgaggtcgaacagctctcacgaggagcccagcattccctccgcaggactatgggaaaagtatagctcatcatgtagactgatcctatgctgtaacagctccctcaaaagtgacagaaagctggttagatccccgttgcttaaaatgtgcgaagtaaatgccccccagcgaagaatcagaattgtccaaagttt

SEQ ID NO: 78566 - DNA, 818 bp, Zea mays
  misc_feature: Ceres CLONE 1563555
  misc_feature: Encodes the peptide sequence at SEQ ID NO. 78567
  misc_feature (661)..(661): n is a, c, t, g, unknown, or other
  misc_feature (675)..(675): n is a, c, t, g, unknown, or other
  misc_feature (762)..(762): n is a, c, t, g, unknown, or other
ctccccgcggtggcggccgctctagaactagtggatcccccgggctgcaggaattcgtctcacccctagaaaaaaagggtgttctcgaacgcatcaggctcctactcgtccaacgtgaacctggcggtggagaacgcgtcatggaccgacgagaagcagctccaggacagatgtacctgagccgcaagtccttcgcgttcgacagcgacgccccaggggcaggcatgaaggagaagcgcaaggcgttcgagctcgccctggcgacggcggacgccacgttccagaacctcgactcgtcggagatctcgctgacggacgtgagccactacttcgactcggacccgaccaagctcgtgcaggggctgcgcaaggacgggcgggcgccgtcctcgtacatagccgacaccaccacggcgaacgcccaggtgaggacgctgtcggagacggtgcgcctcgacgcgaggaccaagctgctgaaccccaagtggtacgaggggatgatgaagagcgggtacgagggggtcagggagatcgagaagcggctcaccaacaccgtcgggtggagcgccacgtctgggcaggtcgacaactgggtctacgaggaggccaactccacgttcatcgaggacgaagcgatgaggaagaggctcatggacaccancccaatttcgtcangaagttggtgcagacttccctggaagcagtggcagaggctactgggagaacacggagagaactggacagctcaggagctcctatccngagttgagacagaattgagggatggcaggtaattgatttgccatcgggtcggccat

SEQ ID NO: 78567 - protein, 207 aa, Zea mays
  misc_feature: Ceres CLONE 1563555
  misc_feature: SWISSPROT Homolog: EC 6.6.1.1 Magnesium chelatase
  misc_feature (164)..(164): Xaa is any aa, unknown, or other
  misc_feature (169)..(169): Xaa is any aa, unknown, or other
  misc_feature (198)..(198): Xaa is any aa, unknown, or other
MYLSRKSFAFDSDAPGAGMKEKRKAFELALATADATFQNLDSSEISLTDVSHYFDSDPTKLVQGLRKDGRAPSSYIADTTTANAQVRTLSETVRLDARTKLLNPKWYEGMMKSGYEGVREIEKRLTNTVGWSATSGQVDNWVYEEANSTFIEDEAMRKRLMDTXPISSXSWCRLPWKQWQRLLGEHGENWTAQELLSXVETELRDGR

SEQ ID NO: 78568 - DNA, 740 bp, Zea mays
  misc_feature: Ceres CLONE 1563556
  misc_feature: Encodes the peptide sequence at SEQ ID NO. 78569
ctccccgcggtggcggccgctctagaactagtggatcccccgggctgcaggaattcgtctcacccctagaaaaacccctctcactcgcctcgacgcgcctctgaaagttcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagccttttgggcccttcgatgtctgttagcggtggcatcaatgtcccagtgatgcggaccccgctctgtgctaatgctcctgctgagaaaggaggcaagaacttcatgatcgatttcatgatgggcggtgtttcagctgctgtttcgaagactgctgctgctcccatcgagcgtgtgaagctgcttattcagaaccaagatgagatgattaagtctggtaggctatcagagccgtacaagggtattgttgactgcttcaaacgtaccattaaaggatgagggtttctcttcctttgttgaaggggtaaacactgctaatgttatttcgttacttcccctactcagggcttggaacttttgcattttaaagactacccttcaagaaggttggttaaccttcagaaaga

SEQ ID NO: 78569 - protein, 144 aa, Zea mays
  misc_feature: Ceres CLONE 1563556
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAPIERVKLLIQNQDEMIKSGRLSEPYKGIVDCFKRTIKG

SEQ ID NO: 78570 - DNA, 817 bp, Zea mays
  misc_feature: Ceres CLONE 1563557
  misc_feature: Encodes the peptide sequence at SEQ ID NO. 78571
  misc_feature (668)..(668): n is a, c, t, g, unknown, or other
ggagctccccgcggtggcggccgctctagaactagtggatcccccgggctgcaggaattcgtctcacccctagaaaaacccgtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgaaggtgaactgcgggccaccgccacctagagatggatccgcaccaagagcaccaagggtgggtggttggtggcggccgcngcagcagcctttgtcgatccagggaacaagggtatacgtgggggaaccttggcatgggggcgttgacaactcgactcctggagaaacctattcagtgaaccaaggaccaggtgcttggatgcctaaaggtcatcttacgaacagggata

SEQ ID NO: 78571 - protein, 224 aa, Zea mays
  misc_feature: Ceres CLONE 1563557
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (175)..(175): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLKVNCGPPPPRDGSAPRAPRVGGWWRPXQQPLSIQGTRVYVGEPWHGGVDNSTPGETYSVNQGPGAWMPKGHLTNRD

SEQ ID NO: 78572 - DNA, 690 bp, Zea mays
  misc_feature: Ceres CLONE 1563558
  misc_feature: Encodes the peptide sequence at SEQ ID NO. 78573
  misc_feature (331)..(331): n is a, c, t, g, unknown, or other
  misc_feature (645)..(645): n is a, c, t, g, unknown, or other
  misc_feature (646)..(646): n is a, c, t, g, unknown, or other
ttccccgcggtggcggccgctctagaactagtggatcccccgggctgcaggaattcgtctcacccctagaaaaaaattacgacacgcctgccgccgccacgccgcccgaaatccggaggggaagctcctcgacgacgtagcggccagtggcagctcggacgatggcctcgtccaactccgccgccccggctcccgccgacgggggcgacgacctcgaccagctcctcgacagcgcgctcgacgacttcaccaacctcgatctctctgcctctgccgcccccaaaagctccggcgaagcatcgggggtcaggatcggggagcaaggggccanttgaaaaggggcttgggggcctggggggtctttcccgggaaaccccccagggggggccccaaaaaaaccgggccccccccgggggggaaaaaaacccccccccccccccaaaaaaggggggggggccctttgtggggcgcccaaaaaaaagagaggggcccccccccccgggggggagaggtttttttcccccccccccccaaaaaaaaaaacccccggggggggaagggggggtttttttttttttttcccccccccttttttttttttttttataaaaaaaaaaaaaaggggcgcccccccccccggccccnngggggaggaaaataatttttgctccccccccccccccccccccc

SEQ ID NO: 78573 - protein, 56 aa, Zea mays
  misc_feature: Ceres CLONE 1563558
MASSNSAAPAPADGGDDLDQLLDSALDDFTNLDLSASAAPKSSGEASGVRIGEQGA

SEQ ID NO: 78574 - DNA, 786 bp, Zea mays
  misc_feature: Ceres CLONE 1563561
  misc_feature: Encodes the peptide sequence at SEQ ID NO. 78575
  misc_feature (14)..(14): n is a, c, t, g, unknown, or other
  misc_feature (18)..(18): n is a, c, t, g, unknown, or other
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (29)..(29): n is a, c, t, g, unknown, or other
  misc_feature (316)..(316): n is a, c, t, g, unknown, or other
  misc_feature (322)..(322): n is a, c, t, g, unknown, or other
  misc_feature (588)..(588): n is a, c, t, g, unknown, or other
  misc_feature (605)..(605): n is a, c, t, g, unknown, or other
  misc_feature (612)..(612): n is a, c, t, g, unknown, or other
  misc_feature (669)..(669): n is a, c, t, g, unknown, or other
ctggagctccaccncggntgnngcggcnncgctctagaactagtggatcccccgggctgcaggaattcgtctcacccctagaaaaaatcgctcatcacagataaatcttttttcccctccatttcatttcagcgtcgcgaaaaatggtagtcgttgatccgaaagccgtcgcctcggcgcaccagttcaccgtggtaatcgacggcgtcgagacgaccgtccacgagggcgtgctccggcgcaacgcggcacggtggccgtggtcggcccgggcttctcgaagtgaccctcccccaccccttgttgttcccccgcnggggcngggggcaaaatcggcctttcccccgggccccttacccggcccccaaaggatgggggcgggggttttttcccccgggggaaaaccggccccccggggggggccccccccccccgggggcgtggcgcccttcccactttccgcaaaaatgagaagcccggggcgccccattatccccccccccccctaaaagggggccgccccccgggtcctcgcatccgcggggagaacccttctggaagcctcagctccgggagacgcacaaacanagaggggcgctacaccnccccacntgcgcggatttctgtccgccacgagaaacccgagcattggaggaggtgttctcgacncctcaagtaaataaggtttttttacagccacaatcaatcttagacatcacccgcggccggattcacacacattcgggcaccatcaactcccctctcgtcgggtgggtgggtaaccgt

SEQ ID NO: 78575 - protein, 121 aa, Zea mays
  misc_feature: Ceres CLONE 1563561
  misc_feature (58)..(58): Xaa is any aa, unknown, or other
  misc_feature (60)..(60): Xaa is any aa, unknown, or other
MVVVDPKAVASAHQFTVVIDGVETTVHEGVLRRNAARWPWSARASRSDPPPPLVVPPXGXGAKSAFPPGPLPGPQRMGAGVFSPGGKPAPRGGPPPPGGVAPFPLSAKMRSPGRPIIPPPP

SEQ ID NO: 78576 - DNA, 842 bp, Zea mays
  misc_feature: Ceres CLONE 1563563
  misc_feature: Encodes the peptide sequence at SEQ ID NO. 78577
ctccccgcggtggcggccgctctagaactagtggatcccccgggctgcaggaattcgtctcacccctagaaaaaaaaacaaggcaacaagggagaagtagatctgcatctgcgagagaaggcagcgggggtggtgatgatggagagccagccgctgcaggccccgacggccacggctccggcccccggatctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccctccaagacaatcccctatgtatggaccgtctttaccgctggttacatcgagcaagtcctcccaggggccattggcagttctcttggtcttctcttttgtggaaaggacattgaaccagcatggggccgcaaggaattcttgaagttcattattttgatcaactccatctgtggcattcttgcattttgctttgctattggactctactacgtcactggaaaggagagcttccttgtcacaccactttctggtttccacggttgccttgctggctttcttgtggccctgaagcaactcttaccaaaccttgagcttcctatgtgctttttctggaaaataaaggcaaagtggatgcccattcttttgttgtatgtttcctcaagtatcatgggcctttcatcgtgcctgattccattaacttcctggccaacttttggtgtccccgggatgtaccgttagctggcttttacctgagatactttccaaagggacccactgactggtat

SEQ ID NO: 78577 - protein, 219 aa, Zea mays
  misc_feature: Ceres CLONE 1563563
  misc_feature (67)..(165): Pfam Name: DUF1751 Pfam Description: Eukaryotic integral membrane protein (DUF1751)
MMESQPLQAPTATAPAPGSAEPAGAPPAVTPGKEFTRTCKGLVVVLIGGYVLLQLLPSSLNYLAIIPSKTIPYVWTVFTAGYIEQVLPGAIGSSLGLLFCGKDIEPAWGRKEFLKFIILINSICGILAFCFAIGLYYVTGKESFLVTPLSGFHGCLAGFLVALKQLLPNLELPMCFFWKIKAKWMPILLLYVSSSIMGLSSCLIPLTSWPTFGVPGMYR

SEQ ID NO: 78578 - DNA, 702 bp, Zea mays
  misc_feature: Ceres CLONE 1563566
  misc_feature: Encodes the peptide sequence at SEQ ID NO. 78579
  misc_feature (510)..(510): n is a, c, t, g, unknown, or other
  misc_feature (554)..(554): n is a, c, t, g, unknown, or other
  misc_feature (638)..(638): n is a, c, t, g, unknown, or other
taccgcggtggcggccgctctagaatagtggatcccccgggctgcaggaattcgtctcacccctagaaaaaagttccaccggacactaccctaaccttttcactgctccagcgaaggcactagccgccgccgtttccatctccccggcgctccatcgctgggcacgcaggcgacggcgacggcgctcaggctcgtgctctcagggacggcgtcagctgcttcctttcccgcctcttgccagtagcctcgcgccctcctttgctcctccgcacggctgacatacatagactgatggcaacactgaaagatgcagcagcaaggaagtctatactggcaacaatccgtcttgttgtcccagccggtgcagcccgtcctgcacctccagttggtccagcacttggtttctatcggctcaatttgatggccttttgcaaggatttcaatgccaggacccaaaaatacaaggcagaaactccaatgcaagtcaccctaactgcctacaaggatagncaccttcgagttcgtggtcaagtcgcccctcggtatcatggggnttcctcagaaggcagcaggaaatcgaaacccgcagcactcgccccagccacgtggaatgtatcggtccctcaccctccgcccangtatacgaagattgcaaagtttgaagcaaggctgaacccctttctgcaaagcacattctcttca

SEQ ID NO: 78579 - protein, 137 aa, Zea mays
  misc_feature: Ceres CLONE 1563566
  misc_feature (16)..(75): Pfam Name: Ribosomal_L11_N Pfam Description: Ribosomal protein L11, N-terminal domain
  misc_feature (73)..(73): Xaa is any aa, unknown, or other
  misc_feature (88)..(88): Xaa is any aa, unknown, or other
  misc_feature (116)..(116): Xaa is any aa, unknown, or other
MATLKDAAARKSILATIRLVVPAGAARPAPPVGPALGFYRLNLMAFCKDFNARTQKYKAETPMQVTLTAYKDXHLRVRGQVAPRYHGXSSEGSRKSKPAALAPATWNVSVPHPPPXYTKIAKFEARLNPFLQSTFSS

SEQ ID NO: 78580 - DNA, 775 bp, Zea mays
  misc_feature: Ceres CLONE 1563572
  misc_feature: Encodes the peptide sequence at SEQ ID NO. 78581
  misc_feature (624)..(624): n is a, c, t, g, unknown, or other
  misc_feature (717)..(717): n is a, c, t, g, unknown, or other
ctggagctccccgcggtggcggccgctctagaactagtggatcccccgggctgcaggaattcgtctcacccctagaaaaaagtgagacggaagtaactgccgcatctcaagtctcaaccctcgcctccaatcgcaacgctcccgaggagagccaggaggaggtgacggcggcgccgcgaggaaggagggatcgatcgaggatggtggacgtctcgcgcgtgcagaaggagctcaccgagtgcaaccgcgaccgggaggtatcgggcgtctccatcgcgctccacgacggcgccaacatctcccacctcaccggcaccatcgccgggcccgccgacagcccctacgagggcggcacgttcgtcatcgatatccgcctgcccggtggatatccctttgagccgccgaagatgcagttcatcaccaaagtatggcaccctaacatcagcagccaaaatggagcaatttgcttggacattctgaaagatcagtggagcccagcccttaccttgaagactgcgctcctttcccttcaagctctgctttcttctcctgcacctgatgatcctcagggatgctgttgttgcacaacagtacctgcgtgactatccaacatttgccgctacngctcgctactggacagaggctttcgcgaagagtgcatcaacgggcatgggaagagagggtgcagaagctggtttgagatgggctttcccaaangacccaggtggagaagtgcccctgaaaagcgggggatggccgaccgagaacatggctc

SEQ ID NO: 78581 - protein, 133 aa, Zea mays
  misc_feature: Ceres CLONE 1563572
  misc_feature (6)..(133): Pfam Name: UQ_con Pfam Description: Ubiquitin-conjugating enzyme
  misc_feature: SWISSPROT Homolog: EC 6.3.2.19 Ubiquitin--protein ligase
MVDVSRVQKELTECNRDREVSGVSIALHDGANISHLTGTIAGPADSPYEGGTFVIDIRLPGGYPFEPPKMQFITKVWHPNISSQNGAICLDILKDQWSPALTLKTALLSLQALLSSPAPDDPQGCCCCTTVPA

SEQ ID NO: 78582 - DNA, 786 bp, Zea mays
  misc_feature: Ceres CLONE 1563573
  misc_feature: Encodes the peptide sequence at SEQ ID NO. 78583
  misc_feature (518)..(518): n is a, c, t, g, unknown, or other
  misc_feature (544)..(544): n is a, c, t, g, unknown, or other
ctggagctcaccgcggtggcggccgctctagaactagtggatcccccgggctgcaggaattcgtctcacccctagaaaaaggacggccgactcgcttctgtgagctaccggccttagatccagccatgagggagattctccacatccagggcggccagtgcggcaaccagatcggttcaaaattctgggaggtcgtctgcgacgagcatggtatcgatcccaccggacgctatgtcggcacctccgacctccagctcgagcgcgtcaatgtctactacaacgaggcctcatgcggccgcttcgtgccgcgcgctgtgctcatggacctcgagcctggcaccatggacagcgtccgcaccgggccgtacggccagatcttccgccccgacaactttgtcttcggacagtctggcgcggggaacaactgggccaagggccactacacagagggcgcagagctcattgactccgtgcttgacgttgtcagaaaggaggctgagaactgcgactgcctccanggctccaagtctgccattcccttggnagagcactggatctggaatgggcacgcttctcatttcaagatcagaagagagtaccctgatcggatgatgccgacattttccggggttccctcggcaaaggtgtcaaaaactgtttggtgaaccatacaatggcaccctgttttgtccatcattgggttgaaaaaccctaataaaagcgctggttctttgaaaacgaagcccttttaagaaaatttgcctttccaaacccggaaacctgaca

SEQ ID NO: 78583 - protein, 179 aa, Zea mays
  misc_feature: Ceres CLONE 1563573
  misc_feature (45)..(171): Pfam Name: Tubulin Pfam Description: Tubulin/FtsZ family, GTPase domain
  misc_feature (131)..(131): Xaa is any aa, unknown, or other
  misc_feature (140)..(140): Xaa is any aa, unknown, or other
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLXGSKSAIPLXEHWIWNGHASHFKIRREYPDRMMPTFSGVPSAKVSKTVW

SEQ ID NO: 78584 - DNA, 759 bp, Zea mays
  misc_feature: Ceres CLONE 1563574
  misc_feature: Translation starting site: 111
  misc_feature: SWISSPROT Homolog: EC 3.4.16.5 Carboxypeptidase C
  misc_feature: SWISSPROT Homolog: EC 2.3.1.92 Sinapoylglucose--malate O-sinapoyltransferase
  misc_feature (686)..(686): n is a, c, t, g, unknown, or other
agctccccgcggtggcggccgctctagaactagtggatcccccgggctgcaggaattcgtctcacccctagaaaaacaatacccccacgaaccctctctctctccccacgatggcaaaaatggcgatggcgtcctcccgcctcccggctctcctctgcctcgccgccgtcgccgtcgccgtcgcggcggaggccgccgccgccgccggagaaggcggcctccgcctgccccgcgacgccacgttcccggcggcgcaggcggagcggctcatccgcgcgctcaacctcctgcctaaggagaaggaggcggggccggccgcgggcggcggcgacgggcccagcgtggcgcccggggagctcctagagcgtcgcgtccggctgcccggcgcgcccgccggcgtcggggacctcggccaccacgccggatacttccgcctgccgcacacgcacgacgccagaatgttctacttcttcttcgaatcgaggggcaagaagaaggaggacgatccccgtcgtgatctggctcaccggagggcccggctgcagcagcgagctggccgtcttctacgagaatgggcccttcaccattgccaacaacatggtcgcttgtctggaacaaattcggttggggacacgatctcaaatatcatattttgttgatcagccaacccggaactggctttagcntacagctctgatgatccgtgatactcgtcatgaaggaagattggtgtcagcaatgacctattatgactttccc

SEQ ID NO: 78585 - DNA, 829 bp, Zea mays
  misc_feature: Ceres CLONE 1563575
  misc_feature: Translation starting site: 176
  misc_feature: SWISSPROT Homolog: EC 2.7.11.1 Non-specific serine/threonine protein kinase
  misc_feature (350)..(350): n is a, c, t, g, unknown, or other
  misc_feature (384)..(384): n is a, c, t, g, unknown, or other
ctccccgcggtggcggccgctctagaactagtggatcccccgggctgcaggaattcgtctcacccctagaaaaaagtttgccgctctgtgagcctgctgccgtcttcttccgccgccgccgccgtcgtcgtcttcgtccgtggatcagagagcggggaggaagaaaaagcgatcgatggcgtccaactacgtggacacgccgggcgaggagggacggttccacggccctcacagccacagcacccgcacgaccccgacgggcggcgcggcggcggcggcggcatctcctcgcaacttccggcgcagcttctcctccgcgtcctccgcgggccacagccactgcggatgcngtcggaagaagaaggcggcagtagtccgccgggncgggctttttctaaaatgggggttcgacgtggcggctcaaccgtcttcttagatcaccatctcggtggagacggttgaagtcttcacaccctctcgacctcttggctgtctcaattttttttttcctgtcaaggataagcaagtgacctctgtgtgcataccacccccaccatacgtagcatacacgggcacagatggcagagcataaagggaacgtcctcttgcacaagtatgagatggggaaattgcttggccaaggcacctttgccaaggtttaccatgctcgtaacacggggactttcggaaagtgcccgatcaaagtgatggaaaaggagaggtttatgaaggttggtcccttggatcaaaccggggagaaatttctgtgatgaagcttggtaggatccaaacatcgtacggttcttgagggcttggcccccaaaccaaa

SEQ ID NO: 78586 - DNA, 853 bp, Zea mays
  misc_feature: Ceres CLONE 1563577
  misc_feature: Translation starting site: 153
ctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaaggcggtgtggttcaaggccggcgcgcagatcttctcggagggcgggctggactacctggggaaccccaacctggtgcacgcacagagcatcctggccatctgggcgtggccaggtggtgctcatgggcttcgtcgagggctaccgcgtcggcggcggcccgctcggggaaggcttcgacaaggtggtaccccggcggcgccttcgacccgctgggcctcgccgacgacccgggacacgccgcccgagctcaaagtggaagagctcaagaccggcccgcttgccatggttctcatgtttcggcttccttcggcaagccatcgtccccgggcaagct

SEQ ID NO: 78587 - DNA, 757 bp, Zea mays
  misc_feature: Ceres CLONE 1563578
  misc_feature (279)..(279): n is a, c, t, g, unknown, or other
  misc_feature (280)..(280): n is a, c, t, g, unknown, or other
  misc_feature (589)..(589): n is a, c, t, g, unknown, or other
  misc_feature (684)..(684): n is a, c, t, g, unknown, or other
ctcaccgcggtggcggccgctctagaactagtggatcccccgggctgcaggaattcgtctcacccctagaaaaagaccaagccaccagtctgcagcacgaaagcttccccccccccctctcttctcctgatggttggctcatatggcctgcacgaataatcctcctgcgaattcccctcacggaaggccaaaaccgaccctttccccaatctacagattctcagacgccgcgcaactccagggcagggccttcaaattttcccggaaccccccatcccnncggatttccctttccccccccggaggaaacccggcccaaagccagagcctttggacacctcccccccccccgttttttttctaacagggggaaattcttttttttaaaaaaacctcgaaaaatttggggggggggggtgttttttagggggttttatcccccccaaaaaaaaggaggagttccccccccgggggcgccaaaaaattgtggggggggaaaaaaaaaaaagggtgggcaacaaaccttttttttttccaaaaaaaaaaaaaacctttttgggggggaaaaaaaacccccccccccaaaaangggttgtgaaaaaaaagggtttttttttggggggaggggcgccccccccccccaaaaaaagggggggaggatttttttcctttaaaaaaagaccnaaaaaaaatttttttttttttccaaaaaaaaatttttttttttaaaaaaaaaaaatataaagggggggaaaaa

SEQ ID NO: 78588 - DNA, 734 bp, Zea mays
  misc_feature: Ceres CLONE 1563580
  misc_feature: Encodes the peptide sequence at SEQ ID NO. 78589
  misc_feature (579)..(579): n is a, c, t, g, unknown, or other
ggagctcaccgcggtggcggccgctctagaatagtggatcccccgggctgcaggaattcgtctcacccctagaaaaaggccgttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaaccctcaggntgtcgcacccgaacaagggaggcgcccgtcatcgactacaagctcgcgttgctccttcagcccatgcttatgctcggcataaccatcggcgtaaagctcagcgtcatcctcccatacggggtaatcactgtcctcaatataatccctcctcggaa

SEQ ID NO: 78589 - protein, 165 aa, Zea mays
  misc_feature: Ceres CLONE 1563580
  misc_feature (139)..(139): Xaa is any aa, unknown, or other
MVMEGRTGSLYGRLNKSSTRGFLAYTAAGAACAAVLACFVLSAADSPASAARNDGARLRLSSRSPRVWPDLAFNWRVVVATVVGFLGSAFGTVGGVGGGGIFVPMLNLVVGFDTKSAAALSKCMIMGASASSVWYNPQXVAPEQGRRPSSTTSSRCSFSPCLCSA

SEQ ID NO: 78590 - DNA, 862 bp, Zea mays
  misc_feature: Ceres CLONE 1563583
  misc_feature: Encodes the peptide sequence at SEQ ID NO. 78591
  misc_feature (751)..(751): n is a, c, t, g, unknown, or other
ctggagctccccgcggtggcggccgctctagaactagtggatcccccgggctgcaggaattcgtctcacccctagaaaaaaagaatttgtactgttcaaggtgtaatgggttgcttttggaaagtttcacacaaatagtcatgtatgggaagtctctgcttcatgaaggttcatgtgagccaaggattcaggaagttgaagcagaagttcaggaaccttcagttcatccttggggaggtctttcgacaacaaaggatggcatcctaactcttcttgattgcttcataaatgcaaaatctcttcatgtgatccagaatgtatttgacaatgcacgtgcgagagaacgtgaacgtgagatgctttaccctgatgcatgtggtggcggtggcagaggatggattagcccagtgatacctaactatggcaggggccatggaacacgagatacctgtgctttgcacactgcacacctttcttgtgatactctggtggatttttggtcggctctgggtgaagaaactagatcatctcttttaaggatgaaagaagaggacttcattgaaagacttatgcacagattcgacagcaagagattctgcagaagactgcagaaggaatgttattcgcgaattcaaggagctcaaggaactaaaacgcatgcgaagggacctcgctgcactagttgggttttgtgttgcagatacaacatttaaagtgtgaagtgttcgaggatgctatttcttgttgattnggcatccatcttatttggagcaagatggaatatacccttcatttccgagtgggctatttggacagatgaagggaaaatcggatatctaaactttggaaaatgtgggcatga

SEQ ID NO: 78591 - protein, 236 aa, Zea mays
  misc_feature: Ceres CLONE 1563583
GAPRGGGRSRTSGSPGLQEFVSPLEKKNLYCSRCNGLLLESFTQIVMYGKSLLHEGSCEPRIQEVEAEVQEPSVHPWGGLSTTKDGILTLLDCFINAKSLHVIQNVFDNARAREREREMLYPDACGGGGRGWISPVIPNYGRGHGTRDTCALHTAHLSCDTLVDFWSALGEETRSSLLRMKEEDFIERLMHRFDSKRFCRRLQKECYSRIQGAQGTKTHAKGPRCTSWVLCCRYNI

SEQ ID NO: 78592 - DNA, 626 bp, Zea mays
  misc_feature: Ceres CLONE 1563584
  misc_feature: Encodes the peptide sequence at SEQ ID NO. 78593
  misc_feature (258)..(258): n is a, c, t, g, unknown, or other
  misc_feature (259)..(259): n is a, c, t, g, unknown, or other
ctaccgcggtggcggccgctctagactagtggatcccccgggctgcaggaattcgtctcacccctagaaaaaaccgtccatcgttccatatgggcttcctgcaggatggcactcctccttggcttgctgctgctagtagtagcttcgcccgcgatcgctgatgacgactccggtatctactaccagctggctcttatgtggccaggagcatactgcgagcagaccagcgctggggtgctgcaagcccgaccaccgggnncgtctcgccggcgcgccgactttctacattaacgggccttttcaccgttccttaaccgccaaccccccgaaccccttgccattgaaccggggatttgcaaccccaaccaaaagttttcccctttaacgaaaacccctttaacccctgggttttttccccggggaatttccccaaaggggccccccggggaaaatcccacggttcccccggggggggaacaaaaaaccctcccccggggggggggggccccccccccggggaaaaaaaaaaaaaaaaggggggggggaaaaaaaaaaaaaccacaccccccttggggggaaaaaaaaaaaaaaaaaccccccccctcccctgggggaagaaaaaaaaa

SEQ ID NO: 78593 - protein, 61 aa, Zea mays
  misc_feature: Ceres CLONE 1563584
  misc_feature (52)..(52): Xaa is any aa, unknown, or other
MALLLGLLLLVVASPAIADDDSGIYYQLALMWPGAYCEQTSAGVLQARPPGXSRRRADFLH

SEQ ID NO: 78594 - DNA, 793 bp, Zea mays
  misc_feature: Ceres CLONE 1563585
  misc_feature: Translation starting site: 190
  misc_feature: SWISSPROT Homolog: EC 4.1.1.35 UDP-glucuronate decarboxylase
  misc_feature (489)..(489): n is a, c, t, g, unknown, or other
  misc_feature (563)..(563): n is a, c, t, g, unknown, or other
  misc_feature (597)..(597): n is a, c, t, g, unknown, or other
agctcaccgcggtggcggccgctctagaactagtggatcccccgggctgcaggaattcgtctcacccctagaaaaaacctcgtccgccccagtctagtccgattcaaacccgcccgttccccgtgtccgagccacgcaagccgagctcaatccccagaggccagagccagctgctcggcgctccacgcgatggcgcagaaggagaccaatggcagcaacggcgagcacatctccacccgcccgccgccgaccccgtcgcccctccgcttctccaagttcttccaggctaacctgcggatcctggtcactggtggggcgggcttcatcggctcgcacctcgtggacaggctcatggagaacgagaagcacgaggtcattgttgctgataactttttcaccggttcaaaagataacctgaagaagtggatcggacacccaagatttgagctcatccgccatgatgtcactgagccacttcttgtggaggtngaccagatctatcaccttgcttgccctgcttcacaatcttctacagcacaatccggttaagacatcaagacaantggttatggtaccctgaacatgctgggactgccnaagagagtgggagctaagattttgttgacatcacatctgaagttttagggggaatcactttgagcatccctcaacccaggcctactgggggcaatgtaccccaattggagccagagattgtttagatgaggggaaacgggtaccaaaaaaccctgaatttcaaatttcacggggacatggggttttaaatcccaat

SEQ ID NO: 78595 - DNA, 821 bp, Zea mays
  misc_feature: Ceres CLONE 1563587
  misc_feature: Encodes the peptide sequence at SEQ ID NO. 78596
ctccccgcggtggcggccgctctagaactagtggatcccccgggctgcaggaattcgtctcacccctagaaaaaagccctcgcgccgccgcctcctccgccacccagcgctcgagctcctcgcgtcctgcgagcgcgctccgcaacgtcaccatgaagttcaacatcgcgaacccttccaccgggtgccaaaagaagctggaaatcgatgacgaccagaagctgcgtgccttttatgaccgaaggatatcccaggaggtcagtggtgatgctctgggtgaggagttcaagggttatgtcttcaagatcatgggtggatgtgataagcaaggcttcccaatgaagcaaggagttttgacttctggtcgtgttcgtcttctgctccatagaggcactccctgcttccgtggttatggcaggcgtaatggtgagcgcaggaggaagtctgtccgtggttgcatcgtgagccaagacctatctgttatcaacttggtgattgtgaagaagggtgagaatgatctgcctggtctgactgacactgagaagccaaggatgaggggtcccaagagggcctccaagatcagaaagctgttcaaccttaacaaggatgatgatgtacgcaagtacgttgacacataccgcaggacattcactaccaagaacggcaagtaggtcagcaaggcaccttagatccaacggcttgtgacacccttgacctccagaaggagcgtgctaaaatcgctgacaggaggagaagataacctaaaagaatctggaggctgctgaataccaaaaccttcttgccaaaaaggtgaaggaaaa

SEQ ID NO: 78596 - protein, 172 aa, Zea mays
  misc_feature: Ceres CLONE 1563587
  misc_feature (1)..(129): Pfam Name: Ribosomal_S6e Pfam Description: Ribosomal protein S6e
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLNKDDDVRKYVDTYRRTFTTKNGK

SEQ ID NO: 78597 - DNA, 765 bp, Zea mays
  misc_feature: Ceres CLONE 1563588
  misc_feature: Encodes the peptide sequence at SEQ ID NO. 78598
ctggagctccccgcggtggcggccgctctagaactagtggatcccccgggctgcaggaattcgtctcacccctagaaaaatccatccccttcccttcccttccttcgtgccccgccggctctccagcgcgccgtctctgcccagatccaggagatatgcctcgctatgatgatcgctatggaggcacgcgcttgtatgttggcagattggccccccgtactcgttctcgtgatttagaatatctcttcggcaaatatggaagaatacgagaagtggagttgaagcgcgactatgcatttattgagttcagtgaacatcgtgatgccgatgaagctcggtaccaactagatggcagggatgtcgatggaagtcgcattgttgttgagtttgctaaaggggtcccacgtggtccaggtggctcacgtgaatatatgggaagaggccctccaccaggcacaggtcgttgtttcaactgtggaatggatggtcactgggcaagagactgtaaggctggtgactggaaaaataaatgctaccgttgtggagaaagagggcatatagaaagaaattgccagaacagtcctaggagcgtcaggcgtgaaagaagttactcacgctccccatctccacgccgtgggaagaggtcgcagtccaagctatagcaggaagcaggagtcgtagcctgagcccgagctatagcccaatcgaggtcccctatctggatctccctaggggggagccgcccgtgaccgtgaatgataggaa

SEQ ID NO: 78598 - protein, 168 aa, Zea mays
  misc_feature: Ceres CLONE 1563588
  misc_feature (13)..(76): Pfam Name: RRM_1 Pfam Description: RNA recognition motif. (a.k.a. RRM, RBD, or RNP domain)
  misc_feature (102)..(119): Pfam Name: zf-CCHC Pfam Description: Zinc knuckle
  misc_feature (124)..(141): Pfam Name: zf-CCHC Pfam Description: Zinc knuckle
  misc_feature: SWISSPROT Homolog: EC 5.2.1.8 Peptidylprolyl isomerase
MPRYDDRYGGTRLYVGRLAPRTRSRDLEYLFGKYGRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVRRERSYSRSPSPRRGKRSQSKL

SEQ ID NO: 78599 - DNA, 791 bp, Zea mays
  misc_feature: Ceres CLONE 1563590
  misc_feature: Encodes the peptide sequence at SEQ ID NO. 78600
  misc_feature (672)..(672): n is a, c, t, g, unknown, or other
ctcaccgcggtggcggccgctctagaactagtggatcccccgggctgcaggaattcgtctcacccctagaaaaagatattcccggccgggtcgtcgagtgtcgagtccccagtccccagtccttatataaatcacgccatgtcccgagcaatcgccactccaactctcaagcgtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtcgcggctctcgagacggagctgcagcggatgggcgaagagaaccggcgcctggcggaagcgctggccgaggtggcctccaagtacgaagcgctgcgggggcagtacacggagatggtggccgcggcgggcacggcctgcgggaaacacccgtcgtccacgtcggaagggcgggtcccttgtcgccgtccgcggaagcgcaagagcgagagcacggaaaancggggccgcccgggaagaagctactgcaccagcacttacccggggggtgggccccgaaaccaaaacggagtgcaccttcgggggcgaagcgtggcagccgcatccgggggaggcgggat

SEQ ID NO: 78600 - protein, 168 aa, Zea mays
  misc_feature: Ceres CLONE 1563590
  misc_feature (129)..(129): Xaa is any aa, unknown, or other
MDPWISSQPSLSLDLRVGLPPLSLHHQAPVAVALPRPKLLVEENFLLPPPKKEPEVAALETELQRMGEENRRLAEALAEVASKYEALRGQYTEMVAAAGTACGKHPSSTSEGRVPCRRPRKRKSESTEXRGRPGRSYCTSTYPGGGPRNQNGVHLRGRSVAAASGGGG

SEQ ID NO: 78601 - DNA, 836 bp, Zea mays
  misc_feature: Ceres CLONE 1563593
  misc_feature: Translation starting site: 128
  misc_feature: SWISSPROT Homolog: EC 3.2.1.4 Cellulase
  misc_feature (402)..(402): n is a, c, t, g, unknown, or other
  misc_feature (748)..(748): n is a, c, t, g, unknown, or other
  misc_feature (798)..(798): n is a, c, t, g, unknown, or other
ctggagctccccgcggtggcggccgctctagaactagtggatcccccgggctgcaggaattcgtctcacccctagaaaaaagaggccggtcaccgagtgccactcctgctcagatctagcgtcggaaatggctgccgccctggccgcagcttccatagtgttcaagaacagcaagacctactccgacaagctcgtcaagggcgccaaggccctgtacaagttcggcaggctgcagcgtgggcgatacagccccaacggatctgaccaggccatcttctacaactccaccagctactgggacgagttcgtgtggggcggtgcgtggatgtacttcgccacggggaacaactcgtacctcaccgtcgccacagccccgggaatggcgaagcacgctggagcatnactggtttggaagtccaaactacggagtgtttacctgggatgacaaacttccaggagctcaggttcttctcagcaggttgcgactcttcctaagtccagggtacccttacgaagaaatactgaggacattccacaaccaaaccgacaacgtcatgtgctcgtatttacctgtattcaattcattcaacttcaccaaagggaggattaatacagctcaaccatggaaaggcctcaaccgcttcagtacgctgtcaacgcagcttttccttgcttctttatacagcgactatcttgaagcggctgacaccccctggggtgggactgttggacccgaactctacccccntagaagtccctcccgcaagtttgcccaggtcacaagcttgactacatccnttggaaagaacccattgaaaatgaacctaacctttgtg

SEQ ID NO: 78602 - DNA, 854 bp, Zea mays
  misc_feature: Ceres CLONE 1563595
  misc_feature: Encodes the peptide sequence at SEQ ID NO. 78603
  misc_feature (567)..(567): n is a, c, t, g, unknown, or other
  misc_feature (583)..(583): n is a, c, t, g, unknown, or other
agctccccgcggtggcggccgctctagaactagtggatcccccgggctgcaggaattcgtctcacccctagaaaaaaatccaacgaactgaccacaaccacctaagctaaaagctaaccaccagacccccggccatggcgctcgcgcccacttccgctgccgtgctcaagaccccgttcctcggggccaggcgcgcgctcgccaatgccgccgccaagcccgcgcctcgccgcgcgctggtcgtcgccgccgcggccgccgccaagaagtcgtggatcccggccatcaagagcgacgccgagatcgtgaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggntgggtggaagtcaaanccgttgggtggacttcttcaacccggaactccagggccgtggagtgggccacgccatggtcccgcaccgccgagaacttcgctaacttcaccggcgagcagggctaccccgggcggcaaggtcttcgacccgctcggcctcgccgggaccgtcaaaggacgcgtctaactccccgacgtcgacaagctcgagcggctcaaggctgcccgaaatcaagcacgcccgcatcgccatgctttgcatgcctcgccttctacttcgaagctgggca

SEQ ID NO: 78603 - protein, 177 aa, Zea mays
  misc_feature: Ceres CLONE 1563595
  misc_feature (58)..(176): Pfam Name: Chloroa_b-bind Pfam Description: Chlorophyll A-B binding protein
  misc_feature (145)..(145): Xaa is any aa, unknown, or other
  misc_feature (150)..(150): Xaa is any aa, unknown, or other
MALAPTSAAVLKTPFLGARRALANAAAKPAPRRALVVAAAAAAKKSWIPAIKSDAEIVNPPWLDGSLPGDFGFDPLGLGKDPAFLKWYREAELIHGRWAMAAVLGIFVGQAWSGIPWFEAGADPSAIAPFSFGSLLGTQLLLMGXGGSQXRWVDFFNPELQGRGVGHAMVPHRRELR

SEQ ID NO: 78604 - DNA, 789 bp, Zea mays
  misc_feature: Ceres CLONE 1563598
  misc_feature: Encodes the peptide sequence at SEQ ID NO. 78605
tggagctccccgcggtggcggccgctctagaactagtggatcccccgggctgcaggaattcgtctcacccctagaaaaaaccccactgctcggtgttcactccggtcgggccatggcgcgcgccggcgtctctaccgcgccgctctcccgcactcacctcctcccaccacgtccttccctcctccacaacacgcagcaccactccctcctcctccggccccagcgcaaggcgcccgccaccaccgcggcggcgctgccgccggccgcggacctcccggcgctgtccctcccggccgcggccgccgcggctgccgcgctggcggcggcggtgtcactttccgaccccgagcggcggcggcgctcgcaggccgaggcggccggcggaggtgacaaggaggccgtccgcgcctacttcaactccacggggttcgagcggtggcgcaagatctacgggtcggcgacggagggcgtgaaccgcgtgcagcttgacatccgcgagggccacgcgcagacggtggcggcggcgctggccatgctccgcgactccccgctggagctgtcgggcgccaccgtgtgcgacgccggctgcgggacggggtcgctggccatcccgctcgcggcggcgggcgccgacgtcctggcctccgacatctcggcggccatggtgtcggaagcgcaacggcaggcggcggcgcagtcgtccgtcgtcgtcgttcccggatgccccgggtcgaggtccgcgacctggagagcctggaggggcgggtacaacctggggtgtgggggctg

SEQ ID NO: 78605 - protein, 225 aa, Zea mays
  misc_feature: Ceres CLONE 1563598
  misc_feature: SWISSPROT Homolog: EC 2.1.1.11 Magnesium protoporphyrin IX methyltransferase
MARAGVSTAPLSRTHLLPPRPSLLHNTQHHSLLLRPQRKAPATTAAALPPAADLPALSLPAAAAAAAALAAAVSLSDPERRRRSQAEAAGGGDKEAVRAYFNSTGFERWRKIYGSATEGVNRVQLDIREGHAQTVAAALAMLRDSPLELSGATVCDAGCGTGSLAIPLAAAGADVLASDISAAMVSEAQRQAAAQSSVVVVPGCPGSRSATWRAWRGGYNLGCGG

SEQ ID NO: 78606 - DNA, 815 bp, Zea mays
  misc_feature: Ceres CLONE 1563599
  misc_feature: Encodes the peptide sequence at SEQ ID NO. 78607
  misc_feature (365)..(365): n is a, c, t, g, unknown, or other
  misc_feature (403)..(403): n is a, c, t, g, unknown, or other
tccccgcggtggcggccgctctagaactagtggatcccccgggctgcaggaattcgtctcacccctagaaaaagacaagggaaaaaaaaccaggtctgtgtgtgtgtgagagagagagagaggcgaaggcaactcaggcgacgctgatggcgatggcggcgctgcgacgcgaggggaggcgcctcatcctctcctccaccgtccccaacccgtctctggcggccgcttcctctgcggtgacgcgatcctccgccgtctcgcaaccggagatggctccacttggtgcacggtctatttcaaactcaatcgtgaggaaccggatgaagaatgtcaggaatatccagaagatcacaaaggctatgaangatggttgcagcatcaaagctcccggggcagtcagacnaggactgaaaaattcacgtggcttgtgggcaaccggtcaccggcccttcttggggaatgctcctaggtgttgacctcaagaaaaaaggtggattgggcccattacctccgaaaagggaaccccgtggggggggtttaatttcaacactcctgggaaagtttaccaggggccccttccaaaatttggacatctcggggcccaaaaaaaaaaaaacccccgggtttttgtttttttgtggggaaaaaagggggaaaagtttccccccgtgtgggggtggagcccccaagaggaaacccctcttttaaaaaaggcccgcccacctgtaaaacccccgaaaaaaaaaacccctttttaaataattacaccacggggtggggtcccccggcgccccccccgaaaataataatttttt

SEQ ID NO: 78607 - protein, 109 aa, Zea mays
  misc_feature: Ceres CLONE 1563599
  misc_feature (73)..(73): Xaa is any aa, unknown, or other
  misc_feature (86)..(86): Xaa is any aa, unknown, or other
MAMAALRREGRRLILSSTVPNPSLAAASSAVTRSSAVSQPEMAPLGARSISNSIVRNRMKNVRNIQKITKAMXDGCSIKAPGAVRXGLKNSRGLWATGHRPFLGNAPRC

SEQ ID NO: 78608 - DNA, 932 bp, Zea mays
  misc_feature: Ceres CLONE 1563600
  misc_feature: Encodes the peptide sequence at SEQ ID NO. 78609
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (922)..(922): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnngggaaagctggagctcaccgcgtggcggccgctctagaatagtggatcccccgggctgcaggaattcgtctcacccctagaaaaagttccctctttgctctgcgcgccacaccacacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccagccggagtagctacaggcagcggcggcggcggcggtagctgtccatccgcgccacgggcggcggggccgccgccgcccgtggtctatcgcgacgccggcgcccgactacgtggccctcgctgaagatcaagctccctgaacccccgtgtcccggcctgaaacctgggcccggccagcgaagcccaaggagggacctgggacccgcggcgggacgccggcggccccggggaaactctggaagcccggcccggcccggggtttgcccccccggccgaaccctcccaggcaaggggacccctccgaatttagcctggccaaggggcccccggggtgggccgggcctgccctggtccaagaccaaacccgccgtttcctccctttccgccggaaaaccctttccgggcggggccagccccgccccttggggcccccggccccaaccgggggccgggccctcccttcccccaattcacgccctttggggcccaggtgttttcccagacccggaaatcccaaacgttggtgggaagccgccgtacttcccgaacaacaatcgtggactggagcntccccccccc

SEQ ID NO: 78609 - protein, 46 aa, Zea mays
  misc_feature: Ceres CLONE 1563600
MAATWSSSCCAATASSSALLRHARVKSAPWVAGASRSSYRQRRRRR

SEQ ID NO: 78610 - DNA, 859 bp, Zea mays
  misc_feature: Ceres CLONE 1563601
  misc_feature: Encodes the peptide sequence at SEQ ID NO. 78611
  misc_feature (546)..(546): n is a, c, t, g, unknown, or other
  misc_feature (633)..(633): n is a, c, t, g, unknown, or other
ctccccgcggtggcggccgctctagaactagtggatcccccgggctgcaggaattcgtctcacccctagaaaaagtgaaccacgggtgttgttcacatttggtaccagagccaatactggatcctccacacgggtactggacgagatcgcaatcgaagttgggcggcatggcgccagcgaagacggacgatcctttgtcccagcttctggcgaagatcgaggagggaaacaaggagactcaccgacgcatggaggcgattcagggggcggtgggaaatatggaggcggcggtcaaggtggtgatgacggagcagggagatcttcagaagtggaaaccggaggtggaagcgaaagtgacggagatttctgatgctctaaaggcgatccagatccagatgggaaagatggagaagaagccgctcggtttcgggtcgagacaggaagaagaaggagaagacggatttctgaagccgccaccatctgattcttcgaatttggagtttcgtcgtgaagaagggcggacccaattctcgcatggagtattgngcatgaactggatccagcaatacagtccgatgaaggtggattgggcgaacaagtgggcagtcattccatataatgggatcgcagcantacttgcaaggtgtgccaggtgacattaccagccggcgctgtcaccgaacttttgctcttgtcagtggaatcacaggctacacccgctggacaatcggtcgatccaaaagtccagcagttctggaataatttcgtggagggaatttgaggatcccagtcggcttacccccaagcagaacatgcgaccacaccttattccattggttccagggaaaaaatgtgggtt

SEQ ID NO: 78611 - protein, 162 aa, Zea mays
  misc_feature: Ceres CLONE 1563601
  misc_feature (127)..(127): Xaa is any aa, unknown, or other
  misc_feature (156)..(156): Xaa is any aa, unknown, or other
MAPAKTDDPLSQLLAKIEEGNKETHRRMEAIQGAVGNMEAAVKVVMTEQGDLQKWKPEVEAKVTEISDALKAIQIQMGKMEKKPLGFGSRQEEEGEDGFLKPPPSDSSNLEFRREEGRTQFSHGVLXMNWIQQYSPMKVDWANKWAVIPYNGIAAXLARCAR

SEQ ID NO: 78612 - DNA, 610 bp, Zea mays
  misc_feature: Ceres CLONE 1563604
  misc_feature (174)..(174): n is a, c, t, g, unknown, or other
  misc_feature (187)..(187): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (557)..(557): n is a, c, t, g, unknown, or other
ggagctccccgcggtggcggccgctctagaactagtggatcccccgggctgcagattcgtctccccctagaaaaattggggcgagagcacactcttgatatcaagaatgggaaagcgatgctgagtatgagtatgtgaaacgtaatggtgtgtccattttcctcatgccatctngaaacaatttggncacaccttcccaggcaccccgggggaggtctccccctcgttcccaaaatnnncccgcagggggaaacccaaactgctttcctgaaacattgggcccccttggaaacccaaaccgggcccaaaaaaaccccaaaaccccccgggaattttgttttaaaaaaaccccggggggggggttttaaaccccaaaaggggttttgggtttttttcccccccacggggtcccgaaaaaaccaaaaaaaaaatggggggggcggcccctaaaaaaaaaaaggagaaaaaaattttttcccccccccccgggaggggggggggtgttttaaaaaaaaaaaaaaaacccccccccccggggggccccctttctctttccngggggggggggggattaaaaaaaaaaacccccccccctttttttttataaaac

SEQ ID NO: 78613 - DNA, 805 bp, Zea mays
  misc_feature: Ceres CLONE 1563605
  misc_feature: Encodes the peptide sequence at SEQ ID NO. 78614
ctggagctccccgcggtggcggccgctctagaatagtggatcccccgggctgcaggaattcgtctcacccctagaaaaaagcgtccccatggcggcgggaagagaaaccgacgaacagctgaccgagtacgagaagcagcggctgtcgcggatacgcgagaacgaggcccgactcgaggccctgggcctccgcagcctcgcagcgtcccctcttctccgcagctcgtcgccggggacggccaaggggaagcagaagaggtccgtcgacgaggacgaggagtacgtcccgtccgatagcggcggtgaggagaaggacgagagctcgtcggagagcgcgcaagacgaagaggtggatgggagaggggaaatcagcttctatgtcacgcgccaagggaaagaaaaagaaattgtcaaaaactggtaaatctacaaagaacacgcctactaagggtagtgctaattttgctgaggtggtggatgatgatacagccttacagcaggctattgctctctccctggcggaatattcagaaaagcctgtgacttcattgggtgcagaaacatcaagcacagtaacaagagcgagtgaaagtactccccagaagaacagcaaagcatccattcaggactcagctaagaacaagaagattaaaaagctgggtaagagcaggattcagctgacagaaagatgatgtgggttcaatttcttcttctccatttgacgaaagtggtaaaaggatatattaccccccatgggattcttgaaaagatggggctacaataaaatgattttcatcctggacaa

SEQ ID NO: 78614 - protein, 111 aa, Zea mays; identical to SEQ ID NO: 77794
  misc_feature: Ceres CLONE 1563605

SEQ ID NO: 78615 - DNA, 772 bp, Zea mays
  misc_feature: Ceres CLONE 1563608
  misc_feature: Encodes the peptide sequence at SEQ ID NO. 78616
  misc_feature (501)..(501): n is a, c, t, g, unknown, or other
  misc_feature (540)..(540): n is a, c, t, g, unknown, or other
  misc_feature (541)..(541): n is a, c, t, g, unknown, or other
ctctccgcggtggcggccgctctagaactagtggatcccccgggctgcaggaattcgtctcacccctagaaaaagtactcggcacgcaggcagaggcagcacagcagcagccagctccatccatcctctttcccctcctcgcttcgcttcctcggcggattcctcctccctcggccgtccccgtcccctttttcggcgcgcgagctcgcccgagatggcaaacgcgagatcgggtgtcgctgtgaatgacgagtgcatgctcaagttcggcgagctgcagtcgaagaggctgcaccgcttcctaactttcaagatggacgacaagttcaaggagatcgttgtggaccaggtcggggatcgcgctaccagctacgaggacttcacaaacagcctccccgagaatgactgccgatacgcgatctatgatttcgactttgtcactgcagaagatgtccagaagagcaggatcttctatatcctatggtccccatcctccgccanggtgaagagcaagatgctttatgcaagctcaaaccaaannattcagagtgggctcaatggcattcaggtggaactgcaggctactgatgcaagtggaatcagccttgatgagatcaaggatcgggctcgctaggcatcatgatcatgcatcatggactcggcctactactgttggatttgtatgccattattaaacctggtgctgtggaaaactgcttgatgattttgcgggtttggttgctgggaaaaaaaaggttcccatggctcccga

SEQ ID NO: 78616 - protein, 139 aa, Zea mays
  misc_feature: Ceres CLONE 1563608
  misc_feature (12)..(139): Pfam Name: Cofilin_ADF Pfam Description: Cofilin/tropomyosin-type actin-binding protein
  misc_feature (96)..(96): Xaa is any aa, unknown, or other
  misc_feature (109)..(109): Xaa is any aa, unknown, or other
MANARSGVAVNDECMLKFGELQSKRLHRFLTFKMDDKFKEIVVDQVGDRATSYEDFTNSLPENDCRYAIYDFDFVTAEDVQKSRIFYILWSPSSAXVKSKMLYASSNQXIQSGLNGIQVELQATDASGISLDEIKDRAR

SEQ ID NO: 78617 - DNA, 861 bp, Zea mays
  misc_feature: Ceres CLONE 1563609
  misc_feature: Encodes the peptide sequence at SEQ ID NO. 78618
  misc_feature (739)..(739): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (829)..(829): n is a, c, t, g, unknown, or other
tggagctccccgcggtggcggccgctctagaactagtggatcccccgggctgcaggaattcgtctcacccctagaaaaaacgagccacagcccacaggtaagcgtcgtcggttcacgccgcgttcccatactctgcactacacttcattacagttacagtcacggcgcgtccgccgccttgcatataccggttctcaccgcctgtccgcgctgcccgtcgccagcaggctagctctctagccagtccagtccacgcagcgcagggatggcgtcgttcgccgtggcaacggccccgtcgctagcggccccggcagccaagaggaggcccgccgccggcgtcacgtacgtggagggcatgaaagcctacagcggcctcaaggggctcaacaaggtgaccatgctcggggtgcgcaagaccgccgactactccttcgccaaggtcgtggcatcgctcagcctcgcgggcaggaagcggcgcggaggagcgttcggcgcccagatgaggttttacgcttacacagtggtgacggttgcaccacgtgagcgagcgcagcgaagccaacacaactgccggcggacaagtgtccccatagacgagatccatggcggagcgccggaagagcgtctccctccgtgctgtttgcttcggcgcgcgccgggaggggataatggcagcagtgagctcggtctctattctgcccctcgcgtcgctgagggctctcccgttgagctgctgctngaattgtggagnnnnnnnnnnnnnnnaaaaaaaaggttttaaatccccctgccccctccaaaggttatgggctgtggcgcggaacccccngctgctgctgtggccgggccaaacagattggc

SEQ ID NO: 78618 - protein, 171 aa, Zea mays
  misc_feature: Ceres CLONE 1563609
  misc_feature (162)..(162): Xaa is any aa, unknown, or other
  misc_feature (163)..(163): Xaa is any aa, unknown, or other
  misc_feature (164)..(164): Xaa is any aa, unknown, or other
  misc_feature (165)..(165): Xaa is any aa, unknown, or other
  misc_feature (166)..(166): Xaa is any aa, unknown, or other
  misc_feature (167)..(167): Xaa is any aa, unknown, or other
MASFAVATAPSLAAPAAKRRPAAGVTYVEGMKAYSGLKGLNKVTMLGVRKTADYSFAKVVASLSLAGRKRRGGAFGAQMRFYAYTVVTVAPRERAQRSQHNCRRTSVPIDEIHGGAPEERLPPCCLLRRAPGGDNGSSELGLYSAPRVAEGSPVELLLELWXXXXXXKKRF

SEQ ID NO: 78619 - DNA, 781 bp, Zea mays
  misc_feature: Ceres CLONE 1563611
  misc_feature: Encodes the peptide sequence at SEQ ID NO. 78620
  misc_feature (636)..(636): n is a, c, t, g, unknown, or other
  misc_feature (644)..(644): n is a, c, t, g, unknown, or other
ctccccgcggtggcggccgctctagaactagtggatcccccgggctgcaggaattcgtctcacccctagaaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtagaggaacggnctctgggnctggttctctcctcctggagcgccctgtctgtgactatggcaagaatccaagctcggtttcaccgtgtaccatccccccaggtgtccacatccgtgggtgagccatacacaagtgtcctggtcacccactctctcct

SEQ ID NO: 78620 - protein, 181 aa, Zea mays
  misc_feature: Ceres CLONE 1563611
  misc_feature (49)..(181): Pfam Name: Tubulin Pfam Description: Tubulin/FtsZ family, GTPase domain
  misc_feature (146)..(146): Xaa is any aa, unknown, or other
  misc_feature (149)..(149): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGRGTXSGXGSLLLERPVCDYGKNPSSVSPCTIPPGVHIRG

SEQ ID NO: 78621 - DNA, 824 bp, Zea mays
  misc_feature: Ceres CLONE 1563616
  misc_feature: Translation starting site: 229
  misc_feature: Pfam Name: V-SNARE Pfam Description: Vesicle transport v-SNARE protein
  misc_feature (587)..(587): n is a, c, t, g, unknown, or other
  misc_feature (612)..(612): n is a, c, t, g, unknown, or other
  misc_feature (673)..(673): n is a, c, t, g, unknown, or other
  misc_feature (691)..(691): n is a, c, t, g, unknown, or other
  misc_feature (698)..(698): n is a, c, t, g, unknown, or other
  misc_feature (785)..(785): n is a, c, t, g, unknown, or other
ctggagctccccgcggtggcggccgctctagaactagtggatcccccgggctgcaggaattcgtctcacccctagaaaaaacaaagacgtagctaccccctcccgcgtccgtcgaattcgcctccgccgcctgctcgatccggtgggaattcgccgctgccgggttgttttcgctggggtgattaaggctcgggattcgagatctacgcgagtcgcgggcaagcagccatgagcgaggtgttcgagggctacgagcggcagtactgcgaggcctccgcctcgctctcccgcaagtgcaccgctgcctccgccctcgatggggagaagaagaagcagaagctgtccgagatccaatccggcgttgaggaagctgaatcgctgattcgtaagatggacctggaggcaaggaacctacagcctagcattaaggctggtttgcttgcaaagctgagggagtataaatctgacctcaacaacgtcaagagtgagcttaagaggatctcagcgcccaatgctaggcaggctacccgggaggagctcctggagtctggaatggctgatactctcgcggtgtctactgatcagangggggagattgatgatgacaactgnaagactgaatcagtcaactgacagaattaaagagagccgaagaactatgttggagacgaangaagcttggtgtgtcaanttctcangatcttcaccaacagcgacagtcactactacatggctcatactattttgccacggaagtggatgacaacattggcaagaagcagaangatccctggctgcattgtcaaaagagatggataggaacc

SEQ ID NO: 78622 - DNA, 980 bp, Zea mays
  misc_feature: Ceres CLONE 1563617
  misc_feature: Encodes the peptide sequence at SEQ ID NO. 78623
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (70)..(70): n is a, c, t, g, unknown, or other
  misc_feature (980)..(980): n is a, c, t, g, unknown, or other
acacgacacacgagagagacaagaatcgatcttttttcttcaaaaggggggggnnnnnncgtattgtggnggggggggaggtccccgcggtggggggcgctctcaaatagtggatcccccgggctgcaggaagtcgtctcacccctagaaaaataagattcgttccttctgccaagcacaacacagaccatagtctgcccgcccaactgcacccgccgccgtcgcctcccagaagccaaccaaaccctagattcgccgccctcagctccggtcagaccctcccccttcgaagatgccgaacctcgagtgccggatgtatgagcagcggttcccggaggtggatgccgcggtgatgatccaggtgaagcacatcgctgacatgggcgcgtacgtctccctgctcgagtacaacaacatcgagggcatgatcctcttctccgagctctcccgccgtcgtatccgctccatctcctcccccaccaaagttggtcgccaggagcccgccatcgtgctccgggtcgaccgcgacaagggctacatcgacctttcaaaagcgccgcgtctccgaggaggatgcgcacgcatgcgaggacaggtacaacaggtccaagctcgtgcactccttccatgcgccacgtcaccgaaaacgctccaagtccacctcgagccgctctaccagcggattgggctggcccccctctaccgcaagtacgggcacccccttcgaggcctttcaagctcattcgttgccggaacccctgacgcttttccctccaacgtactcccccctgtaagggaaacaggaaggtccggccccacaatgggccgcggagggtgggctaaaggtgggggccctgactttccccccccttgaagggttagaggaattcacccggggggaagaaaccttagagggagggagggatggaacccccgctaaccccaccccaaaaaaataccgggggcgcgtaaatttaaan

SEQ ID NO: 78623 - protein, 193 aa, Zea mays
  misc_feature: Ceres CLONE 1563617
  misc_feature (13)..(88): Pfam Name: S1 Pfam Description: S1 RNA binding domain
MPNLECRMYEQRFPEVDAAVMIQVKHIADMGAYVSLLEYNNIEGMILFSELSRRRIRSISSPTKVGRQEPAIVLRVDRDKGYIDLSKAPRLRGGCARMRGQVQQVQARALLPCATSPKTLQVHLEPLYQRIGLAPLYRKYGHPLRGLSSSFVAGTPDAFPSNVLPPVRETGRSGPTMGRGGWAKGGGPDFPPP

SEQ ID NO: 78624 - DNA, 788 bp, Zea mays
  misc_feature: Ceres CLONE 1563618
  misc_feature: Encodes the peptide sequence at SEQ ID NO. 78625
  misc_feature (744)..(744): n is a, c, t, g, unknown, or other
  misc_feature (770)..(770): n is a, c, t, g, unknown, or other
ctggagctcaccgcggtggcggccgctctagaacagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccggctccgcgaagtcgtcgaccccgctgtaccctgggcgcagcttcgaccccctcggcctggccgaacgaccccgaagccttcngccgacctcaaaggtgaagagctcangaaccgccgcctccgcct

SEQ ID NO: 78625 - protein, 209 aa, Zea mays
  misc_feature: Ceres CLONE 1563618
  misc_feature (61)..(210): Pfam Name: Chloroa_b-bind Pfam Description: Chlorophyll A-B binding protein
  misc_feature (205)..(205): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPAPRSRRPRCTLGAASTPSAWPNDPEAFXRPQR

SEQ ID NO: 78626 - DNA, 810 bp, Zea mays
  misc_feature: Ceres CLONE 1563620
  misc_feature: Encodes the peptide sequence at SEQ ID NO. 78627
  misc_feature (706)..(706): n is a, c, t, g, unknown, or other
ggagctccccgcggtggcggccgctctagaactagtggatcccccgggctgcaggaattcgtctcacccctagaaaaaacgagtatccaagtccaaccagcaagaggggaggcgctgcacgcaggtcacgcggcgatggacatatgcgatgtttgagcaggcggtggcagatttctgctggcatgcgagggaagtagtgtcgtcagggatggggctctggggttggccgtgggggcgacgtgggccgtcgggcttcggctccgcgtccaccgccgaggaggtcaccgccggcgtcgacgcaagcaacatcactgccatcgtcacaggagcgacgaatggcattggaaaggagacagccagagttctagcactgaggggagccaaggtaatcataccagctaggacactggagagtggcctcaagttgaaggagagcctcgcagatgaggtcccaagctccaaggtacacgttatggagatggacctgagctgtctcagctccgtccgcgacttcgcacggtccttcaattcatcccacaagcatctgaacctcctcataaacaatgcagggatcatggcctgcccttaccagctgtccaaggatggaattgagctgcaattcgcaacgaatcatgttgggcatttcttgctgaacagtctcctgctagacaagatgatatcaactgctgcagagacaagtgtgcangggaaggatcataaaacgtatcatcggtcgcgcataaaagaaatgattggtacattgctttgagctgaaacaagctaaacgaataagctaagggtccaacccgt

SEQ ID NO: 78627 - protein, 206 aa, Zea mays
  misc_feature: Ceres CLONE 1563620
  misc_feature (54)..(200): Pfam Name: adh_short Pfam Description: short chain dehydrogenase
  misc_feature: SWISSPROT Homolog: EC 1.3.1.33 Protochlorophyllide reductase
  misc_feature (186)..(186): Xaa is any aa, unknown, or other
MFEQAVADFCWHAREVVSSGMGLWGWPWGRRGPSGFGSASTAEEVTAGVDASNITAIVTGATNGIGKETARVLALRGAKVIIPARTLESGLKLKESLADEVPSSKVHVMEMDLSCLSSVRDFARSFNSSHKHLNLLINNAGIMACPYQLSKDGIELQFATNHVGHFLLNSLLLDKMISTAAETSVXGKDHKTYHRSRIKEMIGTLL

SEQ ID NO: 78628 - DNA, 906 bp, Zea mays
  misc_feature: Ceres CLONE 1563623
  misc_feature: Encodes the peptide sequence at SEQ ID NO. 78629
tccccgcggtggcggccgctctagaactagtggatcccccgggctgcaggaattcgtctcacccctagaaaaaccccctccgcctcctgatctctctcgcctctggttggcagagctctcttgaagcctcgagactagtctcgccgctgctccctcagctatggcgctgcgtgcctccgttagttgttgtattgcagcgcagccccgcgagccttgagctgctagctcgcccttcaccacagtcctcagacttggagttcgaagaccgctgccacaaggtccaagagcccaagttcgactgcctgctcttcgacctccacgacagcctgtatccgctgagctccaggatcacacgccatgtcaagaagaagattgaagattagatggttgagaacccccccattgacgagaccaagaccgagaaccggggcaacctgctgtacaagaactacttgcccccgatggctggcactcaagagccctccgctacaccttcgaacaacgataactacccctccctgctgccatggagacgctgccataccacaacatcaaggcctgaaccccattctcaagaacattctaaataaccatacagatcactcgaacttcatatttccccaacggtaaacatgggtccacatccgcggaaaaaccaataacaagccggggccctggaagaaccgcttccggaggggataaatcaggcattttagtgacctggtaaactgccccgtgccccgctgcaagtggggagcacccgggaagcccccagaggcctttgcacaagtagcccaggctctatttcaaaccgaccttggggacaccccacaaaaataagatccacccaaggaaccacctaactccgaagaaccacacgccctaccaggggaaacgccacgtgcg

SEQ ID NO: 78629 - protein, 68 aa, Zea mays
  misc_feature: Ceres CLONE 1563623
MVENPPIDETKTENRGNLLYKNYLPPMAGTQEPSATPSNNDNYPSLLPWRRCHTTTSRPEPHSQEHSK

SEQ ID NO: 78630 - DNA, 1092 bp, Zea mays
  misc_feature: Ceres CLONE 1563624
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (57)..(57): n is a, c, t, g, unknown, or other
  misc_feature (72)..(72): n is a, c, t, g, unknown, or other
  misc_feature (126)..(126): n is a, c, t, g, unknown, or other
  misc_feature (786)..(786): n is a, c, t, g, unknown, or other
  misc_feature (929)..(929): n is a, c, t, g, unknown, or other
nnnnnnnnnnnnnnnnnnnncaaaaaataaaactcaactnnnnnngggaggggcggnggggaaggtgccctngtggtgttttttttaattttggggctcaccgcggtggcggccgctctggaatantggatcccccgggctgcaggaattcgtctcacccctagaaaaaaatccccctccctccccttttgaccctccctcaccagctgcaaaaccgcgggccgcatcccgcccgcgccgcccaccggcggccacagccgcctacataaaccactaatcgaccactcgccgaaccaaaccacccacccacccaaacccaatggcgtccaacctcctctccgccccgtcccgaaccctagctccgtcgccggcgccggcccccgcgggccctccgcgggcgtgtgccggtgcaagcgcacctcccgcgggggggcctgggcctcgcccccccgcccaaaaagccgggcccctccccgtgcgccccgtccggtggcaattcgaaaaagaaaacccccggaaaagagagccccccccccgaagttccccccccccaaaaaacggggccccggggtcccggggtcccctgtgcgggggccccggttttcaagaggccccattttactcccgcccgggtggttcagggggggggaagatctcttgcccccccccccgccctttttataggaggaggccccacaaggggcggggggggggcggcccacccaccccttttttataaaatagagaagaaaactcgttgggtgcgccgccccccgccccttgttntcggggggggggtgcgcgtagggggatataaattatacccgccggcttctttcttttaggagatgagggacgccccccttctttttctaaaataaaaagaggcggggggggggggaacaacaacgtctcccctcccccggttnctataagagaggggggttttttccgccccccccccataccactctctccaccacgggcgccgctctttaggtggggtggggcggcgccccactaattaagaggtgggcgcgcgccctcccccgcgagatatgaaaaaataaacaagcgcggggcgcccgcttc

SEQ ID NO: 78631 - DNA, 770 bp, Zea mays
  misc_feature: Ceres CLONE 1563626
  misc_feature: Encodes the peptide sequence at SEQ ID NO. 78632
  misc_feature (603)..(603): n is a, c, t, g, unknown, or other
  misc_feature (619)..(619): n is a, c, t, g, unknown, or other
  misc_feature (673)..(673): n is a, c, t, g, unknown, or other
ctggagctccccgcggtggcggccgctctagaactagtggatcccccgggctgcaggaattcgtctcacccctagaaaaaaaatgccatcacgaatgtggaacctcaacaaagccctggtcacctcactactctgcatctcggcgttgtcgtcgtcgccatggccatgcacggcagccggtcagctgggcggcaagcccctggtcaccgccgtcaccaaggacgcgtccacctccctctacacggcgccgctcaaggacggccacccgctcgtcctcgacctcactagcccggtcatctcgctggccacgtgcgccagctcctccaagaacaacaacggcacgctcaccgccacgctatccgccaacgccaccgacggccagaacccgctgttcccggtctccttctcggcggtggccacgtgcgcgccgtcgtccaagctgcccgccggcgccggcgccgccgggcgtcgcggggctcgcgccctcctccagcagccagcagtcgctcccgggcgcaagtggcgcgcatcgcagaaggtcgccgacaagggtcgcgctgtgcctgcccagcgacagcaggtccacgtcgggcgacagcgtcngcgtggccatcctgcngcggcagcccgcctgatctttcgtccccggcagaaccggggcgacttcaccacngatgctgggccggcacgggcgccccttccaccccggagccccgaagccggtgccccccggggtattaaagttctcctcaaccgggatgggcgggggg

SEQ ID NO: 78632 - protein, 225 aa, Zea mays
  misc_feature: Ceres CLONE 1563626
  misc_feature (170)..(170): Xaa is any aa, unknown, or other
MWNLNKALVTSLLCISALSSSPWPCTAAGQLGGKPLVTAVTKDASTSLYTAPLKDGHPLVLDLTSPVISLATCASSSKNNNGTLTATLSANATDGQNPLFPVSFSAVATCAPSSKLPAGAGAAGRRGARALLQQPAVAPGRKWRASQKVADKGRAVPAQRQQVHVGRQRXRGHPAAAARLIFRPRQNRGDFTTDAGPARAPLPPRSPEAGAPRGIKVLLNRDGRG

SEQ ID NO: 78633 - DNA, 813 bp, Zea mays
  misc_feature: Ceres CLONE 1563628
  misc_feature: Encodes the peptide sequence at SEQ ID NO. 78634
  misc_feature (617)..(617): n is a, c, t, g, unknown, or other
  misc_feature (690)..(690): n is a, c, t, g, unknown, or other
ggagctcaccgcggtggcggccgctctagaactagtggatcccccgggctgcaggaattcgtctcacccctagaaaaaactcacgcgttctccacctactgctggcgctcctgtgaggcgacgccggaccggccaccccgcatgcgaacagcgcacggaccggccaccggtgtgacccctccatccaaggcttcagctccagaccgagccgccccgccaatcgccgtccgccgaaccgcctaggaatttgttttcctcatctaaagttactgcattgtattccatagaaatggctatggggttgattaatgctaatcctataatccatgagaaaaaagaaagacgcatccgacaggcaccagagaccacagatgaaaatgcggtagagtccatagaccagctggaaatatttgatcacattagagatataaaggatccagagcacccatactcactggaacagcttaatgtggtgactgaagactcaattgaactcaatgatgaaagcaatcatgtcagggttattttcaccccaacagtggagcactgcagtatggcaactattattggcctttgcatacgtgtgaaacttgtacggagtctccctcctttatacnagggtggacataagggttgccccctggatcacacgcaactggaagctgctgtgaaatagcaactgaatgaccnaagaacggtgtggcgggctgcattggaaaacccaaacctacctggacatggtttgaagagtgctttatcaccacatttcgatttgaggtcctcagttattgcacgtccggggaaaccattggg

SEQ ID NO: 78634 - protein, 128 aa, Zea mays
  misc_feature: Ceres CLONE 1563628
  misc_feature (36)..(108): Pfam Name: DUF59 Pfam Description: Domain of unknown function DUF59
  misc_feature (110)..(110): Xaa is any aa, unknown, or other
MAMGLINANPIIHEKKERRIRQAPETTDENAVESIDQLEIFDHIRDIKDPEHPYSLEQLNVVTEDSIELNDESNHVRVIFTPTVEHCSMATIIGLCIRVKLVRSLPPLYXGGHKGCPLDHTQLEAAVK

SEQ ID NO: 78635 - DNA, 707 bp, Zea mays
  misc_feature: Ceres CLONE 1563631
  misc_feature: Encodes the peptide sequence at SEQ ID NO. 78636
  misc_feature (687)..(687): n is a, c, t, g, unknown, or other
  misc_feature (707)..(707): n is a, c, t, g, unknown, or other
ggagctccccgcggtggcggccgctctagaactagtggatcccccgggctgcaggaattcgtctcacccctagaaaaaggccataggcccagttggcgccgggtcgggttttgctagggtttactgcttgtcttcctttctcggcagtcggcaccttcgcggcttcgcctgatcgcctacgccgcttcgtcctgattctgattctctggtgctcccaagaagaaagtcagggaatgaaggaccgccacctctcgctgaaccagacccagcgggtccgcctcgaggccgcgcttcaagagctccagtccgttgcgcccgccgccgcgtccgccgccgccgtcaccgtcgcggacaccattcccgtcaatcaagaggacaacatcctcaaggggcatgggacgtcggatcaggacggggaggtggttgcgacgctctgcggggtggtggagcgggtcaacaagctggtctacgtccgcactcttcgcgcgagatacaagccggaggttggtgatatcatagttggccgtgtgattgagattgctcctaagcgatggaggttggagataaattttagccaagatgctgttctgatgctttcatctatgaacttgcctgatggtattcagagaaggagaactgctgttgatgaacttaatatgcggagtatctttgaagaaaatgatgttnatctgtgctgaagttcgagn

SEQ ID NO: 78636 - protein, 154 aa, Zea mays
  misc_feature: Ceres CLONE 1563631
  misc_feature (152)..(152): Xaa is any aa, unknown, or other
MKDRHLSLNQTQRVRLEAALQELQSVAPAAASAAAVTVADTIPVNQEDNILKGHGTSDQDGEVVATLCGVVERVNKLVYVRTLRARYKPEVGDIIVGRVIEIAPKRWRLEINFSQDAVLMLSSMNLPDGIQRRRTAVDELNMRSIFEENDVXLC

SEQ ID NO: 78637 - DNA, 824 bp, Zea mays
  misc_feature: Ceres CLONE 1563632
  misc_feature: Encodes the peptide sequence at SEQ ID NO. 78638
  misc_feature (610)..(610): n is a, c, t, g, unknown, or other
  misc_feature (759)..(759): n is a, c, t, g, unknown, or other
tggagctccccgcggtggcggccgctctagaactagtggatcccccgggctgcaggaattcgtctcacccctagaaaaaagtgagccgccccgccgctcctcagccatcctctccatctcggtgtcacacactccgcatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctctcctacgacttcggcgcgctggagccggccatctcgggggagatcatgcgcctgcaccaccagaagcaccacgccacctacgtcgccaactacaacaaggcgctggagcagctcgacgctgccgtcgccaagggcgacgcctccgctgtcgtccagctccagggcgccatcaagttcaacggcggcggtcatgtgaaccattcaatcttttggaagaacctcagcctattagcgaaggtggtggggagccgccacatgggaaacttggctgggcctcgatgaggattttggttcatttgaggcacttngtaagaggatgaatgcagaaggcgctgctttacaggatctgggatggggtgtggttagcttttggaataaagaggcaaaaaagctttcagttgaaactacagctaatcaggatccctctgggtgactaaaagtgcaagcttgggtccgnctgttgggggattgatgtctgggggacaatgcgtacctacctggcagtacaaagatggtaagggc

SEQ ID NO: 78638 - protein, 131 aa, Zea mays
  misc_feature: Ceres CLONE 1563632
  misc_feature (32)..(113): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
MALRTLASKNALSFALGGAARPSAASARGVTTVALPDLSYDFGALEPAISGEIMRLHHQKHHATYVANYNKALEQLDAAVAKGDASAVVQLQGAIKFNGGGHVNHSIFWKNLSLLAKVVGSRHMGNLAGPR

SEQ ID NO: 78639 - DNA, 824 bp, Zea mays
  misc_feature: Ceres CLONE 1563634
  misc_feature: Encodes the peptide sequence at SEQ ID NO. 78640
  misc_feature (666)..(666): n is a, c, t, g, unknown, or other
tggagctccccgcggtggcggccgctctagaatagtggatcccccgggctgcaggaattcgtctcacccctagaaaaaagcgcacctcatctcgctccaagcacaccaccactccacagtgcacttcactctctacagcaacagaaaagtgagcagcagacagcagcagctgctgccatggaggcgtggagatctctcctcgcgagcttcgtgctcgccgtgctggccgcgcaggccttggtggccgtggtcgagtccaggaccggtcccgtggagcaggcgagcgaaggtgacgacgtgaagaagccggactgcgtgccggggatggacccgcgctcgttcccggggaccggcggcggccacggcatcacgcccgtgacgccatcgcacggaggctccagctccccgacgccgtcccacggcggcggcggcgggtacgttccaacgccgtcgcatggcgggacgctgcctttcccgtcccacggcggctccggctccggctcctctccgacgtcgccctccaccggcggcggcgcgtacggtgggtctccgtccacccccggcggtggcgcgtacggtgggtctcctccgtcacccccagcggcggcggcgcgtatggtgggtctccgtctactcccagcggtggcggcgcctacggtagcgggntcccctcgcctgctcatggtgctggtggcgcctatgggagctctccgacgcccgcgtacggcgattcccccctgcacggcggcatcgggacctcgtcaccgacgacatttgtccccatggaccccccaagcttcggcactgcgactactgaggtcgac

SEQ ID NO: 78640 - protein, 215 aa, Zea mays
  misc_feature: Ceres CLONE 1563634
MEAWRSLLASFVLAVLAAQALVAVVESRTGPVEQASEGDDVKKPDCVPGMDPRSFPGTGGGHGITPVTPSHGGSSSPTPSHGGGGGYVPTPSHGGTLPFPSHGGSGSGSSPTSPSTGGGAYGGSPSTPGGGAYGGSPPSPPAAAARMVGLRLLPAVAAPTVAGSPRLLMVLVAPMGALRRPRTAIPPCTAASGPRHRRHLSPWTPQASALRLLRS

SEQ ID NO: 78641 - DNA, 1003 bp, Zea mays
  misc_feature: Ceres CLONE 1563635
  misc_feature: Encodes the peptide sequence at SEQ ID NO. 78642
  misc_feature (352)..(352): n is a, c, t, g, unknown, or other
  misc_feature (353)..(353): n is a, c, t, g, unknown, or other
  misc_feature (395)..(395): n is a, c, t, g, unknown, or other
  misc_feature (405)..(405): n is a, c, t, g, unknown, or other
ggagctccccgcggtggcggccgctctagaactagtggatcccccgggctgcaggaattcgtctcacccctagaaaaaagtttgccgctctgtgagcctgctgccgtcttcttccgccgccgccgccgtcgtcgtcttcgtccgtagatcagagagcggggaggaagaaaaagcgatcgatggcgtccaactacgtggacacgccgggcgaggagggacggttccacggccctcacagccacagcaccagcacgaccccgacgggcggcgcggcggcggcggcggcatcgccgcgcaacttccggcgcagcttctcctccgcgtcctccgcgggcccagccattgcggcgcnngcgggcagaaggaaggcgcaggagttctcgcgaggggggggnttttcctggntatgtggaagtgcccggttgccagcgcaccaagtcttattgggaacagcccccctggggggaagacggttgtaagtcttttagcactcttctcggaccctccttggggtggcggcaattttcttttttccacgggccaaggcattaacccgaggtggacctcttgtgggtgcattacccaccccccaacccattaggttgaagataccacggggccacctgatgggggcagaaactttaaaggggaaatcgtttcctcttggggcccaaggttttgaagaatggggggaaattttggcttgggcccaaaggccaccctttgtgccaaaggggttttacccagggttttgctaaaacagcgggcgacattttccggaaaaggtgcccccctttccaaagggttttttgataaaaggaaaaaagggttaaaaaaagggtggggttccccttgggatccaaaaccccggccgaagaaaaattttccggtggaattaaaaccttggtttaggggatcccaaaaattctgtaaaaagtctcttttgggagggtgtggggccccccaaaaaccccaaaaatatacctttttggggcggggaaat

SEQ ID NO: 78642 - protein, 99 aa, Zea mays
  misc_feature: Ceres CLONE 1563635
  misc_feature (58)..(58): Xaa is any aa, unknown, or other
  misc_feature (76)..(76): Xaa is any aa, unknown, or other
MASNYVDTPGEEGRFHGPHSHSTSTTPTGGAAAAAASPRNFRRSFSSASSAGPAIAAXAGRRKAQEFSRGGGFSWXCGSARLPAHQVLLGTAPLGGRRL

SEQ ID NO: 78643 - DNA, 1094 bp, Zea mays
  misc_feature: Ceres CLONE 1563639
  misc_feature: Encodes the peptide sequence at SEQ ID NO. 78644
  misc_feature (9)..(9): n is a, c, t, g, unknown, or other
  misc_feature (10)..(10): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
ttttttttnntttttttctcttattataaaaggcgtgatcacgcgcacagacgcnnnnnnnnttnnnnnnnnnttggtggccctcccgcggtggcggccgctctagaactagtggatcccccgggctgcaggaattcgtctcacccctagaaaaaatgtcgccctcggtcacctacgtctccgtccgcaagcgtcaggcaggctgccccgggaggccgggaggaagcagatcggagaaggtgatctgttgtcatggctcgattgtggatcgggaacttggatgcccggttgactgctcgggagctggaggacgagttccgcacggacggggttcttctcagtgtctgggttgctcgggaaccacctggcgttggcgtttatcgattttgatgataagagggaggaaaaggatgacatcagtgacctcgcatgccccagaaaggacggagagttcagttatctgcagaatggggaagtgcagaccccccccacgtcctctacccggggatgggtgggttttgaggcacctctgggtacaaatgcggggtgaagagtggacaccttcttcgctccgggaggtacccctttgcaaaaattgtcttcccaggaacgtccaagggaatgcgaggaatgggccgaccgtaaaagcgcggaaaagccgatgtacacccaagcaaatctcaaggcttcccctccgagtatgtccccccctggaagagtttcgatattttttacccccccccctcaacaacgcgaagtgttaataggggtcttctaaagtggggccacatccgtccttcaacaaagggggcgatctctagtggaggttatgcctacagaccctctgcctttccagtagcgagaccagggccgttttttttgagggcagggggtccctgagcacgcccacccccacgaagagcgctgcccacgggggaaaacaaggaaatctctcgcgccagctctgtgatgaaaattctcatagcaccctaccctcttagccccacaggcgagacttttcttagacccagacaatccgcattgggagttgctccgcacaactcgataagacggacgcaatgggtgagggaaac

SEQ ID NO: 78644 - protein, 45 aa, Zea mays
  misc_feature: Ceres CLONE 1563639
MARLWIGNLDARLTARELEDEFRTDGVLLSVWVAREPPGVGVYRF

SEQ ID NO: 78645 - DNA, 813 bp, Zea mays
  misc_feature: Ceres CLONE 1563640
  misc_feature: SWISSPROT Homolog: EC 4.4.1.5 Lactoylglutathione lyase
  misc_feature (385)..(385): n is a, c, t, g, unknown, or other
  misc_feature (524)..(524): n is a, c, t, g, unknown, or other
  misc_feature (530)..(530): n is a, c, t, g, unknown, or other
  misc_feature (660)..(660): n is a, c, t, g, unknown, or other
ctccccgcggtggcggccgctctagaactagtggatcccccgggctgcaggaattcgtctcacccctagaaaaaaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacaccacagcaagaggatgctccatgcggtttaccgtggttggggatctggaccgcacaatcaagtactacacggaatgctttgggatgaaactgctgaggaaaagggatgttccntgatgagaagtacaccaatgccttccttgggcttgtggccacaaaacaccaactttgcagttgaattgacatacaacctatgggcgttgacaagtatgacattgggaaccggctttggggcatttcgcaattgccaaangatgantgtgtacaagttagctggagatatcaaatcccaagggtgggtaagatcaccccgcgaaacctggtcctgtcaaagggaggatcccactgttattgcctttcccacaaagatccctgattggccaccttgntttgaagccttttcccgagaggcgtgtagacacccctgagcctcttttgccaggtccatgcctttcggggtttggtgaacccttgagccgttcttaatcaggtttttaatggagaagggcccttaggggattgaaagctccctaaaggaaaaa

SEQ ID NO: 78646 - DNA, 857 bp, Zea mays
  misc_feature: Ceres CLONE 1563641
  misc_feature: Translation starting site: 111
  misc_feature: Pfam Name: ATP-synt_D Pfam Description: ATP synthase subunit D
  misc_feature: SWISSPROT Homolog: EC 3.6.3.14 H(+)-transporting two-sector ATPase
  misc_feature (514)..(514): n is a, c, t, g, unknown, or other
  misc_feature (568)..(568): n is a, c, t, g, unknown, or other
ggagctccccgcggtggcggccgctctagaactagtggatcccccgggctgcaggaattcgtctcacccctagaaaaagtcggccagcggatctaatcggggcgggcgcgatggctgggcagaaccagcggctcaacgtcgtgccgacggtgacgatgctcggcgtcatgaaggcccggctcgtcggcgcgacccgcggccacgcgctgctgaagaagaagtccgacgcgctgacggtccagttccgcgccatcctcaagaagatcgtcgccgccaaggagtcgatgggcgagacgatgcgcgcctcctccttctccctcgccgaggccaagtacgtcgctggcgacggcgtccgccacgtcatcctccagtccgtccgcgcggcatccgtccgcgtccgctcccaccaggagaacgtggccggggtcaagctccccaagttcacccacttcgtcgaccccgccgcggcctccggggccccctccaacgcgtccccgagcctcacgggcctggncccgcggcgggcagcaggtcgccgcctgccgctccgcgcacgtcaaggccatcngaggtgctcgtcgagctcgcctctctgcagacctccttcctcacgctcgacgaggccatcaagaccacaaaccgccgcgtcaacgcgctccgagaacgtcgtcaagcccaggatcgagaacaccatcagctatcatcaaaggggagctcgacgagctcgagcgcgaggacttcttcaggcctcagaagatccaggctacaagaaaaaaggaaatcgagcgccagattgcgcccgcaggctatttgcggaagaacagctttgcgaagattcgggcctaaaaagggtttcc

SEQ ID NO: 78647 - DNA, 1074 bp, Zea mays
  misc_feature: Ceres CLONE 1563642
  misc_feature: Encodes the peptide sequence at SEQ ID NO. 78648
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (27)..(27): n is a, c, t, g, unknown, or other
  misc_feature (29)..(29): n is a, c, t, g, unknown, or other
  misc_feature (61)..(61): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (354)..(354): n is a, c, t, g, unknown, or other
  misc_feature (637)..(637): n is a, c, t, g, unknown, or other
  misc_feature (746)..(746): n is a, c, t, g, unknown, or other
  misc_feature (766)..(766): n is a, c, t, g, unknown, or other
  misc_feature (788)..(788): n is a, c, t, g, unknown, or other
  misc_feature (967)..(967): n is a, c, t, g, unknown, or other
  misc_feature (984)..(984): n is a, c, t, g, unknown, or other
  misc_feature (1004)..(1004): n is a, c, t, g, unknown, or other
  misc_feature (1008)..(1008): n is a, c, t, g, unknown, or other
  misc_feature (1009)..(1009): n is a, c, t, g, unknown, or other
  misc_feature (1013)..(1013): n is a, c, t, g, unknown, or other
  misc_feature (1032)..(1032): n is a, c, t, g, unknown, or other
nnnnnnnnncccccccccgggagaatncnggctgggacgggggggtgggggagagggaatnaatnnnggcgaaccnnnnnnnnnntggggctccccgcggtggcggccgctctagactagtggatcccccgggctgcaggaattcgtctcacccctagaaaaaacggaggaaggaagcgagaagaccagatggtgacaagagagagagagagtgtgtgtgatcggtacaaggatcaccgctgtgactgcgcgtgctgcttcaccgaatcgagtcagatcctgtccgaatccgagctaagggatggaaaccggtagtgaagcctcgaaggcagctgacgctgtggttgactggcntaaacaccacagcaagaggatgctccatgcggtttaccgtgttggggatctggaccgcacaatcaagtactacacggaaccgctttgagatcaaactgctgaggaaaagggatgttcctgatgaaaaaggacaccaatgcctttcccttggcctttggggcccaggaaaacaccccacttttgacagttgaaattgaacaatacaaactaatgggcggtatcacaagagtatggacaattgggaaaccaccgcttttggggggcgctcttacgcacaagtggngttaacttcgaaggaatgagagaaaccacacctctgaaagcgtggaaatacaattattcataaaattccgaaaagggaggggggtggataaaagagaaacaacaccccngcaggcccacaaaaccgcgntgggggtcccccataggcgcanaaggggagagaagaggcaatcccaacccgtgtgctgtttaaataaggcccttttggccgcactacgagggaaatatccccttggaagtggggggattacccaccggagtgtctagaaagccctataataaccgcagaaaaggagccattgaaccatgaaacctttgggaaacccgctcntttttggccgccagganaccaacgtcccataatgcgngggnntggngagcaaaacgataggaaancccgtatacttaaaaaaagaatctattaaaagaagaaaaaag

SEQ ID NO: 78648 - protein, 46 aa, Zea mays
  misc_feature: Ceres CLONE 1563642
  misc_feature: SWISSPROT Homolog: EC 4.4.1.5 Lactoylglutathione lyase
  misc_feature (18)..(18): Xaa is any aa, unknown, or other
METGSEASKAADAVVDWXKHHSKRMLHAVYRVGDLDRTIKYYTEPL

SEQ ID NO: 78649 - DNA, 789 bp, Zea mays
  misc_feature: Ceres CLONE 1563643
  misc_feature: Translation starting site: 173
  misc_feature (578)..(578): n is a, c, t, g, unknown, or other
  misc_feature (624)..(624): n is a, c, t, g, unknown, or other
tggagctcaccgcggtggcggccgctctagaactagtggatcccccgggctgcaggaattcgtctcacccctagaaaaagccacccccgcgagacctgtccgaatcgcgcccaggtccctcgctgggagtttcgccgagggccctcccgcctcccctagattcacgacggagatggcgtccgagctcacctaccgcggcggcggggcgtccacggccgccggcaccggcgccgggggatactccccgaagccgtccaagccgctcgcgtggctgccccgcgcggcccgctacgctgtcgccgagcatcgcccgctcttcgcgctggccgggatgctgatcgccgccgccgtcatctccatcgcctccccgtccgcctcctcctcctcctccacctctacctccaccggcgccgccgcctcgtcctactccaacaacaacaatccgctcgcccgcttccccgtcgagcccgcccaccaccgcgacgtggccacgcggcacttcgtcggcggcaaggtgccgctgggcctcaaacggaaggcgctccgcgtcctcgtcaccggcggcgccggcttcgtcngcagccacctgggtgtacccgctcctcgagcgcggcgacagcgttnatcgtcgtcgataacttccttcaccggccgcaggaacaacgtttctgcaccacctcaacgacccaaacttcgagatgatcccgccccgatgtcgtcaagcccattctgcttcaggtcgaccagatcttacacctggcctggccgggggttccccggtccactaaa

SEQ ID NO: 78650 - DNA, 823 bp, Zea mays
  misc_feature: Ceres CLONE 1563644
  misc_feature: Encodes the peptide sequence at SEQ ID NO. 78651
ctcctcggtggcggccgctctagaactagtggatcccccgggctgcaggaattcgtctcacccctagaaaaaccccgactcctcgcttcctcccgttccgtcgccgccgcgcgcctcggagaagagatagaggcggccgctgcatcgaccccgcgccacctccgcctgcctcccccggcaccgatcgggtttgatcgatggcgtcgaagaggatcctgaaggagttgaaggacctgcagaaggacccgcccacctcctgcagcgcaggtcctgttggtgaggacatgttccattggcaagcgaccatcatggggccttcggacagcccatttgcaggtggggtattcttggtgaacattcacttcccaccggattaccctttcaagccaccaaaggtgtctttccgcaccaaggttttccacccgaacatcaacagcaacggcagcatttgccttgacattcttaaggaacagtggagccctgctttaactatctcaaaggttctcctgtcaatctgctcactgctcacggacccaaaccctgatgatcctcttgtccctgagattgctcacatgtacaagaccgacagggccaagtatgagtccaccgcacgctcctggacacagaagtatgccatgggctagaagcaaagctaaaagcgggcaaaactggtgaatgtgccggaacccaaatcgttatcacctaaataacagtcaagtcgcaagtatgaatggacttttggagaccattgtggccttgttgactcatggattaccttgggaaagccgtttgtggtctgtttccacctgaccgttttcttttt

SEQ ID NO: 78651 - protein, 148 aa, Zea mays
  misc_feature: Ceres CLONE 1563644
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPVGEDMFHWQATIMGPSDSPFAGGVFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 78652 - DNA, 812 bp, Zea mays
  misc_feature: Ceres CLONE 1563645
  misc_feature: Translation starting site: 161
gctccccgcggtggcggccgctctagaactagtggatcccccgggctgcaggaattcgtctcacccctagaaaaactccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctgggagagcttacactgctacccaggtacagggtgactacatgccaattactcgcggtgagaagcgctctgtaaaggttgtgaaagtcacagatgagatgaaaggcttttgcgggcctatgcaaagctcgcccttgagccgattaaacaaaaaacaccctcggtggcccccccaaaaaaaggccagcctgaagcccaaaaaaggaaaaacaagaagggaagccagcccaaactt

SEQ ID NO: 78653 - DNA, 798 bp, Zea mays
  misc_feature: Ceres CLONE 1563647
  misc_feature: Translation starting site: 270
ctggagctccccgcggtggcggccgctctagaactagtggatcccccgggctgcaggaattcgtctcacccctagaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgccaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcgggcaggccacgtacctgggcgcccccggtgccgtggggcacgctgccgaccatcctggtgatcgagttcgtgggcatcgccttcgccgagcaccagcgcaccatggagaaggaccccgagtagaagaagtaccccggcggcgccttcgacccgctcggcttctccaagaccccgccccagtcgagggagtacagctcaaggagatcaagaacgggcgcctcgcccatgcgggccttcgtcggcttctgcgtcaagcagtcggcgtaccccggcacgggcccgctggaa

SEQ ID NO: 78654 - DNA, 801 bp, Zea mays
  misc_feature: Ceres CLONE 1563649
  misc_feature: Encodes the peptide sequence at SEQ ID NO. 78655
  misc_feature (578)..(578): n is a, c, t, g, unknown, or other
  misc_feature (639)..(639): n is a, c, t, g, unknown, or other
  misc_feature (789)..(789): n is a, c, t, g, unknown, or other
ggagctccccgcggtggcggccgctctagaactagtggatcccccgggctgcaggaattcgtctcacccctagaaaaaatttccaccctcgcgcggcggtcgccggagcgagcagagctgccggaaggcccgtcggatccgccgccgccaagatgaatgacgccgatgtagccaagcagatccagcagatggtgcggttcatccgccaggaggccgacgagaaggccaacgagatctccgtctccgccgaggaggaattcaacattgagaagctgcagcttgttgaagctgagaaaaagaagattagacaagagtatgaacgcaaagagaagcagcttgaagtacggaagaaaattgagtactctatgcagttgaatgcttctcgcatcaaagttcttcaagctcaggatgatctagtaaacaaaatgaaagacgatgcgatgaaggaactcctccttgtcagccacaaccaccatgaatacaagaaccttttgaaagatctaattgttcagggcttgctccgtttgaaagagccagctgtattgctccgttgccgcaaggaagatcaccatcatgtnggaatcagtactgcattcagcaaagcacgagtatgcatcataagcagatgtccatgaaccnagagatatttgttgaaccatgatgtggtacctaccacctgcccccaagccatcatgatgctcacgggccagttttgcttctggaaggtatttgtcttggcctctcgagatggaaaaagattggggttttgagagtacaccttgacgcccngaccgggaaggt

SEQ ID NO: 78655 - protein, 160 aa, Zea mays
  misc_feature: Ceres CLONE 1563649
  misc_feature (16)..(161): Pfam Name: vATP-synt_E Pfam Description: ATP synthase (E/31 kDa) subunit
  misc_feature: SWISSPROT Homolog: EC 3.6.3.14 H(+)-transporting two-sector ATPase
MNDADVAKQIQQMVRFIRQEADEKANEISVSAEEEFNIEKLQLVEAEKKKIRQEYERKEKQLEVRKKIEYSMQLNASRIKVLQAQDDLVNKMKDDAMKELLLVSHNHHEYKNLLKDLIVQGLLRLKEPAVLLRCRKEDHHHVGISTAFSKARVCIISRCP

SEQ ID NO: 78656 - DNA, 820 bp, Zea mays
  misc_feature: Ceres CLONE 1563650
  misc_feature: Encodes the peptide sequence at SEQ ID NO. 78657
  misc_feature (610)..(610): n is a, c, t, g, unknown, or other
  misc_feature (656)..(656): n is a, c, t, g, unknown, or other
  misc_feature (756)..(756): n is a, c, t, g, unknown, or other
  misc_feature (761)..(761): n is a, c, t, g, unknown, or other
  misc_feature (814)..(814): n is a, c, t, g, unknown, or other
ctccccgcggtggcggccgctctagaactagtggatcccccgggctgcaggaattcgtctcacccctagaaaaaagcttctgcgcgcggcgagctagggaggaggaggagggacaggagagagatggacgcggagaagcagcgccagcacgacggcgcggtggaggcggacatcgagcggctccccgtcgacctcctcgcgcacatcctctccctcctgtcgcccttccgcgacctgtccatggcggagggagtgatccggaggtggcgctgggcgggtggagcggtcgctggcgtcgcggcggcggctgagcttcgcgggccagcgcaccggcgacgacaccgccgcgcgcctcgtccgcgccgccgtcaacctccgcgacctcgacatgtgagttcaccggccccccatcccatgccccatctctcgctctgctcaccaaaaaattcaacccgttcttcctaacgctgtctgtctgcccgttgttggagttcacgaagctgctggggctgccgaatcaccgacgatggcctgatcaagatttcgtccgcggattgcgtcggcaacctgacgtccatatcgctctggggattggccgggatcaccgatnagggcgtggtccgtctgggttcgagggcttattctctgcagcaccntcatatcggtggaacgttcatcacagatgaatcccctctacgcagtcgcaaacagctgcgcaaatcttaagagcatcatccctgtggagctgcccccacntgacngaggggcgggctgggtggccctggtgaacagtgcccggcgctggaatgatcanctgggg

SEQ ID NO: 78657 - protein, 113 aa, Zea mays
  misc_feature: Ceres CLONE 1563650
MDAEKQRQHDGAVEADIERLPVDLLAHILSLLSPFRDLSMAEGVIRRWRWAGGAVAGVAAAAELRGPAHRRRHRRAPRPRRRQPPRPRHVSSPAPHPMPHLSLCSPKNSTRSS

SEQ ID NO: 78658 - DNA, 844 bp, Zea mays
  misc_feature: Ceres CLONE 1563652
  misc_feature: Encodes the peptide sequence at SEQ ID NO. 78659
ctccccgcggtggcggccgctctagaactagtggatcccccgggctgcaggaattcgtctcacccctagaaaaactgctcagctcgaacgaacaaaaagaactcccctcggccctctcctcttgtgcttctgcttccccaccgagtctcctcaaccccaggcactcgccctctgtcggtctgtcccctcccttcctcgcctccgatgccgccgccgccgccgcttctcgagccgcgcgactacctcggcgccggcgccacctcgtcgtgctgctcgtcgtcctgctcctccggccgcgagggcgcggggccccacctcgcgctgcggctcgggcttccggggtccgacgactcccccggccgcagcgcggacgcggagcacgccggcgcccacgtcgacgccgcgctcaccctcggccccgcccccgcccccgcgcctcccaggggcagcgccaagcgcgggttcgccgactccctcgaccggtccgcgaagcgggacggcgttgccgcggatgacgctgctgggggcgtcacgcgggtagctggagctgctgccggagctccgcccgctgccaaggcacaagttgttggatggccgcctgttaggagctacgggaagaataccctagctgccagtgcacaaagacaaatgggggaatgaaagttagagtgagggcgggatgctgttatgtcaaggtcagcatggaaggaagccccatacctaaggaaagtggacctcaagacctattcaagctatgaggatcttctcgcctgggctggaaaaaaatgtccaattgccttctcacctggtccaaaacagttcatgcaagaacttcaagaaggga

SEQ ID NO: 78659 - protein, 151 aa, Zea mays
  misc_feature: Ceres CLONE 1563652
MPPPPPLLEPRDYLGAGATSSCCSSSCSSGREGAGPHLALRLGLPGSDDSPGRSADAEHAGAHVDAALTLGPAPAPAPPRGSAKRGFADSLDRSAKRDGVAADDAAGGVTRVAGAAAGAPPAAKAQVVGWPPVRSYGKNTLAASAQRQMGE

SEQ ID NO: 78660 - DNA, 930 bp, Zea mays
  misc_feature: Ceres CLONE 1563654
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccnnnnnnnnnnnttttgcggggctcacccgggggcggccgctctgaactagtggatccccgggctgcagaattcgtctcacccctagaaaaagcccgcgattcgaccgctcgttccgtctcgaccttcaggcgggtagcaggttgaccgtccgggaattcaccgtatcccgggatacgtatgggttccaaagcgtccttctgtgtcacgctcctcttgctgctcgccgccgcctgggggacctgccgacgaatgctgctgaactcccagaccatagagctattacttttgaagggagccagggtttctttccaacccgaagaatttcccggtcccgttcctcaaagaaggggccagcccccgcttggggcctcaggccctgggggaaaaaaactttccccccggaaggccaaaaaaagcccggggccccggttttttttttcccggggggggaaaaaaccggcccccccaaaaaaaaaaagggggccccgtgggggggaaattccccccccccaaaaagaaaaacccctttggggcctctctcacaagaaaaattttttcccccgggtttgtgggaaaaaaaaaaaaaaaaaggggggggaaaaaaaaaaaatttgttgggggggggatcctttttttttgggggaaaaaccccccccccccgggtgtttgggggcccccaaaaaaaacacccccgcgggggggttatttattacaccccccgaaaaaagagggttctttttttaaaaaaaaaaaggagggtgtgc

SEQ ID NO: 78661 - DNA, 825 bp, Zea mays
  misc_feature: Ceres CLONE 1563656
  misc_feature: Translation starting site: 178
  misc_feature (804)..(804): n is a, c, t, g, unknown, or other
acccgcggtggcggccgctctagaactagtggatcccccgggctgcaggaattcgtctcacccctagaaaaactgtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccttgccgtccgcagggcttgctatggtgttcttcgttatgttatggagagtggtgccaagggttgtgaggtgattgttgagtggaaagctcagggcccaaagagccaagtccatgaagttcaaggatggctacatgatctcatctggtcagccagtgaacgagtacattgactcggctgtgagacacgttcttctcagacaggggtgtctcggtatcaaggtgaaagatcatgcttgactgggacccgaaaggcaaggttggccccgatcactcctctttccggacctggntgacatccacaccccgaatga

SEQ ID NO: 78662 - DNA, 783 bp, Zea mays
  misc_feature: Ceres CLONE 1563661
  misc_feature: Encodes the peptide sequence at SEQ ID NO. 78663
ctccccgcggtggcggccgctctagaactagtggatcccccgggctgcaggaattcgtctcacccctagaaaaagacaccaccaccaagccagcaggcgctgcgatacattccacacaacaacacccagctctgccccagcccgccacaggagttcccgcatctccctctggtccggtcacaggagctccgagacctctccaatggcggttaagatctacgttgtgtactattccatgtacgggcatgttggcaaactagctgaagagatcaagaaaggtgccttatctgttgaaggcgttgaggctaaaatatggcaggtccctgaaattctctctgaagaagtgcttggaaagatgggcgcgccccctaagcccgacgtgccagtcatcacaccgcaggaacttgcagaggctgacggtatcctctttgggtttccgacacggttcggaatgatggcagctcagatgaaggcgttcttcgatgccaccggtgggctctggagggagcagagcctcgctggcaagcctgccggcatgttcttcagcactggaaccccaggtggtggccaagagactacaccgctgacggcgattacccagttgacgcaccacggcatggtgtttgttccccgtgggctacaccttcggcgccaagctgttcgggatggaccaaggtcagggggggagccccctacggcgcccgggacttttccccccaaaagcttctagggggcccaacaaggtggagctggaaccccccctccccccaggggaaaatctcc

SEQ ID NO: 78663 - protein, 175 aa, Zea mays
  misc_feature: Ceres CLONE 1563661
  misc_feature (7)..(138): Pfam Name: Flavodoxin_1 Pfam Description: Flavodoxin
MAVKIYVVYYSMYGHVGKLAEEIKKGALSVEGVEAKIWQVPEILSEEVLGKMGAPPKPDVPVITPQELAEADGILFGFPTRFGMMAAQMKAFFDATGGLWREQSLAGKPAGMFFSTGTPGGGQETTPLTAITQLTHHGMVFVPRGLHLRRQAVRDGPRSGGEPPTAPGTFPPKSF

SEQ ID NO: 78664 - DNA, 807 bp, Zea mays
  misc_feature: Ceres CLONE 1563662
  misc_feature (744)..(744): n is a, c, t, g, unknown, or other
ctggagctccccgcggtggcggccgctctagaactagtggatcccccgggctgcaggaattcgtctcacccctagaaaaaatccctacccctacgacgtatcttagtcctaccggccagaggggtggcgctgacacgccggtcactacggggatggacatatgccatgtttgatcatgagggggctaatttctgcgggcctgccacggaaatagtgtcatcgaggatgggtgctctgggatcggccgtgggggcaacatgaactgtcgggattcacttcatcgtccgccgcagaggaggataccgcgagcatctagccttgcaacttcactgccatcctcacctgaccgaccaatgccattggatatgagactgccatgagttctggcactgagagcagcctacgtcaccatacccactaggactcagcagactggcctcacgtttgacgacagcctcgaagtatgaggtcccaagctcctcggtgcacgttatgtacatcgacctgagctgtcactactccttccacaatggcgcacggtccattcattcatcccactagcttgtgaacctcctcatttactatgcatggatcgtggactgcctcttacagctgtacaacgctggtgttgagctgcccttcacaactaatcatgctggacttttctcgctgacaggtagcgtgctaaacaagatgtaatggactgatgttaaaactagtgctgcagggcaaggatccctgacncatctttgctctcgcatataagaggtgatggtacatgctcttagctgaacagctatcagtaag

SEQ ID NO: 78665 - DNA, 763 bp, Zea mays
  misc_feature: Ceres CLONE 1563663
  misc_feature: Encodes the peptide sequence at SEQ ID NO. 78666
ctccccgcggtggcggccgctctagaactagtggatcccccgggctgcaggaattcgtctcacccctagaaaaaaaacgccgcagcggcactgcggtagcagcatcgcgcggcaagctcacctcatccctctttcaccccacctctgcaattgcaagcaaagctccggcctccggatcaggatcacactgaccaccgcgagcgcgtgccggcgtccagtggttacgtcgagggagcctaggctagcgaggaacaagcagccaccagcccgccacgatgctcgtgaggagcgcctccacgccggtcctcggcgcgctgcacccttccggctgccactcgccggcggtctcctccccggccgtgcacttcgccgagtcgccggcgtcggccgcctaccacgcgccgcccatctcctgccacctgggcgggcccgggtccgggtccgaccacgagcgctcgcgcagccgcggcgccggcgccggcatgcgccgcacgtgctccgaggacaacctcgcgtctctggccggcggccgcgcggacgtacacgaccaccaccacctttttcctcccggccgtccggaaaaggcgcgccacgggccgcgggccggtggcccctcgaaaaccatccaagtcgttcagaggggcccgcatgccgtccccccggccgacgaaaaaaggagggaagaaccaacccaccaacccaaaaaccccccttccaaagggggggaaaccggggagacctgcccccttttcggggccaagtt

SEQ ID NO: 78666 - protein, 162 aa, Zea mays
  misc_feature: Ceres CLONE 1563663
MLVRSASTPVLGALHPSGCHSPAVSSPAVHFAESPASAAYHAPPISCHLGGPGSGSDHERSRSRGAGAGMRRTCSEDNLASLAGGRADVHDHHHLFPPGRPEKARHGPRAGGPSKTIQVVQRGPHAVPPADEKRREEPTHQPKNPPSKGGETGETCPLFGAK

SEQ ID NO: 78667 - DNA, 858 bp, Zea mays
  misc_feature: Ceres CLONE 1563665
  misc_feature: Encodes the peptide sequence at SEQ ID NO. 78668
  misc_feature (730)..(730): n is a, c, t, g, unknown, or other
  misc_feature (731)..(731): n is a, c, t, g, unknown, or other
  misc_feature (775)..(775): n is a, c, t, g, unknown, or other
ctccccgcggtggcggccgctctagaatagtggatcccccgggctgcaggaattcgtctcacccctagaaaaacgtagacggggccggcgacgaggtccaggagcttcctctgccggagccggcgaggctcgccttcgccgccgcggttggggcgccgcgcactgcagttgacggcgtgatgactccaaaggatggtgaaggagacatgcctactaccgctaacaactcagcagcaaataagcgcaggcggaagaaccagtacagaggaatccggcggcggccgtgggggcaatgggcggccgagatcagagaccccagcaagggcgtccgcgtctggctcggcacatacagcaccgccgaaggagggcggcagggcgtacgacgccgaagctcgcaggatacgcgggaaagaaagccaaggtcaattttccgggacaaaacggcggcagcaggtgctcaaaaagccagcaccaggccgaaactactccaactgcttggtgccacccaaccaaggctggcaacaaactatcggtccccaaatatgtttcccttccctggaccttattaataaaggcccttccgggggaaaaccaggggagggccccccccgttttccccccccagggggaaaaaagttttgaacaggagaccccttttttccccgggaaaaaaaaagttccgcgggtaaaaagggggggggctccccccaaaaaaaaagacccccccccnntgggtttttttaaatattgggggggggggggggggttttttttnaaaaaaaaaaaaccccggggcccccaaaaacccccccccccttttttgtcgcccgcgcggccccccccaaaaaaagtgggggc

SEQ ID NO: 78668 - protein, 129 aa, Zea mays
  misc_feature: Ceres CLONE 1563665
  misc_feature (26)..(76): Pfam Name: AP2 Pfam Description: AP2 domain
MTPKDGEGDMPTTANNSAANKRRRKNQYRGIRRRPWGQWAAEIRDPSKGVRVWLGTYSTAEGGRQGVRRRSSQDTRERKPRSIFRDKTAAAGAQKASTRPKLLQLLGATQPRLATNYRSPNMFPFPGPY

SEQ ID NO: 78669 - DNA, 699 bp, Zea mays
  misc_feature: Ceres CLONE 1563668
  misc_feature: Encodes the peptide sequence at SEQ ID NO. 78670
ctccccgcggtggcggccgctctagaactagtggatcccccgggctgcaggaattcgtctcacccctagaaaaaattgggggcatttgctacaccaccacacccacaccccatcccagcacacaacaagcagcctggtttacggtagctgctagcaaaacaatggagaaccctgctccgagcatcgtagtggccatcgccgcacccgtggcggcggagttcgtgaaactcaccttccgtgccctgtatatgcgccgggctggtcctggcagcagggagatgactgtgccgggaaggccatccgaccagctgggcaggagagtcgtcactgacagccccgtgtacgacggccgtggcgccgacgcccgcctcgtggctcgcatacagggagtcacggtcctggtcggtaacgcagacgccttgttcaccatggtgttcgaaaaccgacagggctaaaggggctccacggctcgtcatccacgggaaatggtcacgggatggggtcagaacgaaatggggcgaattctaccgggcggaaacccgggggtggtttccccccatgggccccacccgggggggttcttgaaaaaaaaaaaaaaaaccctttgccccgggggggggtaaccaaacccaaacgggggaaaactccttgaaaaaaaaagcttttggcccccctgggaaaaaatttttttccctcggc

SEQ ID NO: 78670 - protein, 97 aa, Zea mays
  misc_feature: Ceres CLONE 1563668
MENPAPSIVVAIAAPVAAEFVKLTFRALYMRRAGPGSREMTVPGRPSDQLGRRVVTDSPVYDGRGADARLVARIQGVTVLVGNADALFTMVFENRQG

SEQ ID NO: 78671 - DNA, 801 bp, Zea mays
  misc_feature: Ceres CLONE 1563670
  misc_feature: Encodes the peptide sequence at SEQ ID NO. 78672
tggagctccccgcggtggcggccgctctagaactagtggatcccccgggctgcaggaattcgtctcacccctagaaaaagctattgagccgagcatcctgcgagagtgatccagaacatcacaactttaggactagagttctatggttgcacccacatactaatgcttacctaggatgacgcctgcttggactgcattctgtagtgctcatccgtcatcgtcacttggagtagtagtagttcggctcgattaccggggatcttgggccacgatctcattatgctgctgtctacattcgctctgtccaccgtggcagccacgacactaccagcgctggatgcacagatgaagaacgatccacaggttgacttactcctgatcctccaggcgatggtgacggaatactcgctgctcatggaggtactggacatgatctatggacaccgatatgcaagtcctccatgagcgtgtacgcatcatcacgcctgagctctgcgatgtcaaggcgcatcacacgatgcgaagctcctggacgaccaggatgccggtatcatgaatgttcgcctgctccagatagaggtgacgctcagcccgaggaagaaagatgcattccttgcatgctgaggccaacgtggttatgcgatgaaacgtgtagcaggtccaactgggtagaaaatcctggcaatctccatggggcaaaaggaggagggttgtcaaggtcccttgatgcccaaaatcgatgggatccatggcatgatttgccccccaaaaggggggtccccaaaatgggttcatgaaaaa

SEQ ID NO: 78672 - protein, 61 aa, Zea mays
  misc_feature: Ceres CLONE 1563670
MLLSTFALSTVAATTLPALDAQMKNDPQVDLLLILQAMVTEYSLLMEVLDMIYGHRYASPP

SEQ ID NO: 78673 - DNA, 863 bp, Zea mays
  misc_feature: Ceres CLONE 1563671
  misc_feature: Encodes the peptide sequence at SEQ ID NO. 78674
ctggagctcaccgcggtggcggccgctctagaactagtggatcccccgggctgcaggaattcgtctcacccctagaaaaaaccgcgccacgcagtaaacgaaaagacggggccactccctcaatcctccgcacgccccttccatggagcagccgcacctcttgccgcagctctccccctcaccggtcctctactccctcttctcaccaccagacacgggggccacgccctggcagaggccgctgaaccggggacgggccttcaaaccgcacgctctcctcactgcgggagaccaacaaggccacgctccgcaaggccacgcccaacacacccttccgcatatgcagtagcagaggacagcagccccaacgatcgccgccccaggcccgacaacaatgacgaccacaaccaaggtcgcggcggcgcctgagaactcacagggacgctgatcgaagaagcattcctggttagctacgtacgcggagtatctggcggacagttacttccacaaagaccagatcaacaccttcctcacgcacatctcgcggtacctcgaccgttatggccgagacagataatatctggtcaaagtcgcacacgcaaggtccgaggatcacgcaaatgcccgcaacaccctttaaaagggccatcccggggaattctctggtgaaggagacagaaacaaaatgtcggatccagtctgcaaggaaacgaagctggcaccgggggcccgttccataaatccttaaaaaagttgcccctaagtaagaaaattcttaaagctgggttgaaaaggaaattaaaaaggttttgtttggcaattgcattaacggaaaaatatggtgaaaacaacgcggcctttaa

SEQ ID NO: 78674 - protein, 68 aa, Zea mays
  misc_feature: Ceres CLONE 1563671
MEQPHLLPQLSPSPVLYSLFSPPDTGATPWQRPLNRGRAFKPHALLTAGDQQGHAPQGHAQHTLPHMQ

SEQ ID NO: 78675 - DNA, 786 bp, Zea mays
  misc_feature: Ceres CLONE 1563673
  misc_feature: Encodes the peptide sequence at SEQ ID NO. 78676
  misc_feature (707)..(707): n is a, c, t, g, unknown, or other
  misc_feature (721)..(721): n is a, c, t, g, unknown, or other
ggagctccccgcggtggcggccgctctagaactagtggatcccccgggctgcaggaattcgtctcacccctagaaaaaagcagccgcctcctctcgtagcagtgctcctagtgtactcatcgctactgcttgcaaatacagtactgcttaaaaaagcacagcagcagtacctgaacctccaaaaaaaattatgcgccgctgtgctgttggtctccgcctggctagttttccatatatagaaaaaccgcagctctagacgaccaccagatcggactaggtagaccacacttcccttcacctctcatcggcgctctttcccttcctcgcagtcccaggtctcggctcccctctcagtcaagccgtttcatttcctccctcctacaaatatcctgatatggacgacgacgacgactccccgcctcacgaggcggcggcggcagacctatcgctgacactggcgccggcgccggcgctggcgtctcccgcgccgcctccggcgctgcccgccgtcgcctccgacggaggcgtggcgacggcgcgcgtggacggcaaggacgtgcgcctgttcccgtgcctcttctgcaacaagaagttcctcaagtcgcaagcgctcgggggccaccagaacgcgcacaagaaggagcggagcgtcggctggaacccctacttctacatgaccccgccacacccgcagcccaatgcggcgncgggggagccccancggccccgccgccgggttacgcgggcggggcgggcctcttccccgggccgttaagcggcccacgt

SEQ ID NO: 78676 - protein, 126 aa, Zea mays
  misc_feature: Ceres CLONE 1563673
  misc_feature (105)..(105): Xaa is any aa, unknown, or other
  misc_feature (109)..(109): Xaa is any aa, unknown, or other
MDDDDDSPPHEAAAADLSLTLAPAPALASPAPPPALPAVASDGGVATARVDGKDVRLFPCLFCNKKFLKSQALGGHQNAHKKERSVGWNPYFYMTPPHPQPNAAXGEPXRPRRRVTRAGRASSPGR

SEQ ID NO: 78677 - DNA, 876 bp, Zea mays
  misc_feature: Ceres CLONE 1563676
  misc_feature: Encodes the peptide sequence at SEQ ID NO. 78678
  misc_feature (852)..(852): n is a, c, t, g, unknown, or other
  misc_feature (855)..(855): n is a, c, t, g, unknown, or other
ggagctccccgcggtggcggccgctctagaactagtggatcccccgggctgcaggaattcgtctcacccctagaaaaactctcgttctcaaccatagaccttgggtctgccgtctcctctgccaccggaggatcgaggtcctcgagtcatgagagcgcgcttcacatcgccaccatgaacttctccatcgagaatccttccaccgggtgccaaaagaatctggaattccatgaccacgctaagcatgtcgtgccttttatgacgcaccgtatcccaagtacgccagcggcgatgctctgggtgaggagttcaagggtgatgtcttctaatgttgggctggatgtgaccagcatggcttaccgatgacccagggacttgtgacttctggtcgtgctgctcttctgctccatagaggctctccctgcttcggtaggaataggaggactgacggtaagcgctcgacgaagactgtcggtggttgcatcgcgagccaagacctgtctgctatcaacttgatgacttcgaagaaagctgagaacgtatctgggtggtctgactgactgtgagaagcgaggatgaggggtcgccagatggcctgctacatgagagaaccgtccgacttgacacggatgacgatgatcacgactcccttgcacataccgcaaaggcattcactagcggcgaaccgacggcaaaggcacggagccatctaagatccgaacgggttgtgacaccccttggctctcgacagccaagaggcgctgcatcgctgacaggaagaaagggggttttccaagggaacccccctgtaagctgcccgagtaccgaaaagcgtcctgccccaagctcaanggnaaaaaaaaagggggaaccgcc

SEQ ID NO: 78678 - protein, 65 aa, Zea mays
  misc_feature: Ceres CLONE 1563676
MTQGLVTSGRAALLLHRGSPCFGRNRRTDGKRSTKTVGGCIASQDLSAINLMTSKKAENVSGWSD

SEQ ID NO: 78679 - DNA, 817 bp, Zea mays
  misc_feature: Ceres CLONE 1563677
  misc_feature: Encodes the peptide sequence at SEQ ID NO. 78680
ctccccgcggtggcggccgctctagaactagtggatcccccgggctgcaggaattcgtctcacccctagaaaaattttcctctctgctagctagctcttgtcttgtcactgagtgagcagcggggagctgtctagctagcctagtacaggtggagtggagtgtgtggtggagtgcaaaccacatccaaccaagaaaagtgggagccacgaggaataaaacaagaagaagaagacgacgacgacgcccaccaccagcagcaagcggcaatcagcagaacgaaatgtcgatcaagtactgccaccagcacaaggactgcgagcggcagcgtctgtaccgtcgcttctgcgccgccctggtgggcgtcatcgtgctcgtcctcctcatcgtgctcatcggctggctcgtcctccgccccaccaagcctcgcttcttcctcaacgacgtgagcatcgtgtgcatcaacgtcagctccgcctcctacctcaccgtcaccatgcaagccacgctggcgtcccgcaacaccaacaaccgcgtcggcatctactacgaccgcgccgacgtgtacgcctaccaccgggcgatgcagataacagcgcccaccgcgctgcccccccttctttccagcgacccaacaacgccgccagactggggcgcctttcctctccgccatcgaagggaccgctgcagcacttatcttttctcccggggatctcataaggacgaagatcggggggggtaccctgcttcgttagcaaatcccccttggaacaggaaggaattcccccctggaaaggcccgggggaccatttaaatttc

SEQ ID NO: 78680 - protein, 176 aa, Zea mays
  misc_feature: Ceres CLONE 1563677
  misc_feature (40)..(174): Pfam Name: Hin1 Pfam Description: Harpin-induced protein 1 (Hin1)
MSIKYCHQHKDCERQRLYRRFCAALVGVIVLVLLIVLIGWLVLRPTKPRFFLNDVSIVCINVSSASYLTVTMQATLASRNTNNRVGIYYDRADVYAYHRAMQITAPTALPPLLSSDPTTPPDWGAFPLRHRRDRCSTYLFSRGSHKDEDRGGYPASLANPPWNRKEFPPGKARGTI

SEQ ID NO: 78681 - DNA, 792 bp, Zea mays
  misc_feature: Ceres CLONE 1563678
  misc_feature: Encodes the peptide sequence at SEQ ID NO. 78682
  misc_feature (590)..(590): n is a, c, t, g, unknown, or other
  misc_feature (605)..(605): n is a, c, t, g, unknown, or other
gctcaccgcggtggcggccgctctagaactagtggatcccccgggctgcaggaattcgtctcacccctagaaaatctcgtctttgcgttgcgccgctgctttaaacaaacgtcaggtgaaggctgcggcacgcgtcccctcctccgcctccagtctccgcccatctcaaaaccctagcaaccgcgcctccacccctacccgaatcccaatccaggtccgatcccccggcggcgaggacacccggcgccgattcgtccccgcagatcggcgggcaggacagattcagattcgggttcggggtccgctcgggtcgcctcgccggggtccaccgcggcggtcagggagcatggtgggcggctggaggcggggtggagcggcggatgaggtcaagctcaacaccggcaacgtgttcgcggcgctcgagtccctcgagaagaagaagaagggcgacaaatgcaaggcggccggtgtctcctcgaggagaagcacggcgaggtggccgcgcagcgacaagagccacagcagaaggagctgttctgggcgcccgacgccactgacacaaagtcctggggcggacgtcgaggacgacnatcgacgacgattantgtcgccaccatcgcgcccgccgggccccgttttggggcactgcccggtgagccccgccagggaagaggaaagacgtccaattgattgctgtggggtgcccgccccttcaggagggactttggaaagtggataattgaggacccttgttttgatgaaggttgaaagaacggggcccctgagggatga

SEQ ID NO: 78682 - protein, 130 aa, Zea mays
  misc_feature: Ceres CLONE 1563678
  misc_feature (82)..(82): Xaa is any aa, unknown, or other
  misc_feature (87)..(87): Xaa is any aa, unknown, or other
MVGGWRRGGAADEVKLNTGNVFAALESLEKKKKGDKCKAAGVSSRRSTARWPRSDKSHSRRSCSGRPTPLTQSPGADVEDDXRRRLXSPPSRPPGPVLGHCPVSPAREEERRPIDCCGVPAPSGGTLESG

SEQ ID NO: 78683 - DNA, 818 bp, Zea mays
  misc_feature: Ceres CLONE 1563679
  misc_feature: Encodes the peptide sequence at SEQ ID NO. 78684
ctccccgcggtggcggccgctctagaactagtggatcccccgggctgcaggaattcgtctcacccctagaaaaagtcctaggtaccccgctgcttccgtgctcacctcgcctgctgggccgcagccgctggaagaacacgaagacgacaggagtgcggggtggcgtcgccgctggagcaccagctgtagccgccggctaggcctccgcgccgctctccgtggccaacgcgccgtcatgcttgctgcgttcggcgcggcggtctgtccaccgccacctcgttttcctcttcttcgatgcgatccagccagctcgccgccgtactgaagcagacagaggtggatgcaggacttgaacaagaaggcgatggagctggtggccaaggagaggagtgcactccaggaggtcgacctgcgtcatcgactacgaccgatgtcgtacgacaagcgccatcgtcccgcttctaaggggcgctaacgaaaactttgagctggctttgaagatcgacaatgggaatacaccatgcgaggcatgtggctgggaaaaatgcatctgaagtgatcacgttcctgatgcttagcgtgcaactggcgctgcggtgtctggataaaactgcaaagatgggtgatcttgatgcaggaatgtaacgtggatgtcgactactgttgagactgactctgctcagacagactcacgcgctgtcccttgcattgaagctcctgttaatgagcctgagccggaatgcttgttccttactccgtgctacatatctaactgggaacggggcaaaaaaaatacgggttccggcaaggggcgatgt

SEQ ID NO: 78684 - protein, 44 aa, Zea mays
  misc_feature: Ceres CLONE 1563679
MQDLNKKAMELVAKERSALQEVDLRHRLRPMSYDKRHRPASKGR

SEQ ID NO: 78685 - DNA, 721 bp, Zea mays
  misc_feature: Ceres CLONE 1563682
  misc_feature: Encodes the peptide sequence at SEQ ID NO. 78686
  misc_feature (351)..(351): n is a, c, t, g, unknown, or other
ctccccgcggtggcggccgctctagaactagtggatcccccgggctgcaggaattcgtctcacccctagaaaaaaacgccaaacatctggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgnttctgcacattgggaatcctcaatcccttggtcagcaacctgtgacgtttcttcaggggaagtttctttgctcttttggtgaatcatcccattgccctctttggaaaaaaagagggaaaaccaaaatccatttggttccagtggctggaaggcctatttcccccaagccaaagcaaaatttccttgccaactatttccctgggaccggggcaacaggggggggcattttaggcccccagggccggggggtttccaaaaagggattttgccgtggaatgccaaattttgccccgcccctggggaaatccccccctccaccggggggaaagggggaattttcccccccgggcaaaaatagtggcacaaatat

SEQ ID NO: 78686 - protein, 172 aa, Zea mays
  misc_feature: Ceres CLONE 1563682
  misc_feature: SWISSPROT Homolog: EC 2.6.1.2 Alanine transaminase
  misc_feature (50)..(50): Xaa is any aa, unknown, or other
MAPSVAVENLNPKVLKCEYAVRGEIVIHAQRLQQQLQTQPGSLPFDEILXLHIGNPQSLGQQPVTFLQGKFLCSFGESSHCPLWKKRGKTKIHLVPVAGRPISPKPKQNFLANYFPGTGATGGGILGPQGRGVSKKGFCRGMPNFAPPLGKSPPPPGGKGEFSPPGKNSGTN

SEQ ID NO: 78687 - DNA, 838 bp, Zea mays
  misc_feature: Ceres CLONE 1563683
  misc_feature: Encodes the peptide sequence at SEQ ID NO. 78688
  misc_feature (235)..(235): n is a, c, t, g, unknown, or other
  misc_feature (236)..(236): n is a, c, t, g, unknown, or other
  misc_feature (251)..(251): n is a, c, t, g, unknown, or other
  misc_feature (674)..(674): n is a, c, t, g, unknown, or other
  misc_feature (700)..(700): n is a, c, t, g, unknown, or other
  misc_feature (815)..(815): n is a, c, t, g, unknown, or other
  misc_feature (818)..(818): n is a, c, t, g, unknown, or other
ctggagctccccgcggtggcggccgctctagaactagtggatcccccgggctgcaggaattcgtctcacccctagaaaaaacagcgagtaccgagtaggagcaaccgcttgcgtcagacgcacactgacggagagtgatcactgatttctggtcatggcaaccgtaactgaggaagttgctccggtcgtcaccgtctccgaggagccggcgccggaagcggcgaaggaggtggtnnggagaagccggaggnaggggaagaagcccgacgaggagggtgacgagaggaagaaggccgaccccgccgccgagaaggagaagaaggcgaggaagccgcggagcaggaagcccaagtccgccgggctgcaccacccgccctatttcgaggtgagcaaagatgccgtcgtcgtcgtcgtcgtcttgtcggttactcatccgtgcttggattctcattctgatgatcggtcgctgtgtctgctggggacctggggtgatcgaggtcagatgatcaaggaggcgatcctgtcgcaggacggcgggaaggtcggggcgagcccgtacgcgatcgccaagcacatgaactcgatcggtctgctagtgttggagagaagaaatacactacagtactacatggcgaagcagcagcagcagggcatggcggcagtggcgctggtantgctggtggtgctggcggcgacggcngccgagacggcgtcggcggcttcgtgcacgccggcacctggggggggctggccccccggctatcactgcccgcgcgacgcccctccggcgtcgtgctgctcccacctcaaggggncancaggggtgctttctgccaat

SEQ ID NO: 78688 - protein, 228 aa, Zea mays
  misc_feature: Ceres CLONE 1563683
  misc_feature (28)..(28): Xaa is any aa, unknown, or other
  misc_feature (33)..(33): Xaa is any aa, unknown, or other
  misc_feature (174)..(174): Xaa is any aa, unknown, or other
  misc_feature (221)..(221): Xaa is any aa, unknown, or other
  misc_feature (222)..(222): Xaa is any aa, unknown, or other
MATVTEEVAPVVTVSEEPAPEAAKEVVXRSRRXGKKPDEEGDERKKADPAAEKEKKARKPRSRKPKSAGLHHPPYFEVSKDAVVVVVVLSVTHPCLDSHSDDRSLCLLGTWGDRGQMIKEAILSQDGGKVGASPYAIAKHMNSIGLLVLERRNTLQYYMAKQQQQGMAAVALVXLVVLAATAAETASAASCTPAPGGGWPPGYHCPRDAPPASCCSHLKGXXGVLSAN

SEQ ID NO: 78689 - DNA, 823 bp, Zea mays
  misc_feature: Ceres CLONE 1563685
  misc_feature (609)..(609): n is a, c, t, g, unknown, or other
ggagctccccgcggtggcggccgctctagaactagtggatcccccgggctgcaggaattcgtctcacccctagaaaaaagttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgagcgacatgccccgatgagtaggagggcgcggcggccgccgcaaaacccggggcgcgagcccgggcggagcggccgtcggtgcagatcttggtggtagtagcaaatattcaaatgagaactttgaaggccgaagaggagaaaggttccatgtgaacggcacttgcacatgggtaagccgatcctaagggacgggggaaacccggcagatagcgcgatcacgcgcgtcacccgaaagggaatcgggttaagatttcccgagccgggacgtggcggcagacggcgacgttaggaagtccggagacgccggcgggggcctcggggagaagtatcttttctgcttaacggcccgcaaccctggaatcggttcagccgggaggtagggtccagcngccgggaagagcaccgcacatcccggcggtgtcccggtgcgccccccggcggccccttgaaaaatcgggaggacccgatttccggtcccccccccggtccgtactcctaaaccgcatcaggggctcccaagggggacaacccttctggccatgggaacaatgttaggccaagggaaattccgcaaaaaagggatcccttaccttcggggaaaag

SEQ ID NO: 78690 - DNA, 774 bp, Zea mays
  misc_feature: Ceres CLONE 1563686
  misc_feature: Encodes the peptide sequence at SEQ ID NO. 78691
  misc_feature (679)..(679): n is a, c, t, g, unknown, or other
ctccccgcggtggcggccgctctagaactagtggatcccccgggctgcaggaattcgtctcacccctagaaaaatccgttcggatccgagtgtcctgcagagcccatcctgttcctgtccccctcgagcaatcgagctcagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgccccgccactggctgctgggggccacggacatcgtccctggctgacgggcaggaggaggccaagaccctggaggccaggctcacccaggtcagcgaggagaaccggcggctcaccgagatcatcgcctacatgtacgccagccaggtcgccgcgcagcggagtcccgacggcaggaagatgagcagggacagcctggagccgtcgaattcgagcgacgccaacgctgccgtcgagagcgccgccctcagcgacgatggcacgtgcaggcggatcaagctcaccagggtctgcaccaagatcgacccctgcgaacacacgctcgccgtcatagacggctaccagtgggcgcagtacggncagtaggtgacgcgcgactacccgtccccgagagcctacttccgctgcgcatacgcaccatcctgccccgtcaagaagaaagtgcagaagtacgc

SEQ ID NO: 78691 - protein, 164 aa, Zea mays
  misc_feature: Ceres CLONE 1563686
MMLLMDSGSRGDCSPVCLDLSVGLSPPSPGSGPETTADAERLDRPATGCWGPRTSSLADGQEEAKTLEARLTQVSEENRRLTEIIAYMYASQVAAQRSPDGRKMSRDSLEPSNSSDANAAVESAALSDDGTCRRIKLTRVCTKIDPCEHTLAVIDGYQWAQYGQ

SEQ ID NO: 78692 - DNA, 681 bp, Zea mays
  misc_feature: Ceres CLONE 1563687
  misc_feature: Translation starting site: 145
  misc_feature (60)..(60): n is a, c, t, g, unknown, or other
  misc_feature (82)..(82): n is a, c, t, g, unknown, or other
  misc_feature (83)..(83): n is a, c, t, g, unknown, or other
  misc_feature (350)..(350): n is a, c, t, g, unknown, or other
  misc_feature (355)..(355): n is a, c, t, g, unknown, or other
  misc_feature (361)..(361): n is a, c, t, g, unknown, or other
agctccccgcggtggcggccgctctagaactagtggatcccccgggctgcaggaattcgntctcacccctagaaaaaagccnntcccattcatcagattcagatcagatcgtagcagccaaggattccgcgctccgggggtgccatgaagctgaagctcctctctccctgccttctcctcctcgccttctttgccaccgcggcgtacgcggcgtcggcgtctgcgtctcgcgcgggacggccgtcgttcaagatgcgcgggcgccccgtcacagtcagagttggagtcagacccggaggaaccagtgcgtgtacacggtgtacgtgctgacggggtccatctggaaggcngcacngactcnaccatcagggtgacgctgctggggccctaacgctacggcatcccgatcctggacctgccgggttggggctgccccatagggcgcgggcagaactactacaaaccccggaaacttgaaattttcagggggcgggggcccccttctggaaccagggccccctggcccagtaaaccttcccccccaaaaggcacccggggcccaaccccgggtgggggaacttccaaaccccccccggggggcccggggtttacggggggccccccacccttggggggtgggcccccccaaaaaatttttttttcccccgcgggaaaaaaagg

SEQ ID NO: 78693 - DNA, 749 bp, Zea mays
  misc_feature: Ceres CLONE 1563688
  misc_feature: Encodes the peptide sequence at SEQ ID NO. 78694
ctcaccgcggtggcggccgctctagaactagtggatcccccgggctgcaggaattcgtctcacccctagaaaaacccggcgacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctcttcgatagggcgtcgcggctccacgccctggcctccagctccgccctcgaccaggtgcctccctcctctctcttctgggaactggggtcgtctcgcccttcttccgctcacccagagattgagatcgggtgagcggtgcttacgcgcttggtttttttttccgccgcgcaggatgggatccgcacgggggttgacctgctgcggcgctgcgatgacatggtcagcaagctcggcctcttctcccccaacgagaccaaggaggacgtctccacagcaaacctcaagtacctactggtcccatattaccttgcagaaatgaccgaaaaatagcacaggaggatcggatcccggttcttaagacgtcacaggaccatctggaagagttcattgcttctatgtgaagtactagagcttatcccagaggatgagctagaattgtctaggcagaa

SEQ ID NO: 78694 - protein, 76 aa, Zea mays
  misc_feature: Ceres CLONE 1563688
MVDVEETGNKLQSQMRLHAEPEDDAADLPLPALFDRASRLHALASSSALDQVPPSSLFWELGSSRPSSAHPEIEIG

SEQ ID NO: 78695 - DNA, 899 bp, Zea mays
  misc_feature: Ceres CLONE 1563689
  misc_feature: Encodes the peptide sequence at SEQ ID NO. 78696
  misc_feature (395)..(395): n is a, c, t, g, unknown, or other
  misc_feature (407)..(407): n is a, c, t, g, unknown, or other
  misc_feature (414)..(414): n is a, c, t, g, unknown, or other
ccccgcggtggcggccgctctagaactagtggatcccccgggctgcaggaattcgtctcacccctagaaaaaatcgctcatcacagataaatcttttttcccctccatttcatttcagcgtcgcgaaaaatggtagtcgttgatccgaaagccgtcgcctcggcgcaccagttcaccgtggtaatcgacggcgtcgagacgaccgtccacgagggcgtgctccggcgcaacggcggcacggtggccgtggtcggcccgggcgtcctcgaggtgagccgtctccagcacgtggtggtgcgcggcgggggcgggggcgacgtgcgcttctcccggtgcctgtacgcggccgccgaggactgcggcgcggcgtcgttccaccggtgcgacgcgtgcgnccttgggagggngcccgcncccttggcccgtggcccgggggccgggtcggctgagaggggagggcgcggggccccggtggcccatcccgctcgcggggaggggggggcctgccttgaggtcaggcggccgacggggggaagcttgcgggggtggggggcgggggccggggcgtggtggccggaccttggggggtcgggggggggccgaacgggtgtccctgggggggccggcgggttctctcgtgcccgcgggggggccgcaacctgtgccgcaggtccattcgggctccggccgcggcgagcggcggagagtgcccccggacgaatcgcggagggcggggcgaccggaaggtgccggccgtccatctaggtcggcgagggggctgcgggggtcagcggggggcccaaacggtgggcggaccaagtccggacggggagggggtggggcgagcgaataccggagggggggggcgcgcgggggagagggtgggaggagggcggact

SEQ ID NO: 78696 - protein, 211 aa, Zea mays
  misc_feature: Ceres CLONE 1563689
  misc_feature (89)..(89): Xaa is any aa, unknown, or other
  misc_feature (93)..(93): Xaa is any aa, unknown, or other
MVVVDPKAVASAHQFTVVIDGVETTVHEGVLRRNGGTVAVVGPGVLEVSRLQHVVVRGGGGGDVRFSRCLYAAAEDCGAASFHRCDACXLGRXPAPLARGPGAGSAERGGRGAPVAHPARGEGGACLEVRRPTGGSLRGWGAGAGAWWPDLGGSGGGRTGVPGGAGGFSRARGGAATCAAGPFGLRPRRAAESAPGRIAEGGATGRCRPSI

SEQ ID NO: 78697 - DNA, 815 bp, Zea mays
  misc_feature: Ceres CLONE 1563690
  misc_feature: Encodes the peptide sequence at SEQ ID NO. 78698
ctccccgcggtggcggccgctctagaactagtggatcccccgggctgcaggaattcgtctcacccctagaaaaaatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaacacccgcccccaagcgggccatggccgccgcccgcaagtcaaagaatgcagcggctgccaagcaaagaatgcccgctgctgctgggacaaagcgcaaagtggccgaaaagtaggtcgttgccgaaacccaataaagtcccccgcccgccaaggcaagggccaacccaagaaccgggaaatcccctgccttcaaagaagggaccgaaagccctccccatgaaaatggggttgctttagggccaaaccccccgatttgtgggtttggggccaaa

SEQ ID NO: 78698 - protein, 198 aa, Zea mays
  misc_feature: Ceres CLONE 1563690
  misc_feature (35)..(105): Pfam Name: Linker_histone Pfam Description: linker histone H1 and H5 family
MPALAKPASRTAKPAAAPKPKPAAAKPKAATAGASHPPYFEMIKEAITALKERTGSSSQAIAKYVGDKHGASLPANFKKMLSIQLRGSAAKGKLVKVKASYKLSDAAKKASPKTKAKPAKAAAAKNTRPQAGHGRRPQVKECSGCQAKNARCCWDKAQSGRKVGRCRNPIKSPARQGKGQPKNREIPCLQRRDRKPSP

SEQ ID NO: 78699 - DNA, 842 bp, Zea mays
  misc_feature: Ceres CLONE 1563691
  misc_feature: Translation starting site: 174
  misc_feature: SWISSPROT Homolog: EC 1.1.1.37 Malate dehydrogenase
  misc_feature (722)..(722): n is a, c, t, g, unknown, or other
ggagctccccgcggtggcggccgctctagaactagtggatcccccgggctgcaggaattcgtctcacccctagaaaaagctatcccttggttgccgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtcgaaaaatgtttcaatctacaaatcccaagcatctgcccttgaagcccatgcagctcccaactgcaagggttctggtggttgccaacccagcaaacaccaatgctcttatctttgaagaatttgctccatctattccagagaagaacgttactttgcctgacccgtctggaccacaacaggggctctgggcagatttctgagagacttatggtccaagttagtgatgtgaagaatgttnatcatcgggggtaaacactcgtcctctcagtaccctgatgttaacatgccacagtgaagacttccactggggaaaagcctgttcggaaccctgtctcctgaagacgaggggcttaatggg

SEQ ID NO: 78700 - DNA, 827 bp, Zea mays
  misc_feature: Ceres CLONE 1563692
  misc_feature: Translation starting site: 124
  misc_feature: SWISSPROT Homolog: EC 1.11.1.7 Peroxidase
  misc_feature (674)..(674): n is a, c, t, g, unknown, or other
  misc_feature (702)..(702): n is a, c, t, g, unknown, or other
ggagctccccgcggtggcggccgctctagaactagtggatcccccgggctgcaggaattcgtctcacccctagaaaaaatcatgcatcagcagcagcagcacgaaaccctgtagtagcctgccatgactacgcgctgctgcctggtcgtcgccactctcctcgcggcgctgctctcggtcagtgccagcctcgagttcggtttctacaacaagacgtgccccagcgccgagaccatcgtgcagcagaccgtggccgccgcgttcaccaacaactccggcgtcgctccggcgctcctccgcatgcacttccatgactgcttcgtcagaggctgcgacggctcggtgctgatcgactccacggccaacaacaaggcggagaaggactcgatccccaacagcccgagcctgaggttcttcgacgtggtggaccgcgccaaggcgtccctggaggcgcggtgccccgggcgtggtgtcctgcgccgacatcctcgccttcgcggccagggacagcgtcgtgctcaccggcggcctcggctacaaggtgccgtccggacgccgtgacggccggatatccaatgccacgcagtccctgaacgagctgcccccgcccttcttcaaacgcacccactcgtcgacaacttcgcctccaagaactcagcctcgaaggacatggntgtccctctcggcgcacacaccatcggnggtctcgcactgcaacagcttcgccgggaattacaacacaggcgaccggctcttacaacttcagtggctcatcccgaacgggattggatcctgcccttgaacaaagccctaccccgttctccccc

SEQ ID NO: 78701 - DNA, 786 bp, Zea mays
  misc_feature: Ceres CLONE 1563693
  misc_feature: Encodes the peptide sequence at SEQ ID NO. 78702
  misc_feature (681)..(681): n is a, c, t, g, unknown, or other
  misc_feature (683)..(683): n is a, c, t, g, unknown, or other
  misc_feature (775)..(775): n is a, c, t, g, unknown, or other
ctccccgcggtggcggccgctctagaactagtggatcccccgggctgcaggaattcgtctcacccctagaaaaaaccgtcccacgacccttgtgtgtgtgtgttttttttttttttttgaccctcggcctccggtcttagaacccagttctttcgtagttttcgttcttccgcgtttccacttattcttttgaaggcagaggcagctatatcagtactccagtgttctcgactctcgagtcttgctgcatcccagttccccaacaagagcggcacggggatcctagagcagcagacattcgctttgcaatggtgttctgcgcggatttcgctgccctccggccgtcgccggccgacgtccgtgtcgtcacgtccgacgggagcgccatccgtgcgcattgctccgttcttgccgcggcgtccccggtgctggagcggatgatcgagggcgcgcgccgcgggtgggacgccggctgcaccgtccacgtcctcggcgcgcccgccgacgccgttgccgccttcctccgcctcctctactccagccccagcagggcggaggacgcggtgggggcgcacggggcggcgctgctggcgctggcgcacgcgtaccgcgtcccgtggctgaagcggcgcggggaagccgcggtggcggcgcgcctgaccgcggagcgcgcggtggacncnctgaaagctgccgcgctctgcgacgcgcggcggctgtacctggcgtgcgcgcgcctcgcgggcaaagacctggacgcccgtggagcggtccnaaggggtgggg

SEQ ID NO: 78702 - protein, 159 aa, Zea mays
  misc_feature: Ceres CLONE 1563693
  misc_feature (10)..(117): Pfam Name: BTB Pfam Description: BTB/POZ domain
  misc_feature (125)..(125): Xaa is any aa, unknown, or other
  misc_feature (156)..(156): Xaa is any aa, unknown, or other
MVFCADFAALRPSPADVRVVTSDGSAIRAHCSVLAAASPVLERMIEGARRGWDAGCTVHVLGAPADAVAAFLRLLYSSPSRAEDAVGAHGAALLALAHAYRVPWLKRRGEAAVAARLTAERAVDXLKAAALCDARRLYLACARLAGKDLDARGAVXRGG

SEQ ID NO: 78703 - DNA, 828 bp, Zea mays
  misc_feature: Ceres CLONE 1563696
  misc_feature: Encodes the peptide sequence at SEQ ID NO. 78704
  misc_feature (238)..(238): n is a, c, t, g, unknown, or other
ctggagctccccgcggtggcggccgctctagaactagtggatcccccgggctgcaggaattcgtctcacccctagaaaaagtcacagcgagtaccgagtaggagcaaccgcttgcgtcagacgcacactgacggagagtgatcactgatttctggtcatggcaaccgtaactgaggaagttgctccggtcgtcaccgtctccgaggagccggcgccggaagcggcgaaggaggtggtnggagaagccggaggaggggaagaagcccgacgaggagggtgacgagaggaagaaggccgaccccgccgccgagaaggagaagaaggcgaggaagccgcggagcaggaagcccaagtccgccggactgcaccacccgccctatttcgagatgatcaaggaggcgatcctgtcgcaggacggcgggaaggtcggggcgagcccgtacgcgatcgccaagcacatgggggagaagcaccgggacgtgctcccgcccaattaccgcaaggtgctggcagtgcagctgcgcggcttcgccgccaagggccgcctcgtcaaggtcaaggcttccttcaagctcgccgccgccgaggagaggaagccctccgcggccgcgaaggcgaagaagaaggcgtcggcgggaatggccaagcgcaagagggccgccgcgccggccaagaagaagcctgcggccgctgcctcggcgccgtcgagggaggcacgtaaggtgcgcgcgagcgagcgaagtaggtgggccctgcgcccgcgcagccccagcccagccagcccgcgccggcggcttccggtcccgggcagaaggtcaactaggccgc

SEQ ID NO: 78704 - protein, 147 aa, Zea mays
  misc_feature: Ceres CLONE 1563696
  misc_feature (1)..(65): Pfam Name: Linker_histone Pfam Description: linker histone H1 and H5 family
MIKEAILSQDGGKVGASPYAIAKHMGEKHRDVLPPNYRKVLAVQLRGFAAKGRLVKVKASFKLAAAEERKPSAAAKAKKKASAGMAKRKRAAAPAKKKPAAAASAPSREARKVRASERSRWALRPRSPSPASPRRRLPVPGRRSTRP

SEQ ID NO: 78705 - DNA, 819 bp, Zea mays
  misc_feature: Ceres CLONE 1563699
  misc_feature: Encodes the peptide sequence at SEQ ID NO. 78706
  misc_feature (713)..(713): n is a, c, t, g, unknown, or other
ctggagctccccgcggtggcggccgctctagaactagtggatcccccgggctgcaggaattcgtctcacccctagaaaaaacgagttcaaaccaattttctaggtgccaaatggaaagcgtagtccaaccaaagtggaaagtgtgaccgggatccccatccgttccagcccccccagaacccagagctccaaacctaggccggagccgcggtgcaagcagctacgtggattggacttggacgtctggctctggaggtcccaagttcccaacgcttgctggagttgagatctggtgggcttccggaggagacgccgacggtttgcgaggtttgctggctccgtggcgtcgcggaaggtcatggagcaccgcgccttctactgcagcgggagtgatgatgatctccctccaacatatcaaattagagtaccgagaatgcatttcagtgggaacagaaggcaattagcaggcccattttctcagccaagaccacacaacaagttggatagcgatatacatcagattgagcaacaggcatatactggtgttcttagagcattcaaaatgcaatcggatgccctgacatgggaaaaagaaagtctaattactgaactaagaagagagttgaaagtctctgatgtggaacacaggatgctattaaacatggtcaatgaagaggaggctatccatagaataaggcagtcaaggcaggggnatgtggaatgcaatctagcttgccttataaatagcgtagtttgatcacaacctttggacctatcaagcggcagaagaaatcacatcccatctattcactccctggg

SEQ ID NO: 78706 - protein, 132 aa, Zea mays
  misc_feature: Ceres CLONE 1563699
  misc_feature (48)..(121): Pfam Name: ENT Pfam Description: ENT domain
  misc_feature (119)..(119): Xaa is any aa, unknown, or other
MEHRAFYCSGSDDDLPPTYQIRVPRMHFSGNRRQLAGPFSQPRPHNKLDSDIHQIEQQAYTGVLRAFKMQSDALTWEKESLITELRRELKVSDVEHRMLLNMVNEEEAIHRIRQSRQGXVECNLACLINSVV

SEQ ID NO: 78707 - DNA, 826 bp, Zea mays
  misc_feature: Ceres CLONE 1563700
  misc_feature: Translation starting site: 467
  misc_feature (439)..(439): n is a, c, t, g, unknown, or other
  misc_feature (798)..(798): n is a, c, t, g, unknown, or other
ctggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagnctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgttatctgggcctgcccagtcgtgctcatggggcgccgtcgagggctaccgcatcgccggcggcccgcttcggggaagtcgtcgacccgctctaccccggcggcagcttcgaccccgctcggcctcgccgaacgacccggaggcctcgccgagctcaaggtcaaggagctcangacggcccgctcggccatgtcccccatt

SEQ ID NO: 78708 - DNA, 739 bp, Zea mays
  misc_feature: Ceres CLONE 1563701
  misc_feature: Encodes the peptide sequence at SEQ ID NO. 78709
ctccccgcggtggcggccgctctagaactagtggatcccccgggctgcaggaattcgtctcacccctagaaaaagttcccaaatcccgtcccctccacccgcactccattggcgccgctcccctcccctcgccgccgccggagatctgatccgatccgatccgatccgtttgtgcttgtgctgcagcaggagtgagaagtaaaaaaatatggctgccctgccactggccaccgccgaagtatgcgacgctaaccctcacctgatcatgaacggcgagctccgcgcgctccagccaatcttccagatctacggacggcgccaggtcttcgccggccccatcgtcacgctcaaggtctacgaggacaacgtcctggtccgcgagttcctcgaggagaaaggccacggtagggtcctcgtggtcgacggcggcggcagcatgcgctgcgccatccttggcggcaaccccgtccagcaggcgcagaacaacgggtgggctggtatcctggtcaacggctgcatcagggacgtggatgagatcaacggctgcgacatcggtgtccgggctctcagctcgcaccctatgaaagccacaagaaggggatgggcgagaagcacgtcccccgtcacatcgctggaaaccaggatttgcgacggcgaagtggctctacgcccgatcccggatggcatttcttgtctcccaggacgggaacctcaccgtggtagaacagacacctggttt

SEQ ID NO: 78709 - protein, 177 aa, Zea mays
  misc_feature: Ceres CLONE 1563701
  misc_feature (4)..(154): Pfam Name: Methyltransf_6 Pfam Description: Demethylmenaquinone methyltransferase
MAALPLATAEVCDANPHLIMNGELRALQPIFQIYGRRQVFAGPIVTLKVYEDNVLVREFLEEKGHGRVLVVDGGGSMRCAILGGNPVQQAQNNGWAGILVNGCIRDVDEINGCDIGVRALSSHPMKATRRGWARSTSPVTSLETRICDGEVALRPIPDGISCLPGREPHRGRTDTWF

SEQ ID NO: 78710 - DNA, 565 bp, Zea mays
  misc_feature: Ceres CLONE 1563704
ggggctccccgcggtggcggccgctctagaactagtggatcccccgggctgcaggaattcgtctcacccctagaaaaattctttcttcccgtcctgtcctggtgtcctgtcctgtccacctctcctccgactccgatcctctccgccatttccctgcgcttctggaactgttgttctaaacccccaaaccctaacggcctaacctctgcgctgcggctcgcacgcggactgcgcatgacgcttccgtctcgggactgaccactctctcgtcctctgctctctcagatctcgcaccagtctgctaaggtgttcaggaaacccagacctgacatgttgggttcggggaaggtacccaaactttttcagggaaaagttccggtttaaaattgggggtaaaaaagggggttcccccccccccccccgggaatttgttggggtcttcccccccccccccccgggggcggggggatttctcccaaagggggggggggcccccttcccccccccgggggggtttttttcccccccccgtttttctgttccgggcccgaaaattttccccaac

SEQ ID NO: 78711 - DNA, 799 bp, Zea mays
  misc_feature: Ceres CLONE 1563705
  misc_feature: Translation starting site: 187
  misc_feature: SWISSPROT Homolog: EC 3.4.22.14 Actinidain
ctccccgcggtggcggccgctctagaactagtggatcccccgggctgcaggaattcgtctcacccctagaaaaagaaaaggaaggaagaagggcctcctgtatcctctcacttccctcagtcctcgtccgtctgctccctcctctctctacctagctctagctagccttcctgtagcgcggcagagatggctgcccctgcctccaccacggcggcggcggcggcagcgctgctgctgctgctcctcctgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgccgccgacgcgggcgtccactccttccgcctcggcctcaaccgcttcgccgacctcaccaacgacgagtaccgcgccacctacctcggcgccaggaccaggccgcagagggagaggaagctcggcgccaggtaccacgccgccgacaacgaggacctgccggagtccgtcgactggagggccaagggcgccgtcgccgaggtcaaggaccagggcagctgcgggagctgttgggctttctcaacaatagcagctgtggaagcatcaaccagattgttacaggcgacttgatctccttgtctgaacaagagcttgtcgactgtgacacttcgtaacatcaggggtgcaatggaggtctgatggacta

SEQ ID NO: 78712 - DNA, 820 bp, Zea mays
  misc_feature: Ceres CLONE 1563706
  misc_feature: Encodes the peptide sequence at SEQ ID NO. 78713
ctggagctccccgcggtggcggccgctctagaactagtggatcccccgggctgcaggaattcgtctcacccctagaaaaagtgaaccacgggtgttgttcacatttggtaccagagccaatactggatcctccacacgggtactggacgagatcgcaatcgaagttgggcggcatggcgccagcgaagacggacgatcctttgtcccagcttctggcgaagatcgaggagggaaacaaggagactcaccgacgcatggaggcgattcagggggcggtgggaaatatggaggcggcggtcaaggtggtgatgacggagcagggagatcttcagaagtggaaaccggaggtggaagcgaaagtgacggagatttctgatgctctaaaggcgatccagatccagatgggaaagatggagaagaagccgctcggtttcgggtcgagacaggaagaagaaggagaagacggatttctgaagccgccaccatctgattcttcgaatttggagtttcgtcgtgaagaagggcggacccaattctcgcatggagtattgggcatgaactggatccagcaatacagtccgatgaaggtggattgggcgaacaagtgggcagtcattccatataatggatcgccagcatacttgcaaggtgtgcaagtgacattaccaggcggcgctgtcaccgaatttttgctcttggcagggaatcacaagctacacccgctggacaatcggtcgatccaaaatcccaacagttctggatcacatccgggaggtttttgaggaatcattcggctttcacccaagaaaaatgggacccc

SEQ ID NO: 78713 - protein, 202 aa, Zea mays
  misc_feature: Ceres CLONE 1563706
MAPAKTDDPLSQLLAKIEEGNKETHRRMEAIQGAVGNMEAAVKVVMTEQGDLQKWKPEVEAKVTEISDALKAIQIQMGKMEKKPLGFGSRQEEEGEDGFLKPPPSDSSNLEFRREEGRTQFSHGVLGMNWIQQYSPMKVDWANKWAVIPYNGSPAYLQGVQVTLPGGAVTEFLLLAGNHKLHPLDNRSIQNPNSSGSHPGGF

SEQ ID NO: 78714 - DNA, 791 bp, Zea mays
  misc_feature: Ceres CLONE 1563707
  misc_feature: Encodes the peptide sequence at SEQ ID NO. 78715
  misc_feature (766)..(766): n is a, c, t, g, unknown, or other
ctccccgcggtggcggccgctctagaactagtggatcccccgggctgcaggaattcgtctcacccctagaaaattttcctctctgctagctagctcttgtcttgtcactgagtgagcagcggggagctgtctagctagcctagtacaggtggagtggagtgtagtggtggagtgcaaaccaaatcaaacgaagaaaagtgggagcgaggaggaagaaaagaagaagaagaagacgacgaccacgcccaccaccagcagcaagcggcaatcaacagaacgaaatgtctatcaagtactgcgaccagcacaaggactgccagcggcagcgtctgtaccgtcgcttctgcgccaccctggtgggcgtcatcgtgctcgtcctcctcatagtgctcatcgtctggctcgtcctccgacccaacaagcctcgcttcttcctcaacgaggtgagcatcgtgtgcatcaacgtcagctccgcctcctacctcaccgtcaccatgcaagccacgctggagtcgcgcaacaccagaagaccgcgtcggcatctactacgaccgcgccgacgtgtactccgagtaccgggcgatgcagatcacagtgcccaccgcgctgccactcttcttccagccgaccaaccacgccgcaggatgggcgcccttcctctccgcctccaacggaccgctgccgacctacctctttgccgggatcaaacaagacaagacggcggggtacctgatcgtcaccaatccccttgaacagaagaatactnctgaaaagccgggggccattatttc

SEQ ID NO: 78715 - protein, 69 aa, Zea mays
  misc_feature: Ceres CLONE 1563707
  misc_feature (62)..(62): Xaa is any aa, unknown, or other
MQITVPTALPLFFQPTNHAAGWAPFLSASNGPLPTYLFAGIKQDKTAGYLIVTNPLEQKNTXEKPGAII

SEQ ID NO: 78716 - DNA, 855 bp, Zea mays
  misc_feature: Ceres CLONE 1563710
  misc_feature: Encodes the peptide sequence at SEQ ID NO. 78717
  misc_feature (531)..(531): n is a, c, t, g, unknown, or other
  misc_feature (549)..(549): n is a, c, t, g, unknown, or other
  misc_feature (550)..(550): n is a, c, t, g, unknown, or other
  misc_feature (609)..(609): n is a, c, t, g, unknown, or other
  misc_feature (616)..(616): n is a, c, t, g, unknown, or other
ggagctccccgcggtggcggccgctctagaactagtggatcccccgggctgcaggaattcgtctcacccctagaaaaagcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcggcggctangtggtgtgaggaaaaaannggggggggggggtggcggtggctatgggggggtggtgaaggctaagggtggtggtgggnggcggcngttggattacggtggcggccgactatgggtgccaaccgcaacaggggtgggtggtgttggattaaggaagtttccgggggggaaaaggtgaaagcaccctttttctgggtggagggtaggaaccagtttttccaaaaggtaaattttgggttttgaaaaatgatttttggggggaaaaggggccttgggggcttttgtagaaacccggcgggtttccaaaaagaaattaataggtgttt

SEQ ID NO: 78717 - protein, 126 aa, Zea mays
  misc_feature: Ceres CLONE 1563710
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (124)..(124): Xaa is any aa, unknown, or other
MALANKLGGLLKKATSSNLSVYQAIRCMSSKLFVGGISYQTDDHSLRDEFAKYGQVIEARIIIDRESGRSRGFGFVTYTSSEEASAAITALDGKTLDGRSIRVNHANEKTGGFRGGGGYGGGGXVV

SEQ ID NO: 78718 - DNA, 829 bp, Zea mays
  misc_feature: Ceres CLONE 1563712
  misc_feature: Encodes the peptide sequence at SEQ ID NO. 78719
  misc_feature (593)..(593): n is a, c, t, g, unknown, or other
  misc_feature (616)..(616): n is a, c, t, g, unknown, or other
ggagctccccgcggtggcggccgctctagaactagtggatcccccgggctgcaggaattcgtctcacccctagaaaaaacaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtccngtgtgggaagcgctggtgctggnaaatcgtgatgaccttccgggctggtggtacacggtgtacgccacgggcggtggacccgaagaagggcagcctgggcaccatcgcccccattgccatccggcttcatcgtggggcaacatcccccggggggggcggggcctttcaacggcgcgtcattgaaacccccggcgtggtccttcggccccggccctcgttaagctgggaaagggggg

SEQ ID NO: 78719 - protein, 149 aa, Zea mays
  misc_feature: Ceres CLONE 1563712
  misc_feature (13)..(148): Pfam Name: MIP Pfam Description: Major intrinsic protein
  misc_feature (140)..(140): Xaa is any aa, unknown, or other
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTGGQATGTFGLTGVSXVGSAGAGKS

SEQ ID NO: 78720 - DNA, 848 bp, Zea mays
  misc_feature: Ceres CLONE 1563715
  misc_feature: Translation starting site: 192
  misc_feature: SWISSPROT Homolog: EC 3.1.3.11 Fructose-bisphosphatase
  misc_feature (661)..(661): n is a, c, t, g, unknown, or other
  misc_feature (743)..(743): n is a, c, t, g, unknown, or other
ctggagctccccgcggtggcggccgctctagaactagtggatcccccgggctgcaggaattcgtctcacccctagaaaaagtgcccgcgcgctctttgcactccgtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctgggaggacgtgctgncaccctggcagaacatgctcgccgccggatactgcatgtacggcagttcctgcacgctcgttctgacacctggaactggtgntcatggctccacgctcgacccttccacttgggggagtcatactaacccatccagacatcaggatacctagaaaagggaagatcttttcagtcaaccgaggggacc

SEQ ID NO: 78721 - DNA, 831 bp, Zea mays
  misc_feature: Ceres CLONE 1563716
  misc_feature: Encodes the peptide sequence at SEQ ID NO. 78722
  misc_feature (416)..(416): n is a, c, t, g, unknown, or other
  misc_feature (492)..(492): n is a, c, t, g, unknown, or other
ctccccgcggtggcggccgctctagaactagtggatcccccgggctgcaggaattcgtctcacccctagaaaaagtgcgcgatggagggtgacgagaagtcggcgggcggggcccctgcttactggggcctgggcgcgcggccctgcgacgcgtgcggcgcctaggcggcgcgcctctactgccgcgcggacgcggcgttcctgtgcgccgggtgcgatgcgcgggcgcacggcgccgggtcgcgccactcgcgagtctggctctgcgaggtctgcgagcacgcgccggcggcggtcacgtgccgcgcggacgctgccgcactctgcacctcctgcgacgccgacatccactcggcgaacccgctcgcgcgccgccacgagcgcctactcttggcgcccttcttacgtggtgtggncgacgcgtccgagcccttcgcctcagcagctgcgcccagatcaaccgacgaccacaggagcaacgcagacgaagcnggcatcaatggctcctcccctaaccagaacaccgacagaaagatggacccacgacgtgaagtgttcttcgcagactctaaacctgtacgtaatacttccaactgccgctgttccaaggaccaaatccataccttcgcggttccgggggagcaggggccccatacctcggaccctaggggaacctaatccttgcaaatcaaatcagtcgtttgaacaaacgttggtctccttcaaaaggaaggagtttgtcccaaaaccaagattctggccatggccccccaaagttggaaagtgcccaaaacgggtcctttaaaccgggagggcccccgcttaaccccc

SEQ ID NO: 78722 - protein, 47 aa, Zea mays
  misc_feature: Ceres CLONE 1563716
MDPRREVFFADSKPVRNTSNCRCSKDQIHTFAVPGEQGPHTSDPRGT

SEQ ID NO: 78723 - DNA, 824 bp, Zea mays
  misc_feature: Ceres CLONE 1563717
  misc_feature: Translation starting site: 144
  misc_feature (546)..(546): n is a, c, t, g, unknown, or other
  misc_feature (638)..(638): n is a, c, t, g, unknown, or other
  misc_feature (671)..(671): n is a, c, t, g, unknown, or other
  misc_feature (673)..(673): n is a, c, t, g, unknown, or other
  misc_feature (728)..(728): n is a, c, t, g, unknown, or other
ctccccgcggtggcggccgctctagaactagtggatcccccgggctgcaggaattcgtctcacccctagaaaaactcccgcagagccgccgacaactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactgagatccctagtgaagaagtggcagacattaatcgaagcccatgttgatgtcaagacaaccgacaactacatgnttgcgtttgttctgcatcggcttcacgaagaggcgcccaaaccaggtcaagagaacctgctatgctcaggcatcccagatccgtcagatccngccgtaagatggttgaagattatgatcaaacangncttctacatgtgaccctgaaagaaccttgtttcgaagttcattccagaaagttantgggtaaggaagattggagaaatctaccttccagcatcttcccaacttcaaaacgtctttcatcccgcaaggtgaagatactcaaggccccccaat

SEQ ID NO: 78724 - DNA, 804 bp, Zea mays
  misc_feature: Ceres CLONE 1563719
  misc_feature: Encodes the peptide sequence at SEQ ID NO. 78725
  misc_feature (667)..(667): n is a, c, t, g, unknown, or other
  misc_feature (668)..(668): n is a, c, t, g, unknown, or other
  misc_feature (681)..(681): n is a, c, t, g, unknown, or other
  misc_feature (706)..(706): n is a, c, t, g, unknown, or other
  misc_feature (721)..(721): n is a, c, t, g, unknown, or other
  misc_feature (804)..(804): n is a, c, t, g, unknown, or other
ctccccgcggtggcggccgctctagaactagtggatcccccgggctgcaggaattcgtctcacccctagaaaaaacctgggcggcgatggcgaccgccgcgagggagaggcgcctgccgccggcgctgcccctggcgactctcatcggccgggagctccgcgcggggggctccgagcgcccggccctgcgctacggccacgccggctttgccaagcgtggcgaggactacttcctcgtcaagcccgactgcctccgcgtccccggggaccccgcatccgcgttctccgtctttgccgtgttcgacggccacaacggcgtgtcggcggcggtctacagcaaggagcatctgctcgagcacgtcatgagcgcgctgtcgccggacatcggccgcgaagactggctgcaggcgctgccgcgcgcgctcgtcgccggcttcgtcaaggccgacatcgatttccagcgcaagggggaggtgtccggaaccacggcgacactggtggtcatcgatgggttcacggtcacggtggcgtcggtgggtgactcgcgctgcatcctggacacgcagggcggcgagttgcagctgctaaccgtggaccaccgcctggaggagaatgcagaggagcgggagcgcgtcacggccagccggtggggaaagtaggcccggcnntcatctctttggncggccagggagtcggcccctctccnggtgctggccctggntggcttgtggcctctcaggatccatcgggggactgggattgtttggaaaaattccattgttgcccattcccaacatgtcaagn

SEQ ID NO: 78725 - protein, 190 aa, Zea mays
  misc_feature: Ceres CLONE 1563719
  misc_feature: SWISSPROT Homolog: EC 3.1.3.16 Phosphoprotein phosphatase
MATAARERRLPPALPLATLIGRELRAGGSERPALRYGHAGFAKRGEDYFLVKPDCLRVPGDPASAFSVFAVFDGHNGVSAAVYSKEHLLEHVMSALSPDIGREDWLQALPRALVAGFVKADIDFQRKGEVSGTTATLVVIDGFTVTVASVGDSRCILDTQGGELQLLTVDHRLEENAEERERVTASRWGK

SEQ ID NO: 78726 - DNA, 909 bp, Zea mays
  misc_feature: Ceres CLONE 1563720
  misc_feature: Encodes the peptide sequence at SEQ ID NO. 78727
  misc_feature (832)..(832): n is a, c, t, g, unknown, or other
tggagctccccgcggtggcggccgctctagaactagtggatcccccgggctgcaggaattcgtctcacccctagaaaaagaaattttccgtttgcacctaccgagaggtgacgacgagtgaggagtctgtgtgaccagtgctcgccgtcgtcccctgcctctggccctctgctagccgctaggcgacgggcctttcgccgggcgacgggcacaccgcccctgttaccatggcagcgatgaatactggtatgggaggtttaggtggcaggccgatacattcacaagcaaatccttttggaactgccttgcagggtgctggaccaggattgatccgtactgggctagaaacatatggcggaaggattttagattcaagttctgagtttatgcagagcaatataacacaatatttgtccgaccctcagtactactttcaagtcaacagccagtatgtgaggaacaaactgaaggtcatcttgttccctttcttgcacaggggtcactggacaagaataactgaaccagtaggaggaaggctgtcctacaaacctccagtccaggatatcaatgcaccggacttgtacatccctttgatggcatttggcacctacattgtagctgctgggtatgccttgggtgttcttggaaggtttacccctgacgcactgaccctacagttttctaaagggattacttgggtggttttctgcaagtcgtcatcatcaaaggtctactgtactccctgggaagcggcgtagctccgttgctggacatcgtggcgtatgctggatatgggctcgctggcacgtcccctggcatagtgggccgcatnctctggagctacctgtattacttcatcatgccatgggtctgcctctgcacggaagtctccgtgtgaagaacatgaag

SEQ ID NO: 78727 - protein, 176 aa, Zea mays
  misc_feature: Ceres CLONE 1563720
  misc_feature (34)..(177): Pfam Name: YIF1 Pfam Description: YIF1
MAAMNTGMGGLGGRPIHSQANPFGTALQGAGPGLIRTGLETYGGRILDSSSEFMQSNITQYLSDPQYYFQVNSQYVRNKLKVILFPFLHRGHWTRITEPVGGRLSYKPPVQDINAPDLYIPLMAFGTYIVAAGYALGVLGRFTPDALTLQFSKGITWVVFCKSSSSKVYCTPWEAA

SEQ ID NO: 78728 - DNA, 962 bp, Zea mays
  misc_feature: Ceres CLONE 1563721
  misc_feature: Encodes the peptide sequence at SEQ ID NO. 78729
ctccccgcggtggcggccgctctagaactagtggatcccccgggctgctggaattcgtctcacccctagaaaaagaaagctcttcctcggaccctttaatgcactacggacaaccaccaccaccccacagcgcgcgcgtgtgctcgcctcacttcgcttggccctgctgtctccacgccaagctgcccacaatcccctttcccctccagtaggtatagtggcgagaaagatggtggccgtgtccacggagacgatggcgagctcgctgctcctccaggagcgagcgctcctgccaccccatccgattcctagctccagccgccggtcattgccagctccgcgtgtacaactacaggggagcatccatgagaatccgggccttccggcgaaaaaccacagcgaactgaggcggccggctgggacacggctctactcgctggcgccctaccatcagctgctggccgcgctgcttgccgggagctgaaccggtgacggccgtgttcacgcccttcgtgaaactggggaaaacgggggacctccaccggttggctcgtggaatggggccaacccgggaaaaaagggccgcggtgctctttccccagggggcggttacgggaacaaaccgggggcttcacgggatcaaccattcgaaagacccttcacaaaaaagggccaaggccaaagaatttccaaccgaaaaatccccggcggggaatgttccttttctttccccccggggggcccaaccggtgggaaataagaaatcttttaaacctcaaaaaatcccactcttgaaaaacccccttggccttgaacgtgagtttgccgtccttgtgcccccgaaaaattaatttcgttccgggacaaactggttctgagggaaaaccaggggttttgaaacaccaccgggtgtacctccatggggaaaatatactgttgttaattcccggggcgcatgccgg

SEQ ID NO: 78729 - protein, 84 aa, Zea mays
  misc_feature: Ceres CLONE 1563721
MVAVSTETMASSLLLQERALLPPHPIPSSSRRSLPAPRVQLQGSIHENPGLPAKNHSELRRPAGTRLYSLAPYHQLLAALLAGS

SEQ ID NO: 78730 - DNA, 980 bp, Zea mays
  misc_feature: Ceres CLONE 1563726
  misc_feature: Encodes the peptide sequence at SEQ ID NO. 78731
  misc_feature (449)..(449): n is a, c, t, g, unknown, or other
  misc_feature (490)..(490): n is a, c, t, g, unknown, or other
  misc_feature (554)..(554): n is a, c, t, g, unknown, or other
  misc_feature (555)..(555): n is a, c, t, g, unknown, or other
  misc_feature (568)..(568): n is a, c, t, g, unknown, or other
  misc_feature (580)..(580): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (658)..(658): n is a, c, t, g, unknown, or other
  misc_feature (683)..(683): n is a, c, t, g, unknown, or other
  misc_feature (689)..(689): n is a, c, t, g, unknown, or other
  misc_feature (690)..(690): n is a, c, t, g, unknown, or other
  misc_feature (694)..(694): n is a, c, t, g, unknown, or other
  misc_feature (695)..(695): n is a, c, t, g, unknown, or other
  misc_feature (720)..(720): n is a, c, t, g, unknown, or other
  misc_feature (724)..(724): n is a, c, t, g, unknown, or other
  misc_feature (725)..(725): n is a, c, t, g, unknown, or other
  misc_feature (727)..(727): n is a, c, t, g, unknown, or other
  misc_feature (728)..(728): n is a, c, t, g, unknown, or other
  misc_feature (778)..(778): n is a, c, t, g, unknown, or other
  misc_feature (779)..(779): n is a, c, t, g, unknown, or other
  misc_feature (782)..(782): n is a, c, t, g, unknown, or other
  misc_feature (800)..(800): n is a, c, t, g, unknown, or other
  misc_feature (806)..(806): n is a, c, t, g, unknown, or other
  misc_feature (837)..(837): n is a, c, t, g, unknown, or other
  misc_feature (844)..(844): n is a, c, t, g, unknown, or other
  misc_feature (968)..(968): n is a, c, t, g, unknown, or other
  misc_feature (969)..(969): n is a, c, t, g, unknown, or other
  misc_feature (972)..(972): n is a, c, t, g, unknown, or other
ggcggccgctctagaactagtggatcccccgggctgcaggaattcgtctcacccctagaaaaagcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggaccaaaggttttggctttataactaacacgtcttctgaggaggcttcacctgcctttactgccttggatggaaagactctcgatggacggagcatacntgttaatcatgctaacgaaaagacaggtggctttcctggcngcagaggctatgagagccaccgcctacaaggtggagggagatcttaaaggtagtaaactatcgnntactaggtgtgtnttctgcacttcnctgtactgacaataccaccaatcgtcaccgccatcaagccctcacgnnnannntaatatcctgaacatttgtgggggngaataaggcgatatctatggatagngccaannaagnngcgctagccctatttaccgagattnttgnncnngtgctccgacccaatacattctgcgctctccctctcatactccaacttgnntgnccacgacacaacaagccngagtgngttaacgtaaacacgacacaaaaatcaatgntggagantgagactaactcttctctaattttagcgcgatgatgataaagttggggtgcagtggagcacaagacgtgtgtctccagtatgactctatcgtaagtgatatcataaaacaagtcgatagaatgnngtntcataatt

SEQ ID NO: 78731 - protein, 130 aa, Zea mays
  misc_feature: Ceres CLONE 1563726
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (102)..(102): Xaa is any aa, unknown, or other
  misc_feature (116)..(116): Xaa is any aa, unknown, or other
MALANKLGGLLKKATSSNLSVYQAIRCMSSKLFVGGISYQTDDHSLRDEFAKYGQVIEARIIIDRESGRTKGFGFITNTSSEEASPAFTALDGKTLDGRSIXVNHANEKTGGFPGXRGYESHRLQGGGRS

SEQ ID NO: 78732 - DNA, 1589 bp, Zea mays
  misc_feature: Ceres CLONE 1563727
  misc_feature: Encodes the peptide sequence at SEQ ID NO. 78733
aacgccacatcgccgtcggccaccacatgatgcacgcgcacgccgccatataatactagtactactgaaccacacgggggtcgccgtgcgagcgcaagcaacgacgccccggcccgcctactactagtaccgccgcatccaccatggctgcgcccgccgcggccaagcgcccgtactggcaggcccccgccgcagcagctgagcccaacaagcggcaccgcacggccgcggcgccggcgcacatggacgcggagccggagcaggaggaccagcccctgctcccgggcctgccggaccacctcgcccagctctgcctcgccccgctcccgccgctcctcctgcacgccgtctgccgcccctggcgccgcctcctctactcgccctcgttcccgccgttcctcgcgctctacgccgtgctcgacgacgaggccgccgccttcgccggcagcggcgtctcgttcgcggcctacgacgccgtggcggggcggtgggacgagcttcccgcgccgccgatgccgtcgccgccgcccaggctgtggcacccggccttcctgtcccgccggctcccgctccagtccgtggccgcggggggcaggctcgtgctcgtggccggctccacgcgggcgctcgccccggcgctgccccgccccgtggtcttcgacccggccgcccgcgcgtggcggctcggcccgcgcctcccgttcgcgccgcgccggtggtgcgcggcgggcgcggcccgcgggcgcgtgttcatggctggcggagtcggcgcgggctacgacgccagcgacgcccggtccggcgccacgtgggacccggccgcggccgcggccgcgccgtgggagccgatcccgcccatgcgcgacgcgcggttcagccgcgacgccgcggaggccgtctgcgccgcggggaaggtgtgcatggtcagcctccgcggccgcggcgccaaggagggtgccgtcttcgacctgcgcgccgcgcggtgggaggacatgccgcccgggatgctcgctggctggaagggcccggccgcggccgccgccgctggcggcgacgaggacgagacgactatcttcgtggtggacgaggagcgcggggcgctgagcgcctacgattgggccggggaccggtggcgcacggtggtggagtcggagcggctcaagggcgccgccgagatggcggctggcggggggcgggggtgcgtggcggcccagggtggcgacaaggtgctcgtggtcgacgtggcgccctcacggtcacggcggtggggtacccccgccgccgcggagccccggccccaagtctgggaggtggaggcgccgccggggaagcgggtggtggcgctgcacgtgctgccccggatggcgcgcgcggactagcaggcaacttcccgccacgtcgtctgggaatggcgggttgcatgctcgttggattcgctacacgtgctgtacaagagacggcgcacacactgccacctgctgctcatgatccgactccgactccacctccagagtccagcctttctgttcgcatctccttccttgcagagagtttgattctaaaaaaaaaaaaaaaaaaaaaaaaaaaaa

SEQ ID NO: 78733 - protein, 411 aa, Zea mays
  misc_feature: Ceres CLONE 1563727
MAAPAAAKRPYWQAPAAAAEPNKRHRTAAAPAHMDAEPEQEDQPLLPGLPDHLAQLCLAPLPPLLLHAVCRPWRRLLYSPSFPPFLALYAVLDDEAAAFAGSGVSFAAYDAVAGRWDELPAPPMPSPPPRLWHPAFLSRRLPLQSVAAGGRLVLVAGSTRALAPALPRPVVFDPAARAWRLGPRLPFAPRRWCAAGAARGRVFMAGGVGAGYDASDARSGATWDPAAAAAAPWEPIPPMRDARFSRDAAEAVCAAGKVCMVSLRGRGAKEGAVFDLRAARWEDMPPGMLAGWKGPAAAAAAGGDEDETTIFVVDEERGALSAYDWAGDRWRTVVESERLKGAAEMAAGGGRGCVAAQGGDKVLVVDVAPSRSRRWGTPAAAEPRPQVWEVEAPPGKRVVALHVLPRMARAD

SEQ ID NO: 78734 - DNA, 764 bp, Zea mays
  misc_feature: Ceres CLONE 1563729
  misc_feature: Encodes the peptide sequence at SEQ ID NO. 78735
  misc_feature (415)..(415): n is a, c, t, g, unknown, or other
  misc_feature (722)..(722): n is a, c, t, g, unknown, or other
ctccccgcggtggcggccgctctagaactagtggatcccccgggctgcaggaattcgtctcacccctagaaaaagcgacgcctcaaatcgctccctgcctctgccctctggtcacctcgcttccgctcccggctcccctccggccacccagacatcgtccgttcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccgggagtcctcaacctcatggcccngcagatgaagggacacgacctcccgaggaggagctcaaggaggcggtcaggtgtcgacaagaccgaacggcttctctctgcgggggactccgccagtgatgacaacctcggcaaaactgaaccacaaggaggcaataaaatgaccccgagggcccaacccaaaggggaagggccaataaaccccaaaagatttccccagggccttgagggcccagggataaaacccggggggaaaggataatccccccccggggaaattaggggggaaaaccacacccgggcccccccatttttaaaaaagagaatnggggggctttttttttcctctggggcccaccccaggaaaaaa

SEQ ID NO: 78735 - protein, 154 aa, Zea mays
  misc_feature: Ceres CLONE 1563729
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (75)..(75): Xaa is any aa, unknown, or other
MADQLTDDQIAEFKEAFSLFDKDGDGCITTKELGTVMRSLGQNPTEAELQDMINEVDADGNGTIDFPGVLNLMAXQMKGHDLPRRSSRRRSGVDKTERLLSAGDSASDDNLGKTEPQGGNKMTPRAQPKGEGPINPKRFPQGLEGPGIKPGGKG

SEQ ID NO: 78736 - DNA, 934 bp, Zea mays
  misc_feature: Ceres CLONE 1563730
  misc_feature: Encodes the peptide sequence at SEQ ID NO. 78737
  misc_feature (767)..(767): n is a, c, t, g, unknown, or other
  misc_feature (831)..(831): n is a, c, t, g, unknown, or other
  misc_feature (934)..(934): n is a, c, t, g, unknown, or other
ctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgccaggtcgtgctcatgggcgccgtcgagggctaccgcatcgccggcggcccgctcggcgaggtcgtcgacccgctctaccccggcggcagcttcgacccgctcggcctcgccgacgaaccccgaggncctcgcgagctcaaggtcagggagctcagaacgccgccctcgccatgtctccatgttcggatcntcggtcaggcatccgtcacggggtagggcccgctcgagaactcgctgaacacattgcgacccgtcaacacaacgctggggctacgccacacttcgtccggggn

SEQ ID NO: 78737 - protein, 235 aa, Zea mays
  misc_feature: Ceres CLONE 1563730
  misc_feature (65)..(217): Pfam Name: Chloroa_b-bind Pfam Description: Chlorophyll A-B binding protein
  misc_feature (228)..(228): Xaa is any aa, unknown, or other
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADEPRGPRELKVRELRTPPSPCLHVRIXGQASVTG

SEQ ID NO: 78738 - DNA, 1322 bp, Zea mays
  misc_feature: Ceres CLONE 1563731
  misc_feature: Encodes the peptide sequence at SEQ ID NO. 78739
  misc_feature (1)..(1): n is a, c, t, g, unknown, or other
  misc_feature (73)..(73): n is a, c, t, g, unknown, or other
  misc_feature (1035)..(1035): n is a, c, t, g, unknown, or other
  misc_feature (1322)..(1322): n is a, c, t, g, unknown, or other
ntactttttagccttctactttccacgaccatacacatttttactctcttcttttttggttcctcttatatanttgaactccccgcggtggcggccgctctaaaatagtggatcccccgggctgcaggaattcgtctcacccctagaaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcttccgccttctgcgaggcccgcgtgacgatgggtaagacggcggctaaggccaagccagcggaagggtccgggagcccgtggtacggcctcgacagcgtgctgtacctgggctcactgtgcggcaagccaccgagctacctgacgggcgagttcccaggtgactacggctgggaaaacgcaggggccccccaacccgaccccagaaactgttccccaaaaaccggggagcttggaagtgatccagctcccggctgggcacatgctggggagccgctcgggattatcatgctataccccgaagcgtgctcggcccggcaacgggagttcaaagtttacagctgaaggccctagtgtggtacaataagggcggtgcctcaccagaaacctctcagccgaaagtggccagggtcttgagaacccaaccctccggtggaaactcccgagaaccccctcaattcggaaaacggggcaggtaaagaaacatccattaggcctccatttcagagaggagtcccgtccgccaacaggtttcctctggacctctccatacggaggaggaccagcccccatactctaaggagacgagggtatagataccccacgttataatttatgggccatagctgtggcgaggatatgcggggggctttctctctgctcataagagtgtgccaaactacaaaaagcccacaagagctctctatattatcacaccggacgcgggaccgtgtcattgtctgataaacnccgcgcgttgtggaagcactccttatatcgtaagacgaacacacctctgagggaaccgttatagagacgaaaagcctgcgcagaggggtacaagtggcgacccttccactagtaactagtgcggcgccacgcgcaactatgtgtatgccccactagatcgtaggagaagtactagataataagagtaccttagactattatcgggagaagaggagccccgcctctgtagtaaaaccaccgcatgtacacagtgtggaggagatctccgataatacgctagatcacgn

SEQ ID NO: 78739 - protein, 136 aa, Zea mays
  misc_feature: Ceres CLONE 1563731
MASSTMALSSTAFAGKAVNVPSSSAFCEARVTMGKTAAKAKPAEGSGSPWYGLDSVLYLGSLCGKPPSYLTGEFPGDYGWENAGAPQPDPRNCSPKTGELGSDPAPGWAHAGEPLGIIMLYPEACSARQREFKVYS

SEQ ID NO: 78740 - DNA, 934 bp, Zea mays
  misc_feature: Ceres CLONE 1563733
  misc_feature: Encodes the peptide sequence at SEQ ID NO. 78741
  misc_feature (934)..(934): n is a, c, t, g, unknown, or other
ccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgccagcatcccctccaagtgcggcgtcagcatcccctacaccatcagcacctccaccgactgctccagggtgaactaaaacctagaccacgcgcgacgacggccgcctgatcgatcgtacaaccattccgccgtcgccgccggccggatcatcgggcgtcgtcatgatgatatctatcaatctacgcgtgatgatcgatggctacttgtctactgctatggactactaaataaaatctctccccgtgtgtgtacacgtacgcttggatgtgcatggtagcatgtacctacgacgtcgtcattgtataatgttggaacgtggagacggacagaagaaagaaagaaaggatcgttcgaaaaacggctggtccctttggctgttggggttattcttccaaactttggaggggaacaaaattatttctgggggacctttttttcccccagggggaggggccaattggtcccgggccatttggcacccaan

SEQ ID NO: 78741 - protein, 121 aa, Zea mays; identical to SEQ ID NO: 62569
  misc_feature: Ceres CLONE 1563733
  misc_feature (32)..(117): Pfam Name: Tryp_alpha_amyl Pfam Description: Protease inhibitor/seed storage/LTP family

SEQ ID NO: 78742 - DNA, 942 bp, Zea mays
  misc_feature: Ceres CLONE 1563734
  misc_feature: Encodes the peptide sequence at SEQ ID NO. 78743
  misc_feature (667)..(667): n is a, c, t, g, unknown, or other
  misc_feature (749)..(749): n is a, c, t, g, unknown, or other
  misc_feature (750)..(750): n is a, c, t, g, unknown, or other
  misc_feature (754)..(754): n is a, c, t, g, unknown, or other
  misc_feature (759)..(759): n is a, c, t, g, unknown, or other
  misc_feature (796)..(796): n is a, c, t, g, unknown, or other
  misc_feature (811)..(811): n is a, c, t, g, unknown, or other
  misc_feature (862)..(862): n is a, c, t, g, unknown, or other
  misc_feature (881)..(881): n is a, c, t, g, unknown, or other
ctggagctcaccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtncgcggcgcccgctcggagaggtcgtcgacccgctctaccccggcggcagcttcgacccgctcggcctcgccgacgaccctgnnagcntcgcngagctcaagttgagggagctcagaacggccgcctcgncatggtctccatgtncgggggtctcgtcaaggcatcgtcaccggcaaggcccgcttgagaactcgncgacaactcgcgacccgtnaaaaaaacgatgtcctatgccacaacttgtgctgaatttttagggggtgagcgcccgccac

SEQ ID NO: 78743 - protein, 210 aa, Zea mays
  misc_feature: Ceres CLONE 1563734
  misc_feature (64)..(199): Pfam Name: Chloroa_b-bind Pfam Description: Chlorophyll A-B binding protein
  misc_feature (204)..(204): Xaa is any aa, unknown, or other
  misc_feature (207)..(207): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEGYRVRGARSERSSTRSTPAAASTRSASPTTLXASXSSS

SEQ ID NO: 78744 - DNA, 928 bp, Zea mays
  misc_feature: Ceres CLONE 1563735
  misc_feature: Encodes the peptide sequence at SEQ ID NO. 78745
  misc_feature (855)..(855): n is a, c, t, g, unknown, or other
ctccccgcggtggcggccgctctagaactagtggatcccccgggctgcaggaattcgtctcacccctagaaaaaaaaaatccatccatctattctccagtccacccattccattccactaccgacgcccagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggagtcgcctcgccgtccgctggcgccgcgtgcagggccgcgggcaaggggaaggaggtgctcagcggggtcgatgttcagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctatttcgaccgcgacaacgtggatctcaaaggatttgccaagttcttcaaggaatccagcgacgaggagagggagcacgctgaaaagctcatggagttacagaacaaacgtggaggcagggtgagggctcaatcgattgtgacgcctttaaccgagtttgaccaccctgaagaaagaaatgctctgtacgctatggaactggctctggcccgggaaagctggtcaatgaaagctgcacaactgcatggtgtggcacaagtgcaatgatctcagctgacgacttcatcgagaggaagtcctccgagagcaggtggaagcataacaagatcaccagtatgtcgccanctgaaggaagtggccaggggcccgggtggtgcactccatcgatgcgcctgaggaaaggctaaaaggagacggg

SEQ ID NO: 78745 - protein, 201 aa, Zea mays
  misc_feature: Ceres CLONE 1563735
  misc_feature (91)..(200): Pfam Name: Ferritin Pfam Description: Ferritin-like domain
  misc_feature: SWISSPROT Homolog: EC 1.16.3.1 Ferroxidase
MMLRVSPSPAAAVPTQLSGAPATPAPVVRVAAPRGVASPSAGAACRAAGKGKEVLSGVDVQPFEEIKGELALVPQSPDKSLARHKFVDDCEAALNEQINVEYNASYAYHSLFAYFDRDNVDLKGFAKFFKESSDEEREHAEKLMELQNKRGGRVRAQSIVTPLTEFDHPEERNALYAMELALARESWSMKAAQLHGVAQVQ

SEQ ID NO: 78746 - DNA, 935 bp, Zea mays
  misc_feature: Ceres CLONE 1563736
  misc_feature: Encodes the peptide sequence at SEQ ID NO. 78747
ggagctccccgcggtggcggccgctctagaactagtggatcccccgggctgcaggaattcgtctcacccctagaaaaaaccggaccttcgttccgcccaaccgagcaaccaaccttcccaaaatttcgaactcgtattaacggtcggcggtgggtgtggagcgggacggggcggcgagatcacgacgagatggagactgacatctcttcatgcggaggcggcggcgcccaacagcggggtataggacctgtggaggtgcaagcggcgacggcagcactgcggcggtcagaggtgttccacgtcttgaaggagctcgtaggcttcgtcctctacatgcaccaccagatcccctcggttttgccgagtcttgaaaatgaatttgcaagtttaaaggaggaaatgacagaaatggcattacaaccagctgaactcaaaccatctgatcggagaaagtacaacacacgaaaaacggaggttagacgtagaataaagaagcacgagaagttgatgaatggcatctctaccttactctgttctcttcagcacgcacttgatgaagtttctagcattgaaggagttgtcctgatacttggaggaagccttgtacggcccctatttgtttatgacattacaatttctcatggtatctttggtccaggaagtgccaaagaacatgctctaaccagttagcccaatctgtttctcggaaggctatccgtgctcttgtatcacgtggagctgggagtctgtcctacacagacctagcaagttgttttttgtgtaagatgctcagtacattaaagctaccactggttttctgccaaagctgatttcgttacagcaaaaaggtgtacctctcaaatgcatataagtgccagtaatcggttgttcagggcataccagcacctatgctcctgttgattcccaggtccact

SEQ ID NO: 78747 - protein, 166 aa, Zea mays
  misc_feature: Ceres CLONE 1563736
METDISSCGGGGAQQRGIGPVEVQAATAALRRSEVFHVLKELVGFVLYMHHQIPSVLPSLENEFASLKEEMTEMALQPAELKPSDRRKYNTRKTEVRRRIKKHEKLMNGISTLLCSLQHALDEVSSIEGVVLILGGSLVRPLFVYDITISHGIFGPGSAKEHALTS

SEQ ID NO: 78748 - DNA, 848 bp, Zea mays
  misc_feature: Ceres CLONE 1563737
  misc_feature (316)..(316): n is a, c, t, g, unknown, or other
  misc_feature (317)..(317): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
ctccccgcggtggcggccgctctagaactagtggatcccccgggctgcaggaattcgtctcacccctagaaaaacctcgtcatcggctcctccgcctccacctccgcccgccccctgatccggatcgacgacgccgaccccagatccctttcctctccgccgtctccccgcccgcccgcccgccgatcccacatccctcccaggccttcaagcagtgaaggagccttatgagctggttggctggggctttactccaattctggtgctactaagatgggccagggcctgctcagcaacaagtctggggacaagactnnaagcatagatggaaaatagcaggggcgctttacccatttttcttggcctccttggcgccctccccccccgggggggtttcccctttcgggggggacccggccctcttttccccccccaaaaaaaataaaaaaaaaaccttttttttttaaaaaaccgtggaaaggggggggggggggtttaaaaaaaaattttttggtttcccccccccctcttttttaaaaaagtttgctttttctttttttccccgggatttttaaaaaaaaaaaaagtggggaaaaccccggggggcgcgaaaaaaaagaggggggggacccttttttttttttttcccccccccccccaaaaaccccgggggggggggggggggggggagggggggcgccccccccccccccgtgtttttttttttttttcctcaaaaaccccccccccttcccttttttttggggggggggcccccccgggctcccacaaaaaaaaaaaaagggnnnnnnngggggggggggggtggtgttataagaaaaaaaaaa

SEQ ID NO: 78749 - DNA, 952 bp, Zea mays
  misc_feature: Ceres CLONE 1563739
  misc_feature: Encodes the peptide sequence at SEQ ID NO. 78750
ctggagctccccgcggtggcggccgctctagaactagtggatcccccgggctgcaggaattcgtctcacccctagaaaaagagtcgtcgccccctcgctttcaccccacgcggaagcaagaattcgtcgtcaaattcccagcttgcgcgtgtttctgtggatttcttcccgcttccctgctcctgcctcctatgggcctttgatccggggcttcgtggatcttgggaagaggaggtgcggtgggcgcctcggcggcgatctggcggggaggatatggccagcgggaaggagccgatcgaggtcaggtttcgtctcttcgacggcacggatatcgggcctacgaagtacgatccctccaccacggtctcctcgctcaaggagttcatcctcgctcggtggccgcaagataaggatatagctccaaaaactgttaatgacttgaagcttatcaatggtggaaggatattggagaataaccggacacttgcagagtcccgtgttccagtaggagagatcccaggtggtgtaattacaatgcatgtggtagtgcggcctccacaagctgacaaatacaagaagcagcttgccaattcccccaagcagaacagatgtggatgcaccattctctgataaggcgtctgcttggtgctggacaatctgtgtgtacacataagattttggatgtgctttgctgggttcacacaagcagggattcgttttgattccaaattcttgaagccctacaaatcccaaaagtaagaacccccggaaaccaaagatttctggaacctttttttccaaaaggtaggattggaaccttcctgctgcataaaatgggttggcaaaaactgaaaaaaaatcgccttccttttccgctttttaacttatattccgacccccccagctcggtcgttttgttgtcggtaaacaaaatttgcacccctgtttgtac

SEQ ID NO: 78750 - protein, 118 aa, Zea mays
  misc_feature: Ceres CLONE 1563739
MASGKEPIEVRFRLFDGTDIGPTKYDPSTTVSSLKEFILARWPQDKDIAPKTVNDLKLINGGRILENNRTLAESRVPVGEIPGGVITMHVVVRPPQADKYKKQLANSPKQNRCGCTIL

SEQ ID NO: 78751 - DNA, 940 bp, Zea mays
  misc_feature: Ceres CLONE 1563740
  misc_feature: Encodes the peptide sequence at SEQ ID NO. 78752
ctggagctccccgcggtggcggccgctctagaactagtggatcccccgggctgcaggaattcgtctcacccctagaaaaagccaagcgcccaagaccaaacccaccagcacagcaccaattcaaccgcgacccaacccaccgccccgcaccccattcccgcaccctcctcccccagatctccggccgcgacgacgccatgacggccaagggcggcgccacgccgtcccccggcggcgcgggccccgcggcggggaacggccgcctcttcaccgtcgggctggtcaccgcctggtactcctccaacatcggcgtgctcctgctcaacaagtacctcctcagcaactacggcttcaagtaccccatcttcctcaccatgtgccacatgtccgcctgcgccctgctctcctacgccgccatcgcctggctgcgcgtcgtgcccatgcagctcgtgcgctcccgcgtccagctcgccaagatcgccgcgctcagcctcgtcttctgcggctccgtcgtctccggcaacgtctcgctgcgctacctccccgtctccttcaaccagcggtcggcgccaccacgcctttcttcaccgccgtcttcgcctacatcatgaccgtcaagcgcgagtcctgtgtcacctacctcaccctcgtggccgtcgtcaccggagtcatcatcgcccgcggcggcgagcctagctttcatctggttggattcaccatgtgcataggagcaactgcagcaagggcgttgaagacagtattggcagggaattcttctggcttccgaaggggagaagccttaatcccttgaacccggtgggtgtaacggggctccaatcccgggtttaccttcatggtttccgggaaaatttttttatggggggaaaaaggttgtccggcgttcaaatttaacgctggcgaaaaaagaggttcccacatc

SEQ ID NO: 78752 - protein, 137 aa, Zea mays
  misc_feature: Ceres CLONE 1563740
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQRSAPPRLSSPPSSPTS

SEQ ID NO: 78753 - DNA, 969 bp, Zea mays
  misc_feature: Ceres CLONE 1563741
  misc_feature: Encodes the peptide sequence at SEQ ID NO. 78754
tggagctccccgcggtggcggccgctctagaactagtggatcccccgggctgcaggaattcgtctcacccctagaaaaactcgccatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctccaccggcctcaccacccgccggttcgtcggccacgagaaggacgtcatctccgtcgccttctccgtcgacaacccgcagatcgtctccgcgtcccgccgacagaccatcaagctctgggaccctctcggcgagtgcaagtacacccctcgggggggaccttcggggggcggggagggccccaacgggggggggctcctgcgttagggtcccccccaaaaaccttccagcccccctttggcctcggatcccggggaccccacccttaagggcctggaacccttaccaactggaagctggccgggacctttggggggggaagggggggctttgtttaaccccctcccctctgtacagccccgacggttctctttgtcccccccccccgtggaaggaagggtgttcttccctgtgggggattttgccctgagaggaagagttcgtttccccctcggcccggtgctccatctacatcttcgcttgttgctcccgcccccgtgctcctggttctt

SEQ ID NO: 78754 - protein, 172 aa, Zea mays
  misc_feature: Ceres CLONE 1563741
  misc_feature (65)..(103): Pfam Name: WD40 Pfam Description: WD domain, G-beta repeat
  misc_feature (107)..(145): Pfam Name: WD40 Pfam Description: WD domain, G-beta repeat
  misc_feature (8)..(47): Pfam Name: WD40 Pfam Description: WD domain, G-beta repeat
  misc_feature: SWISSPROT Homolog: EC 2.7.11.7 [Myosin heavy-chain] kinase
MAGAQESLSLVGTMRGHNGEVTAIATPIDNSPFIVSSSRDKSVLVWDLTNPVHSTPESGVTADYGVPFRRLTGHSHFVQDVVLSSDGQFALSGSWDGELRLWDLSTGLTTRRFVGHEKDVISVAFSVDNPQIVSASRRQTIKLWDPLGECKYTPRGGPSGGGEGPNGGGLLR

SEQ ID NO: 78755 - DNA, 960 bp, Zea mays
  misc_feature: Ceres CLONE 1563745
  misc_feature: Encodes the peptide sequence at SEQ ID NO. 78756
  misc_feature (743)..(743): n is a, c, t, g, unknown, or other
ctggagctccccgcggtggcggccgctctagaactagtggatcccccgggctgcaggaattcgtctcacccctagaaaaaattaaagtcccatccgcggctccgccctcctctgtgtcttccttccacctgaaaacccaacccacacgctcgcgcctccgcgaagaaaaacaccgaggcccatggcgccgagaacgtcagagagagcgatgacatcggcggccgcggggctcgcgcgtggcgccggcccgcactacagaggcgtcaggaagcggccgtggggccggtacgccgcggagatccgcgacccggccaagaagagccgcgtgtggctcggcacgttcgacacgcccgaggacgccgcgcgggcctacgacgccgccgcgcgcgagtaccgcggcgccaaggccaagaccaacttctccttcccttcgtgcctgccgctcgccgccgcggacgtggccggcggctgccggagcggcaacagcagcagcaccaccaccaccaccaccgtcgactccttcggcggcgacgtgcaggcgccgcccatgcaggccatgccgctcccaccgtccttcagcgccagcgccgccgtacgcttccctttcagcggctaccccgtgacgcacccgtactacttcttcgggcatgcggcagcagggtgccatatgctgaagctgccaccgacgacggtgactgtggctcagagcgactctgactcctcgtccgtcgaggatctgtcgncgtcgccgccggcccgcgtgtcagcgacgagagccgccgcgtttgatctcgacctaaactgcccaccgccggccgagggcgagcattagtcgcggagtttgctgatgactgcctgtagtttcttcgtctttacccgtagagagaaatcggtagcttaggcccctttgtatccaacgtgtcacggcacaccacctcgaactctgatttttgtcttaat

SEQ ID NO: 78756 - protein, 216 aa, Zea mays
  misc_feature: Ceres CLONE 1563745
  misc_feature (23)..(74): Pfam Name: AP2 Pfam Description: AP2 domain
  misc_feature (188)..(188): Xaa is any aa, unknown, or other
MAPRTSERAMTSAAAGLARGAGPHYRGVRKRPWGRYAAEIRDPAKKSRVWLGTFDTPEDAARAYDAAAREYRGAKAKTNFSFPSCLPLAAADVAGGCRSGNSSSTTTTTTVDSFGGDVQAPPMQAMPLPPSFSASAAVRFPFSGYPVTHPYYFFGHAAAGCHMLKLPPTTVTVAQSDSDSSSVEDLSXSPPARVSATRAAAFDLDLNCPPPAEGEH

SEQ ID NO: 78757 - DNA, 924 bp, Zea mays
  misc_feature: Ceres CLONE 1563749
  misc_feature: Encodes the peptide sequence at SEQ ID NO. 78758
agctcaccgcggtggcggccgctctagaactagtggatcccccgggctgcaggaattcgtctcacccctagaaaaaaaaccgccagacttcgcagtcctcctccactaccagagcatgcgcgttgcccccgcgacccgaaccgccgccgccgctcaccctccgagcgccttcctgctcctcctcggttgcgcgtccctcgcgatcggaggagcagccatggccggccacgtcctcggcggcgtgaaggagaacccagccgcggccaacagcgccgagtccgacgggctcggccgcttcgccgtcgacgagcacaacaggcgcgagaacgcgctgctggagttcgtgcgcgtggtggaggccaaggagcaggtggtggccggcacgctgcaccacctcacgctcgaggccgtcgaggccgggaggaagaagctctacgaggccaaggtctgggtcaagccatggctcgacttcaaggagctccaggaattcagccacaagggggacgccaccgccttcaccaacgccgacctcggcgccaagcaaggtggacatgagcctggttggcgtgaggttccagtagaggatcctgtggtcaaagatgctgcacaccatgctgtgaaatcgatccaagagaagtccaactccctgtttccctacgaacttctcgagatcccttcgtgcccatgcacaggttgtggaagactttgcaaaatttgacattctgatgaaactgaagagaggcagcaagcgccgaaagatcaaagccgaaggtccataagagcctggaaggggccctttgtgctaaaaccagcatcagccgggcgaagcatgattaagtcgagccacccaggggaacggacgttaactggtgtgacctgtaagtagttaccggaccttccttgttaacgtaagaagaataagga

SEQ ID NO: 78758 - protein, 200 aa, Zea mays
  misc_feature: Ceres CLONE 1563749
  misc_feature (41)..(129): Pfam Name: Cystatin Pfam Description: Cystatin domain
MRVAPATRTAAAAHPPSAFLLLLGCASLAIGGAAMAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKQGGHEPGWREVPVEDPVVKDAAHHAVKSIQEKSNSLFPYELLEIPSCPCTGCGRLCKI

SEQ ID NO: 78759 - DNA, 790 bp, Zea mays
  misc_feature: Ceres CLONE 1563751
  misc_feature: Translation starting site: 192
  misc_feature: SWISSPROT Homolog: EC 4.4.1.5 Lactoylglutathione lyase
ctccccgcggtggcggccgctctagaactagtggatcccccgggctgcaggaattcgtctcacccctagaaaaaacctccgcagctagcatcgatccgccattgctcaccgcacaagtgcacgctcacctgtcacctcacacacgcagctaagtagctaacgccggaggcgagaacaagaaaaagctcgacatggccgaggagaagaagcagggcctgcagctgctggacttctgggtgagcccattcgggcagcgctgccgcatcgcgatggacgagaagggcctggcctacgagtacctggagcaggacttgggggaacaagagcgagctgctccctcgtcgcaacccggtgcataagaagatccccgttgctgctgcacgacgggccgcccccgtctggaagtccctcggcatcgtggaagtacctcgaacaaaggggttccccggggggggggacccggggccttgttccccccccaaacccctataggggcgcgcgcaagggcccccttttggggggggggaattaaccccaacaaaagaaagtctttaaaaaaaagggggggacccccgggggggggggggggaaacccccccggggggggggaaaggggcccacggggcccaaggggggccccccccccccaaaaaaaggggggcaaaaaaaaccccccccccccaccccccttgggagggggggggggccccctccccagaaaaaaggggggccccccttttttcttgtggggggggggaggagaacccccccccccggtggtttttttttt

SEQ ID NO: 78760 - DNA, 1333 bp, Zea mays
  misc_feature: Ceres CLONE 1563752
tccccttttcaaggactctattactttccagtacaatattttatgcgctcgtctttttgttccttaataactggaactccccgcggtggcggccgtctctagaactagtggatcccccgggctgcaagaattcgtctcacccctagaaaaagcgtagactcaaatcgctgcctgcctctgccctctgggcacctcgcttccgctcccggatcccctccggccacccaaacatcctccgtgtcctcgccaagagaaaggaccggagaccatggcagaccagctcaacgaaaaaccagatcgccgacttccatggagggtctttgaacaacttcaaaaatggacggcgaccgggagcatttaaaaataaaaaagactccgaaactgttcatgggtttttgcgggggtcaaaaaacccaatcgcagactggaggcccccgtcccatgattcaccaaaggttctccgcctgaccacttttacttctctatttgaatttttgccccccccgggcttaaaccctcttttgttacctccattattttcaagggcaccgccaccgcttttagaaaggaggccctcccgggatgcgcctctcaaggggtgtttccccagagcaaggttcccgataaaggggttgtttcgtttattggcggcgtgtgaattttatcggcatcatcttgatttatacataagccgttctcctgcagaaaacggcctctattcccagcactagtggagagttctccaatataacatatacaaccctctttaataggcccgacacacccactcattgcgtgtattaggagccccgattaactactttctatccgggcatttatcttctcggccctgcacatctcctctctcaatgcgccccctcatctgatattctacattagtatccacgctctacaattttctttaaggcgaatactataacacacttgtaacgttaacgatactcatgggagggccttcatgcaccccacccttattcgcgaccgctctaggcgctctacatctataccatgtgaaatgtcggcaccagcgtgcaccatatggttatcccctcttctcgagaatcctgtttctgcatcttaaagcaaaacctctactgcgtgatatcttcagtacatgtgcaccctactacatcgttcatgattaacacccatgtagagaagtacacaacgactatgtgtgtccactactctgttgttgggtattattacaagtatccgctgtggggtagaccccgaactctctttaagatacgcgttcgagcgtcatcattgtacatgtctcttttccaaacactctctgtcgcctttcttt

SEQ ID NO: 78761 - DNA, 912 bp, Zea mays
  misc_feature: Ceres CLONE 1563755
  misc_feature: Encodes the peptide sequence at SEQ ID NO. 78762
  misc_feature (635)..(635): n is a, c, t, g, unknown, or other
tggagctccccgcggtggcggccgctctagaactagtggatcccccgggctgcaggaattcgtctcacccctagaaaaaactcgtagtcctaggcactttcatctgtggcctctgcgttcgagatcgatctgagctggcaccgtcccacttcgccatggcggaggaccggagccccaagcccatccactgcaaagcggcggtgtgcagagccgccggcgagccactcaccatcgaggagatcgtcgtcgacccgccgaaagcgtacgagatccgcatccgggtcgtctgcacctcactctgccacaccgatatcaccttctggaaagctaaggtggcaccggtgtttccaagaatactagggcatgaggcgtacggggtagtggagagcgtgggggagcacccggagggcttcgcggcgggggacaccgtggtgccgacgttcctggggcagtgcgagcgctgcgccagctgcgcgtcggagcacagcaacgtgtgcgacgcggtgccgttcgtcatcggccccgggatgcggcgcgacggcaccacccggttccgggacgcgcgggggagcccgctgcacgacctcctcgccgtctccagcttcagcgagtacaccgtcgtggacgtgaaccangtggtcaaggtcgaccccgccgtgccgcccaagctcgcctgcctcctcagctgcggcgccggcaccggggttagagcagcgtggaagtctgccaaagtggagccaggatccactggtgcaatctttggccttggatctgtcggtttggcggtggtccaaggcgcgaaaatgtgttgggcatccagatcatcggcgttgatcttcaccctgacaaggaggaagtagggagatcgttcggggttccaagacttcgtcaattcatccgcagctgggacag

SEQ ID NO: 78762 - protein, 234 aa, Zea mays
  misc_feature: Ceres CLONE 1563755
  misc_feature (36)..(164): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (160)..(160): Xaa is any aa, unknown, or other
MAEDRSPKPIHCKAAVCRAAGEPLTIEEIVVDPPKAYEIRIRVVCTSLCHTDITFWKAKVAPVFPRILGHEAYGVVESVGEHPEGFAAGDTVVPTFLGQCERCASCASEHSNVCDAVPFVIGPGMRRDGTTRFRDARGSPLHDLLAVSSFSEYTVVDVNXVVKVDPAVPPKLACLLSCGAGTGVRAAWKSAKVEPGSTGAIFGLGSVGLAVVQGAKMCWASRSSALIFTLTRRK

SEQ ID NO: 78763 - DNA, 1219 bp, Zea mays
  misc_feature: Ceres CLONE 1563756
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (71)..(71): n is a, c, t, g, unknown, or other
  misc_feature (861)..(861): n is a, c, t, g, unknown, or other
tttgtttgtttctcattttttttattataattatcttttctgtctgccacttaagaaggcgtnnncntttntattgggctccccgcggtggcggccgctctagaactagtggatcccccgggctgcaggaattcgtctcacccctagaaaaagaggacgacgtctccttctccaccccccgcccctgcccctgtgtgggagtaggtgtagccgtgtaagcggcagcggcgtaagcctcagctcggctcagctgccgcctcgctcgaaccataggagccaatcacaggaagcgaggcgggagatgtcggcggggctggtgaccaactatgccaccctgggggcggctgttccggatcccgtccacggtgatgcatattccgcctgtacgtggctacccggtggctgaccaatagctttcccaccgggctccgagacttcctccgtatgttcggcgagtccttccaaccgcgatgggaccctcttcatcaccgtgtacaagaaagaacgagcccctcccgaccaatatataacttcttctttcccccctccgaagatacaaggttaggggagggaagctcctttttagaaattatcccccgaaaatgactgaaccccaccagataacttgcttcccataaatctggggcttgggttgcctccaagcagtaaaccctaaacgttcccggtttgggaaaaaaatcccgtttactttgccttttaacgttgtggtaagccccgaaaaatattccttgtatttgggacaaattttttctccaaggtatagtgcctgccaaataactcctctttctcattactcctctcgaataaggtaagaacatggttgccctccggggttccctncgtgagactaacccccagggggtggcctcctctccaaatctgctggtgggtgatattaaaagtgcctcccttttttggggtgtgggtggtaacacaccctttttttaaggagtagaaatgtctccgatatcccagggaaatacgctggatcacatcggtggttctcccttattgcgctttgcaatttggtcatcggcgccctcctggcggcagaggtaaataatttctgttatagaaagctcaatcgctgggccctcctgcgaataatgtggcgcgtgttataactcattttgctctagacccgcttatcttttattattgcgaaacagatcttgcgctgaacactgtgtaaaataag

SEQ ID NO: 78764 - DNA, 979 bp, Zea mays
  misc_feature: Ceres CLONE 1563757
  misc_feature: Encodes the peptide sequence at SEQ ID NO. 78765
  misc_feature (785)..(785): n is a, c, t, g, unknown, or other
ctggagctccccgcggtggcggccgctctagaactagtggatcccccgggctgcaggaattcgtctcacccctagaaaaaatctccaatctcctcgccccccacggacctgaaccgagaaccgttaccgccgccgcctctcgcctagccgccggagaagcgccgctcgctcaggaggacagccatggcgccggagccggaggatgatattatgaacgagaagaatccccgcccgctcgacgaggatgacatcgcgctcctcaaaacctatggactggggccgtattcgaccagcattaagaaggtcgagaaggagatcaaggaaatggccaagaaaatcaacgacctctgtgggataaaggagtctgatacagggctggctccacctagccagtgggatttggtttcagataagcagatgatgcaagaagaacaaccgttacaagtagcaagatgtacaaagattataagccctaatacggatgatgccaaatatgttataaatgtaaaacaaattgcaaagtttgtggtcggattgggagataaggtctctccaactgatatcgaggaagggatgagggttggtgttgatcgcaacaagtaccagattcaaatccctcttccaccaaaaattgacccaagtgttaccatgatgactgtggaggaaaaaccagatgtgacgtacaatgatgtcggtggctgcaaggagcagattgagaagatgcctgaagttgtttaaactcctatgcttcacccagaaaagtttgtcaacttggtattgacccntccaaaaggggtcctttggtatgggccccccggtactgggcagacacttcttgcaagaactgtagccaaccggacggatggttgttcctcccgggaattgggaggagcctattccaaatttttgtggaaaaagggccccgaagggaaaggaaactttcccaatggcccgctccaagaagacaggcttggttttc

SEQ ID NO: 78765 - protein, 184 aa, Zea mays
  misc_feature: Ceres CLONE 1563757
MAPEPEDDIMNEKNPRPLDEDDIALLKTYGLGPYSTSIKKVEKEIKEMAKKINDLCGIKESDTGLAPPSQWDLVSDKQMMQEEQPLQVARCTKIISPNTDDAKYVINVKQIAKFVVGLGDKVSPTDIEEGMRVGVDRNKYQIQIPLPPKIDPSVTMMTVEEKPDVTYNDVGGCKEQIEKMPEVV

SEQ ID NO: 78766 - DNA, 952 bp, Zea mays
  misc_feature: Ceres CLONE 1563760
  misc_feature: Encodes the peptide sequence at SEQ ID NO. 78767
  misc_feature (388)..(388): n is a, c, t, g, unknown, or other
  misc_feature (393)..(393): n is a, c, t, g, unknown, or other
ccgcggtggcggccgctctagaactagtggatcccccgggctgcaggaattcgtctcacccctagaaaaagaagctcttcctcggaccctttaatgcactacggaccaccaccaccaccccaccgcgcgcgcgtgtgctcgcctcacttcgcttggcccggctgtctccacgccacgctgcccacaatcccctttcccctccagtaggtagagtggcgagaaggatggtggccgtgtccacggcgacgatggcgagctcgctgctcctccggccgcgcgcgctcctgccaccccatccgattcctagctccagccgccggccattgccagctccgcgtgtacaactacaggggagcatccaggagaagcccggccttccggcgaaaancgacngcaagcggaggcggccggctgggacgcggctctactcgctggcgccctaccctctgctgctggccgcgctgctgccgggagctgagccggtgacggccgtgttcgcgccgttcgtggagctggtgaagacgtgggacctcccgggctggctcgtgcactggggccacccggggtacaatggctgtggtgctctttcgcaaggggtggttacgggacatacctggggctccggatcaaactatcagacgaactttgaaaagtaggcaaagccaaagatctccaccccaaactccctccccgggatgttctttttcttcgccctgggccccaccggtgggatcacagctctttctcactcagacaaacccatctttgaaagccctcatgccggtgactggagtcatcggcccttgcgctcttgaacaatcagtccgtcctgccaaaaactgttcgaggaaaacccaggcttagaactacacatgttccgccccgaaatggccatgaactcggttctaatcacccgggacttggccttgaacttggaatcagtttctaactg

SEQ ID NO: 78767 - protein, 143 aa, Zea mays
  misc_feature: Ceres CLONE 1563760
  misc_feature (55)..(55): Xaa is any aa, unknown, or other
  misc_feature (57)..(57): Xaa is any aa, unknown, or other
MVAVSTATMASSLLLRPRALLPPHPIPSSSRRPLPAPRVQLQGSIQEKPGLPAKXDXKRRRPAGTRLYSLAPYPLLLAALLPGAEPVTAVFAPFVELVKTWDLPGWLVHWGHPGYNGCGALSQGVVTGHTWGSGSNYQTNFEK

SEQ ID NO: 78768 - DNA, 899 bp, Zea mays
  misc_feature: Ceres CLONE 1563761
  misc_feature: Encodes the peptide sequence at SEQ ID NO. 78769
  misc_feature (719)..(719): n is a, c, t, g, unknown, or other
  misc_feature (741)..(741): n is a, c, t, g, unknown, or other
  misc_feature (755)..(755): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
ctccccgcggtggcggccgctctagaactagtggatcccccgggctgcaggaattcgtctcacccctagaaaaaagctgagcacgccgaaaagctcatcagtgctcatcccctgctggcccgttctcagtcccagtgagaggctccatgaagatcctggtcgcggtgaagcgggtggtggactacgctgtcaaagtgcgcgtgaggccggacgggaggggcgtggagacggccaacgtgaagatgtccatgaatccattctgcgagatcgccgttgaggaggcgctgcggctccgggaggccggcgtcgccgctgaggtcgtcgccgccaccgtaggccctgcccagtccgccgacacgctccgcaccgcactcgccatgggcgccgatcgcgccgtccacgtgctccacgacccggaccctgcgcggcccctcctccctctcgccgttgccaagatccttcgcgccgtcgcgctccaggagaagcccggcctcgtcatcctcggcaagcaggcaattgatgatgattgcaaccaaactggacaaatgttagctggattgctcaagtggccacaaggaacctttgcctccaaggttacattggacacagaaaaacaaaaagctactgttgagcgagaagttgatggtggaattgaaacatctgccttgatctgccagcagtgatcaccacggatttaagacttacccagccagatatgncactttgccccacataatgaanggcaaatccaaagnttattagaaagtcgccgctgaagaccttggcgtagatatagatcagacatgggagtgattgannngtcatgaccacaaaacgaaaagcagggtgattctttcatgtgtcgacgagctccttgacagtgaaaaatgagcagtgta

SEQ ID NO: 78769 - protein, 178 aa, Zea mays
  misc_feature: Ceres CLONE 1563761
  misc_feature (23)..(179): Pfam Name: ETF Pfam Description: Electron transfer flavoprotein domain
MKILVAVKRVVDYAVKVRVRPDGRGVETANVKMSMNPFCEIAVEEALRLREAGVAAEVVAATVGPAQSADTLRTALAMGADRAVHVLHDPDPARPLLPLAVAKILRAVALQEKPGLVILGKQAIDDDCNQTGQMLAGLLKWPQGTFASKVTLDTEKQKATVEREVDGGIETSALICQQ

SEQ ID NO: 78770 - DNA, 882 bp, Zea mays
  misc_feature: Ceres CLONE 1563762
  misc_feature: Encodes the peptide sequence at SEQ ID NO. 78771
  misc_feature (720)..(720): n is a, c, t, g, unknown, or other
  misc_feature (721)..(721): n is a, c, t, g, unknown, or other
  misc_feature (724)..(724): n is a, c, t, g, unknown, or other
  misc_feature (744)..(744): n is a, c, t, g, unknown, or other
  misc_feature (802)..(802): n is a, c, t, g, unknown, or other
acccgcggtggcggccgctctagaactagtggatcccccgggctgcaggaattcgtctcacccctagaaaaaacaaggagacgtacgctctctgctagcacccatcttgcagcaggcggagtcgcccgacccaatccgtgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgccagcctcgtcgccatcctcagcgtctgcctcaccatgtacggcgtcgcctcctttcacgagggcgacccgtgcacggggcccacgctcacgctcaccgggcggaagaaggatgccgacaagctgcagaccgcccgacgctgggccaagttcacccggagggttctcnntcngtggtatctccggcgtgctnctggcatacttcctcctctacgtgctcgacctcccctactacttcaagtagatacaanttcataaagatgcatatatataatatagctccggctccgatcctcctctctgggtgcaaaggtttgccatttcaacaagg

SEQ ID NO: 78771 - protein, 209 aa, Zea mays
  misc_feature: Ceres CLONE 1563762
  misc_feature (44)..(185): Pfam Name: PsaL Pfam Description: Photosystem I reaction centre subunit XI
  misc_feature (181)..(181): Xaa is any aa, unknown, or other
  misc_feature (182)..(182): Xaa is any aa, unknown, or other
  misc_feature (189)..(189): Xaa is any aa, unknown, or other
  misc_feature (208)..(208): Xaa is any aa, unknown, or other
MASQVMKSSPVHSRPRGLSGAALTRPRPRFSVVKAAIQPEKATYQVVQPINGDPFIGSLETPVTSSPLIAWYLSNLPAYRTAVSPLLRGVEVGLAHGYLLVGPFALTGPLRNTPVHGQAGALGAASLVAILSVCLTMYGVASFHEGDPCTGPTLTLTGRKKDADKLQTARRWAKFTRRVLXXWYLRRAXGILPPLRARPPLLLQVDTXS

SEQ ID NO: 78772 - DNA, 971 bp, Zea mays
  misc_feature: Ceres CLONE 1563763
  misc_feature: Encodes the peptide sequence at SEQ ID NO. 78773
ctccccgcggtggcggccgctctagaactagtggatcccccgggctgcaggaattcgtctcacccctagaaaaaatcccccacgacacctataagcaccaaccctagcccaaaaccccgcttccacttcacagcctctccgcctccgctcctcgcgccgccgccgcgtctcctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctgttgatcaccgccgcaagaacaaatcccttgagggactgcaggccattgtccagaggcttaagacatacaatgccaagctggttatcttcccaaggcgtgcacacaaggttaaggctggtgactctactccagaggagcttgccaccgctacccaggtccagggtgactacatgccaatttactcgtggtgagaaacgttcagttgaagttgtgaaggtcacagatgagatgaagtcatttgctgcccatgggcagcctcgccctgggccgatgaccagaaacatcttggtgcccgccataataggcacctgaggcaaataggaaaataaaaagggaccgggttgagaatataccccggttttgtctttcagccttatgggatggcaccccttaaaggcctggtccatgttttttttgccggatgggaaatgagcccaaaaaactttttggggtcccacggtgtggaccctgttcttgt

SEQ ID NO: 78773 - protein, 159 aa, Zea mays
  misc_feature: Ceres CLONE 1563763
  misc_feature (6)..(158): Pfam Name: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQAIVQRLKTYNAKLVIFPRRAHKVKAGDSTPEELATATQVQGDYMPIYSW

SEQ ID NO: 78774 - DNA, 912 bp, Zea mays
  misc_feature: Ceres CLONE 1563767
  misc_feature: Translation starting site: 201
  misc_feature: SWISSPROT Homolog: EC 1.1.1.267 1-deoxy-D-xylulose-5-phosphate reductoisomerase
tggagctccccgcggtggcggccgctctagaactagtggatcccccgggctgcaggaattcgtctcacccctagaaaaagtccatccccgtcgccagcatcgcttccacttcggtctcagcgacggtcgccaccaccgctcccctccctctccccctcctcgcccagcggcaattaccacagcctccccagcaagccgggatggctgcactcaaggcatcgttccggggtgagctcagcgccgcttccttcctcgactccagcaggggacctctcgtccagcacaaagtggattttacgtttcaaaggaagggcaaacgagccatttcactgagaaggacatgctgttctatgcaacaggctccaccaccagcatggcctgggcgagctgttgctgagcctggccggaggtcatgggatggcccaaagcctatctcgattgttggttcaactggttccataggaacacagacattggacattgttgcggagaatcctgataagttcagagttgttgctcttgctgctggatccaatgtcacgcttctagctgatcaggtcaaaacattcaaacctaagttggttgctgtaagaaacgaatcattagttgatgaattgaaagaagccttggctgattgcgaagagaagcagaaattattcctggggagcaaggtgtcatagaagttgctcgccatccagatgcagttacagtagtcacagggatagtaggttgtgcagggctgaaagctacagttgctgcaattgaagctggtaaagacatagcattggcaaacaaaggacacttattgcaggtgggtctttttgtgcgtccccttgcacaaaacacaaagtgaaaattcttccagctgattctgagccctcggcaatattcagtggatcaaaggttggtcca

SEQ ID NO: 78775 - DNA, 881 bp, Zea mays
  misc_feature: Ceres CLONE 1563768
  misc_feature: SWISSPROT Homolog: EC 3.2.1.51 Alpha-L-fucosidase
  misc_feature (736)..(736): n is a, c, t, g, unknown, or other
  misc_feature (745)..(745): n is a, c, t, g, unknown, or other
  misc_feature (758)..(758): n is a, c, t, g, unknown, or other
ggagctccccgcggtggcggccgctctagaactagtggatcccccgggctgcaggaattcgtctcacccctagaaaaaaaggacttcaagaagggcgccaacttcgccatcaccggcgcgacggccctggagtactccttcttcaaggcgcacggcatcgaccagcgcatctggaacaccggctccatcaacacccagatcggctggctccaggacatgaagccgtccctctgtaaatcggagcaagactgcaaggattacttcagcaaatccctgttcgtcgtcggggagttcgggggcaacgactacaacgcgccgctcttctccggcgtcccattttctgatgtcaagacttacgtgccccttgttgcaaaggctatcgccaatggcgttgagaaactgatcgagcttggggcaacagacctcctggtgcctggcgttctcccaattggctgcttcccgttgtacctgacgctgtacaacaccagcagcaaagcagattacaacgccccggaccgggtgccttcggaggtacaaccgcctggccttccaccacaacagggagctgaagcagcagcttgacgagcttcagaagaagtacccaagacgaagatcatgtatggagattacttcaaggctgcactgcagtttgtcgtcaccctggggaatttggtttcagcacagctttgcagcgtgctgcggcgccggaaggcagggcaaactacactcaacctgnaagaataantgtgcgagcaggncgcgagcgtgtgctccaacccgtcgtcgtacgtgagctgggatggcatcacatgaaccgagctgcgtacagaaggtcgccgatggctgggtgaatgcccgtatgccagcccccattctcaagt

SEQ ID NO: 78776 - DNA, 940 bp, Zea mays
  misc_feature: Ceres CLONE 1563769
  misc_feature: Encodes the peptide sequence at SEQ ID NO. 78777
  misc_feature (631)..(631): n is a, c, t, g, unknown, or other
  misc_feature (727)..(727): n is a, c, t, g, unknown, or other
  misc_feature (731)..(731): n is a, c, t, g, unknown, or other
  misc_feature (880)..(880): n is a, c, t, g, unknown, or other
  misc_feature (915)..(915): n is a, c, t, g, unknown, or other
ctggagctccccgcggtggcggccgctctagaactagtggatcccccgggctgcaggaattcgtctcacccctagaaaaaacaggagacgtacgctctctgctagcacccatcttgcagcaggcggagtcgcccgacccaatccgtgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgccggcctcgtcgccatcctcagcgtctgcctcaccatgtacggcgtcgcctccttcaacgagggcgacccgntcactgcgcccacgctcacgctcaccggccggtaagaaggaggccgacaagctgcagaccgccgactgctgggccaagttcaccggaaggttcttnctcngtggtatctcccgcgtgctctgggcatactttctcctctacgtgctcgacctcccctactacttcaagtagatacaaatcataaagatgcatatatatatatagctcccgctccgatccctctctctgcgtgcaaggtatgccatttcncagtgacgagcatcgtggatactgcaatcccctgncctgggatgaattgaatagtacctg

SEQ ID NO: 78777 - protein, 167 aa, Zea mays
  misc_feature: Ceres CLONE 1563769
  misc_feature (52)..(168): Pfam Name: PsaL Pfam Description: Photosystem I reaction centre subunit XI
  misc_feature (157)..(157): Xaa is any aa, unknown, or other
MATTAYAPMASQVMKSSPVHSRPRGLSGAALTRPRPRFSVVKAAIQPEKATYQVVQPINGDPFIGSLETPVTSSPLIAWYLSNLPAYRTAVSPLLRGVEVGLAHGYLLVGPFALTGPLRNTPVHGQAGALGAAGLVAILSVCLTMYGVASFNEGDPXTAPTLTLTGR

SEQ ID NO: 78778 - DNA, 954 bp, Zea mays
  misc_feature: Ceres CLONE 1563770
  misc_feature: Translation starting site: 141
  misc_feature (890)..(890): n is a, c, t, g, unknown, or other
  misc_feature (954)..(954): n is a, c, t, g, unknown, or other
ctccccgcggtggcggccgctctagaactagtggatcccccgggctgcaggaattcgtctcacccctagaaaaaacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaagggcgccaagcgcgggttttctgacgaggcgccgacgccatcgcccggtgcagcttccgggaagggaaagaaggtagcggaagaggaggacgacaagaaggttgcagcgacgccgcagccggtcgcaaaagctcagggtggtgggatggccaccaatccgaagctaccgcaagaacacgatgtctaccacccagctgaaggggcagcagggagatgctgaggccaagcaggaccaggggtttcctgtacgtcaaggtcagcatggatggcgcgccgtacctcagggagattgacctcaagacttacaagaactacaaggacctgtcgactgcgcttgagaagaatgtcagtgggctcagtactgggcaagatgggctatctgagtaccgcaaggatggtgaaatatgtctgactacggagacaaggatggagattggatgcttgttgggcatgtacccatggaagatgtcgctgactcttgccgccagctccggatcatgaaaggatcagatgcaattggacttgctcccagggcagctgataagtccagaatcagcactagaatggttgcctcttncagcccaagcaaaagggaaattcccgtgactgtaaggatctttggggagccggaaacctctaan

SEQ ID NO: 78779 - DNA, 943 bp, Zea mays
  misc_feature: Ceres CLONE 1563771
  misc_feature: Encodes the peptide sequence at SEQ ID NO. 78780
  misc_feature (858)..(858): n is a, c, t, g, unknown, or other
ctggagctccccgcggtggcggccgctctagaactagtggatcccccgggctgcaggaattcgtctcacccctagaaaaatttatggacctggatagcattcccaaggacttcttacccatgagggttccatccaatactccaggtaggaattcttccaacaacatccggaggactggtggtggacctagaccaagacgcttggacatgttctcagaaccaagggctggtatgaacatgaggcctgatgaatatgagcgtctgaattctgttccaagaaatggtagctacaggaatttggatgattttgtccaccctggagatcgctccagggataatatgcagtttggacatcctaggaggccaaatgcttctaatggtaggagagaagtctaagtagtgttgctatcaataactctggtacagcatggaacattgatgaagagctctgaacagtccaagattcagcaaggtgcagatgcatgttctgaagatcagttgcttgtgcattagattccttgcaacctttggttgggggtggtcacaataaagcattgctgtcagcggaggatgtgcgaatctaccatgttgtgacctggatcgagaccattcatgataggtgattaaaggctcatgatgtcaggtggaagaaaagctgctgtagccctcagtggtatgaactttgcaggaatttcttttttagatcgaagctgtctgctgtgttttgacgttgcagtccttgctttacccagctcatcttttcgtattatgtacatgcatgggcatttccattttgctgctgcgatcgtgcatgcaggagaaagctcactggtctagatgaagatggtctccacaatgntgctgaattgctgcccgatcgtgcatgcttgattatgtctggtagatcagtatgctacctaggcaacgctcctggtcattttcat

SEQ ID NO: 78780 - protein, 130 aa, Zea mays
  misc_feature: Ceres CLONE 1563771
GAPRGGGRSRTSGSPGLQEFVSPLEKFMDLDSIPKDFLPMRVPSNTPGRNSSNNIRRTGGGPRPRRLDMFSEPRAGMNMRPDEYERLNSVPRNGSYRNLDDFVHPGDRSRDNMQFGHPRRPNASNGRREV

SEQ ID NO: 78781 - DNA, 1219 bp, Zea mays
  misc_feature: Ceres CLONE 1563773
  misc_feature (47)..(47): n is a, c, t, g, unknown, or other
  misc_feature (479)..(479): n is a, c, t, g, unknown, or other
  misc_feature (1011)..(1011): n is a, c, t, g, unknown, or other
  misc_feature (1059)..(1059): n is a, c, t, g, unknown, or other
  misc_feature (1153)..(1153): n is a, c, t, g, unknown, or other
tgaggttggttccctgtccaccttttttgaatatctgtgtgaatggntttctgcaaatgacataactggagctcaccgcggtggcggccgctctacactagtggatcccccgggctgcaggaattcgtctcacccctagaaaaaactcgttttcctccgggcacattcctccgagttcggacggcaacgccttttatggtccccgttgcctcctccttctcgcggttctccttccgctgcgccgtctgaccctccccgctccgcgttcgcttttcgcagccccattcgcccgggcgggtgccggtctgctccaccggggttgctgctccaaaacgcaaaccccagcggctcaagttcgccgccaaacgccccttcacaagactggatagcccgttcctgctagctggagagagagcccctccggcggggaattttcggaaacattgacccccttaaaagaagtgtgttttccccccccncccacacgggtggagccctccttgcaaccgctcctcccccctgggcggggggcctggatgtcacactggaatgcgctttgagcgcgccttctgcccgaaccccaaagggctttggaaaatgttgttaaggtttcaacaacccctcgagggggggtgcatttgcgggcgatcactcaaaacccttccaccccaagggaatcttcctcttatggggcctttaaacccaaggggaaaacctgaaacatatttttccagagaggggtgttaaaaccaggagtaaaaatgaactggggggccttcttagctgctgtttggtgttgttcctgcctgccaggcttgacctgcatatctcgctgccaatttcatgacattttgaaccaactgtggggttgcacacccccctcatacctctttgctgactgaaaaatgcccggcaggtatgtgtgcatacctcccaaatatgcgcgccatataactccccaccttgactgcaagcaaatagtggcggatggcatgtttccggatggccccntggtgccattccctacacgctgggctgcatagcccaggtgccgtgcgncggctggatggccatcgtttttaccaccatgtaactatcctgtcgaatgctgtttgtgttcccctttatgtcggatgaggcctgatgcactggntgtactgggccgccttccccatatccctgcgcccctctcccttgtgtggtaatacctaggggccgg

SEQ ID NO: 78782 - DNA, 1067 bp, Zea mays
  misc_feature: Ceres CLONE 1563774
  misc_feature: Encodes the peptide sequence at SEQ ID NO. 78783
  misc_feature (249)..(249): n is a, c, t, g, unknown, or other
  misc_feature (293)..(293): n is a, c, t, g, unknown, or other
  misc_feature (298)..(298): n is a, c, t, g, unknown, or other
  misc_feature (403)..(403): n is a, c, t, g, unknown, or other
  misc_feature (404)..(404): n is a, c, t, g, unknown, or other
  misc_feature (699)..(699): n is a, c, t, g, unknown, or other
  misc_feature (745)..(745): n is a, c, t, g, unknown, or other
  misc_feature (783)..(783): n is a, c, t, g, unknown, or other
  misc_feature (867)..(867): n is a, c, t, g, unknown, or other
  misc_feature (891)..(891): n is a, c, t, g, unknown, or other
  misc_feature (916)..(916): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (958)..(958): n is a, c, t, g, unknown, or other
  misc_feature (1003)..(1003): n is a, c, t, g, unknown, or other
  misc_feature (1067)..(1067): n is a, c, t, g, unknown, or other
ccccgcggtggcggccgctctagactagtggatccccgggctgcaggaattcgtctcacccctagaaaaagtgttctctgcgcggtcggcccggcgaacttcctctggttcctgatgatggatgtatcgcaagttgccgcagccgtggcgctgatggcgttcgcggtcgcgtttccggcgtcggccttcccgtccggcttcccgcctgggacaccatcagcgttcccgaatccgtgggcggcattccanaacctgtctggctgtcacatgggggaggagcggcagggcctggncgggntcaaggactacctcaccccctttgggtattttccgcctgcgccccccccgtccccctgcggggaggggtgtggaccaaaacctggagggggccatcgcgacggtnnaccgcgaacttcggggtccaaagccgaccggggcctcttgaaacccgtccaccccctgcgtaaaatgagggccgggccttgttgggggggggggcccacccaccccccaccccgcccgccgcgcccttgggggaagaacacccccccccccccctacccccccgccggccatagcgccacaggcaagctggtgtccacccggacgttccccaccggggtgggtgcgaacacaggtgtccccccccctccccccgttcgggggccctctcgctctccccccgcaagagaacttgtngttacacctctcgcaccccaccgcccaccttttaagtcgcgctgtntgccgctataccaccccaaacccacccctcttcgacgnacccacttttctccccttgaggtggtgctcacatcctctttggacccagtgatacattcgggggacggccccctccgctccggnaatgcgcaaactccctatatcggntggccgccatactacccaacacagnggnnnntcgtgtaccccccgcggggctcggggcccacggggngacggtgaggagctgcctgtctctcctcgccgtccgtgtgaggcnttttgcaatctcctcgtttgttcactgcccactcctccccaacgggaggcctccacgcgccccn

SEQ ID NO: 78783 - protein, 282 aa, Zea mays
  misc_feature: Ceres CLONE 1563774
  misc_feature (44)..(44): Xaa is any aa, unknown, or other
  misc_feature (59)..(59): Xaa is any aa, unknown, or other
  misc_feature (61)..(61): Xaa is any aa, unknown, or other
  misc_feature (96)..(96): Xaa is any aa, unknown, or other
  misc_feature (210)..(210): Xaa is any aa, unknown, or other
  misc_feature (267)..(267): Xaa is any aa, unknown, or other
  misc_feature (268)..(268): Xaa is any aa, unknown, or other
  misc_feature (269)..(269): Xaa is any aa, unknown, or other
  misc_feature (281)..(281): Xaa is any aa, unknown, or other
MDVSQVAAAVALMAFAVAFPASAFPSGFPPGTPSAFPNPWAAFXNLSGCHMGEERQGLXGXKDYLTPFGYFPPAPPPSPCGEGCGPKPGGGHRDGXPRTSGSKADRGLLKPVHPLRKMRAGPCWGGGPTHPPPRPPRPWGKNTPPPPYPPAGHSATGKLVSTRTFPTGVGANTGVPPPPPVRGPSRSPPARELVVTPLAPHRPPFKSRCXPLYHPKPTPLRRTHFSPLEVVLTSSLDPVIHSGDGPLRSGNAQTPYIGWPPYYPTQXXXVYPPRGSGPTGXR

SEQ ID NO: 78784 - DNA, 1031 bp, Zea mays
  misc_feature: Ceres CLONE 1563777
  misc_feature: Encodes the peptide sequence at SEQ ID NO. 78785
  misc_feature (400)..(400): n is a, c, t, g, unknown, or other
ctccccgcggtggcggccgctctagaactagtggatcccccgggctgcaggaattcgtctcacccctagaaaaacagaaaaaactcaccgggaagaaggaaccagaagctaaccggcacgtcgtgaagctaaccgggattccgggaagcagagacgtccgcccgtcgcccgtcgtccgtcgtcatggccgccgtggaggtgtgcgtgaaggccgccacggggaagcccgacacgctcggcgactgcccgttctcgcagagggtgctgctcacgctggaggagaagaaggtcccctacgaggtgaagctcgtcgacctcgacaacaagcccgaatggtttctgaagatcagcccacagggtaaggtgcctgtgttcaacggtggtgatggcgaatcccccnctgattctgatgtaatcacccaaaccattgaggagaagttcccaactccatctctggtcactcctgtagaatatgcatcagtgggatcaaagattttcccagccttcatcacattcttggaaaagcaaggatgcctagtgatggtccccaaaaaggcgcttctgggatgacctgcagggccctgggttgaacaatcttcaaagctcaggggcccgttacctcaacgggggaagaaactattccagcagcttgacccttatgcttgggtggcaaaaggctctttcccccttcccgggtcgccacttgggaagcattttcaaaaggcgtgggaagaattccctgtaaaaacctaaacctacggtcccacgcgctttccccatggatctcctttttacaacacttgagatccttttgtgcagaactaagagccctccctaggaagaccattgtatatgccgggatggggcgcccccaaggtgataacccgtaagcccctctctggttttttgctgcctatactgggggaaacaccacccactttctccgaacactctattgacaatggggtggttgtgttggtgttcccatttcgattgcttatgacactttatttcccttggtatacagggcg

SEQ ID NO: 78785 - protein, 128 aa, Zea mays
  misc_feature: Ceres CLONE 1563777
  misc_feature (16)..(84): Pfam Name: GST_N Pfam Description: Glutathione S-transferase, N-terminal domain
  misc_feature: SWISSPROT Homolog: EC 2.5.1.18 Glutathione transferase
  misc_feature (73)..(73): Xaa is any aa, unknown, or other
MAAVEVCVKAATGKPDTLGDCPFSQRVLLTLEEKKVPYEVKLVDLDNKPEWFLKISPQGKVPVFNGGDGESPXDSDVITQTIEEKFPTPSLVTPVEYASVGSKIFPAFITFLEKQGCLVMVPKKALLG

SEQ ID NO: 78786 - DNA, 858 bp, Zea mays
  misc_feature: Ceres CLONE 1563782
  misc_feature: Encodes the peptide sequence at SEQ ID NO. 78787
  misc_feature (797)..(797): n is a, c, t, g, unknown, or other
  misc_feature (837)..(837): n is a, c, t, g, unknown, or other
ctggagctccccgcggtggcggccgctctagaactagtggatcccccgggctgcaggaattcgtctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgcccggtgatccagtgcagcaagggccccttcgacaagtacatgctgttccagctctacttctgcgcggcgggggacggcacgttcatcgactgccccgcgccgcagcagtacaccctgctcaaggagatcccctctcacccctttcagaagtggatgctncagcagcagctcacctagaacgacgaccctttcaagctgncctgcgtcgccatggacaacg

SEQ ID NO: 78787 - protein, 252 aa, Zea mays
  misc_feature: Ceres CLONE 1563782
  misc_feature (30)..(225): Pfam Name: Ribonuclease_T2 Pfam Description: Ribonuclease T2 family
  misc_feature: SWISSPROT Homolog: EC 3.1.27.1 Ribonuclease T(2)
  misc_feature (233)..(233): Xaa is any aa, unknown, or other
  misc_feature (246)..(246): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPGDPVQQGPLRQVHAVPALLLRGGGRHVHRLPRAAAVHPAQGDPLSPLSEVDAXAAAHLERRPFQAXLRRHGQ

SEQ ID NO: 78788 - DNA, 888 bp, Zea mays
  misc_feature: Ceres CLONE 1563783
  misc_feature: Encodes the peptide sequence at SEQ ID NO. 78789
  misc_feature (394)..(394): n is a, c, t, g, unknown, or other
  misc_feature (811)..(811): n is a, c, t, g, unknown, or other
  misc_feature (812)..(812): n is a, c, t, g, unknown, or other
  misc_feature (863)..(863): n is a, c, t, g, unknown, or other
ctccccgcggtggcggccgctctagaactagtggatcccccgggctgcaggaattcgtctcacccctagaaaaaatcccaaacacaacccacactactaccctacccgtccgcctctctcgaaagcgcagcaccagcgagcatgtcgcctgtcaccgcactcctggcgggcacggtggtgccgccggcctcggccccgtcgccagcgaggcacgcccgccattactccgtcggcttctccccgctccacggcggcgggcgcgcggcgctggcggtggagtgctcgtcgcggccgcagaagaaggggaccaagcaccacatgaagacgcggcccaagaagacgcaggccgtgggacatcaagcgccgccccacgcagtacccgccggctgcgccnctccccgcggactggacgctcgtcgcctccggcgccaacggtggaccgtgaaggaggccgaagcccccggcaccccgccccaaattctcggtcctcgaacggggccgcgggcccccaaactgaagccgcccccggcgttgcccccaaaaatttgtccccttgaaccctcccccaaaaaccgtgttttttcttttgaaatttttttttttttaaaaaacaaatggggccgccccaaaattttggggggttttaaaattgtaaaaaattctttttttttggttgttccaaaatgtggggggttgtcccccccccccccaaaaatataaggggccttcctaaaaaaaaattttcttggtgttccccccccttgggtggccaaaccactttttttttccccggccgccccaggggggggannggtgaacaaccccccgggagaggggtattaccgatctctcctttttctccnaaaatattttggcgccgctgagaaa

SEQ ID NO: 78789 - protein, 192 aa, Zea mays
  misc_feature: Ceres CLONE 1563783
  misc_feature (85)..(85): Xaa is any aa, unknown, or other
MSPVTALLAGTVVPPASAPSPARHARHYSVGFSPLHGGGRAALAVECSSRPQKKGTKHHMKTRPKKTQAVGHQAPPHAVPAGCAXPRGLDARRLRRQRWTVKEAEAPGTPPQILGPRTGPRAPKLKPPPALPPKICPLEPSPKNRVFSFEIFFFLKNKWGRPKILGGFKIVKNSFFLVVPKCGGLSPPPPKI

SEQ ID NO: 78790 - DNA, 896 bp, Zea mays
  misc_feature: Ceres CLONE 1563784
  misc_feature: Encodes the peptide sequence at SEQ ID NO. 78791
  misc_feature (651)..(651): n is a, c, t, g, unknown, or other
  misc_feature (687)..(687): n is a, c, t, g, unknown, or other
ctggagctccccgcggtggcggccgctctagaactagtggatcccccgggctgcaggaattcgtctcacccctagaaaaaatcgatcgatctccaccgttccttctccccgttcctaatgtcagccgtgcagcctctccactgcgcccacttcttatactcccaccttctgctccctctcacggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaagggagttgataatgagactccatacactattatgtttggtccagatnaatgtgggtcaaccaaacagggtcatttcatccttnaagcacagatcctaagactggaaagtatggtgagcatcacctcaaattcccaccttctgtccatacgaacagctctctcatgtctaccagctatcttgaagccagacaatgagtcagaaatttgatcgatgggaaaaaaagaagaggcgaaactccttctgctgatgactttgagccagcactattccatccagacaatcctgacccga

SEQ ID NO: 78791 - protein, 189 aa, Zea mays
  misc_feature: Ceres CLONE 1563784
  misc_feature (24)..(189): Pfam Name: Calreticulin Pfam Description: Calreticulin family
  misc_feature (137)..(137): Xaa is any aa, unknown, or other
  misc_feature (149)..(149): Xaa is any aa, unknown, or other
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKGVDNETPYTIMFGPDXCGSTKQGHFILXAQILRLESMVSITSNSHLLSIRTALSCLPAILKPDNESEI

SEQ ID NO: 78792 - DNA, 884 bp, Zea mays
  misc_feature: Ceres CLONE 1563785
  misc_feature: Encodes the peptide sequence at SEQ ID NO. 78793
  misc_feature (327)..(327): n is a, c, t, g, unknown, or other
  misc_feature (329)..(329): n is a, c, t, g, unknown, or other
  misc_feature (335)..(335): n is a, c, t, g, unknown, or other
  misc_feature (340)..(340): n is a, c, t, g, unknown, or other
  misc_feature (371)..(371): n is a, c, t, g, unknown, or other
  misc_feature (866)..(866): n is a, c, t, g, unknown, or other
ctggagctccccgcggtggcggccgctctagaactagtggatcccccgggctgcaggaattcgtctcacccctagaaaaatcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctcgccgggggggcgcccgcngnccgggnacaanctctcggtggaggagcgcaacctgctgtccntcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaagccgagcttgccccgcatctgcgacggcaatcctcgcgcttcctcgactcccaacgtcgaacccaatccggccgggcgggccccgagtccaaagggccttccacctccaaaaataaaagggggaataacccccgggggacctcttgcggaagtttccaggtcccggggggcccaaaagggaaaggggttttctcctggaaaaaccaccccataataatgttcctcaaaaaaagccgcttccacgggaaaattcgccccctttgccaaaaaaagggggggccccaaaaaaccccccccccaaaaaagggggttgggggggcttttttctccttcacaaatctctccgggggggggtgtttttcanataaaaaagaagaattcc

SEQ ID NO: 78793 - protein, 228 aa, Zea mays
  misc_feature: Ceres CLONE 1563785
  misc_feature (8)..(226): Pfam Name: 14-3-3 Pfam Description: 14-3-3 protein
  misc_feature (43)..(43): Xaa is any aa, unknown, or other
  misc_feature (44)..(44): Xaa is any aa, unknown, or other
  misc_feature (46)..(46): Xaa is any aa, unknown, or other
  misc_feature (47)..(47): Xaa is any aa, unknown, or other
  misc_feature (58)..(58): Xaa is any aa, unknown, or other
  misc_feature (223)..(223): Xaa is any aa, unknown, or other
MSPSEPTREESVYMAKLAEQAERYEEMVEFMERVARSPGGRPXXGXXLSVEERNLLSXAYKNVIGARRASWRIISSIEQKEEGRGNEAHAASIRAYRSKIEAELAPHLRRQSSRFLDSQRRTQSGRAGPESKGPSTSKNKRGNNPRGTSCGSFQVPGGPKGKGVFSWKNHPIIMFLKKSRFHGKIRPLCQKKGGPQKTPPPKKGVGGAFFSFTNLSGGGCFSXKKEEF

SEQ ID NO: 78794 - DNA, 939 bp, Zea mays
  misc_feature: Ceres CLONE 1563786
  misc_feature: Encodes the peptide sequence at SEQ ID NO. 78795
ctccccgcggtggcggccgctctagaactagtggatcccccgggctgcaggaattcgtctcacccctagaaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcccttctggtacaccgcctgcgagcagcagtacttcaccgacaccaccaccctcttcatcatcgagctcatcctcatcggctgggccgaaggccgccgctgggctgacatcatcaagcccggaagcgtcaacaccgaccccatcttcccaggtacaagctcaccggcaccgacgtcggggtaccctggtggcctctggtttgaaccgctcggctggggcagctgctcgcccggagaagatcaggagctgcgcaccatgagatcatgaacggacgcctcgcatgctcccgtcatgggcccctggttccagccgagtaaaccgggaccggcccattgaaaacttttcgccaccttggcgaacctggcaagcaaccttcttcagggcttccccccaaagaagggtggacttatattggcattttgggatgcaccaccatggctctcagttgaagccc

SEQ ID NO: 78795 - protein, 213 aa, Zea mays
  misc_feature: Ceres CLONE 1563786
  misc_feature (63)..(210): Pfam Name: Chloroa_b-bind Pfam Description: Chlorophyll A-B binding protein
MALVSASSSSTTAVTALPRNGQRASSSFLGGKTLLRQAEAARPSFAVRAAADPNRPIWFPGSTPPPWLDGSLPGDFGFDPWGLGSDPESLRWNVQAELVHCRWAMLGAAGIFIPEFLTKIGVLNTPFWYTACEQQYFTDTTTLFIIELILIGWAEGRRWADIIKPGSVNTDPIFPGTSSPAPTSGYPGGLWFEPLGWGSCSPGEDQELRTMRS

SEQ ID NO: 78796 - DNA, 965 bp, Zea mays
  misc_feature: Ceres CLONE 1563787
  misc_feature: Encodes the peptide sequence at SEQ ID NO. 78797
  misc_feature (719)..(719): n is a, c, t, g, unknown, or other
  misc_feature (820)..(820): n is a, c, t, g, unknown, or other
  misc_feature (965)..(965): n is a, c, t, g, unknown, or other
ctccccgcggtggcggccgctctagaactagtggatcccccgggctgcaggaattcgtctcacccctagaaaaatttcagatcaagccagtccttgaggaggccactagagcagcatactcagctctcctccctcaaaccatggtcgtggccgacttaggctgctcatcggggcctaacacactgcgcttcatctccgagttcaataagtcgatggcaagaaaccacaagggtgaggcagccgaggcactgcctccgtgctatatctctggtttgccaggctccttctacactaggatcttccctagcgaaagcgttcaccttttccactctttgttctccgttcactggcactctcaggcatcagaacaactgaaggacaccaaaaataaatgcctagatatctacatcacaaagaatatgccaccgtcgatggtgaagttgtttcaacagcagtttgagaaggacttctccctcttcctcaagctacgctatgaggaactcgtgtctggtggccaaatggttctaacatttattggaagaaagcatgaggatgtgttcactggagagtccaaccatctttacggattgcttgcgcagtcactgaaatccctagttgatgagggtcttgtggagaaagaaaaacttgagtcattctatcttccgatctactcaccgtcgggttggtgaagtggaggcgatagtgaagcaaagtggggntgtcaacatgaatcatgttaaagtatttgagaataatggggatcccctacgtgactcagaaggtgatgatgtgcatgacagtattaggagcggtgaaaatnggtgctagtgcctacgagcaagtatgggagccgtgggttgcagccatttggagaaccatactcgacaagttatcaaagagtacgctcgtcgtgttgccaacaccttgagaatgagaaaaccagcatgctattctgtctatccatn

SEQ ID NO: 78797 - protein, 228 aa, Zea mays
  misc_feature: Ceres CLONE 1563787
  misc_feature (31)..(229): Pfam Name: Methyltransf_7 Pfam Description: SAM dependent carboxyl methyltransferase
  misc_feature: SWISSPROT Homolog: EC 2.1.1.141 Jasmonate O-methyltransferase
PRGGGRSRTSGSPGLQEFVSPLEKFQIKPVLEEATRAAYSALLPQTMVVADLGCSSGPNTLRFISEFNKSMARNHKGEAAEALPPCYISGLPGSFYTRIFPSESVHLFHSLFSVHWHSQASEQLKDTKNKCLDIYITKNMPPSMVKLFQQQFEKDFSLFLKLRYEELVSGGQMVLTFIGRKHEDVFTGESNHLYGLLAQSLKSLVDEGLVEKEKLESFYLPIYSPSGW

SEQ ID NO: 78798 - DNA, 863 bp, Zea mays
  misc_feature: Ceres CLONE 1563789
  misc_feature: Translation starting site: 154
  misc_feature: Pfam Name: DUF1295 Pfam Description: Protein of unknown function (DUF1295)
  misc_feature (748)..(748): n is a, c, t, g, unknown, or other
ctggagctccccgcggtggcggccgctctagaactagtggatcccccgggctgcaggaattcgtctcacccctagaaaaaagagcagctccattccattgccccttgctcatcaccaccactctagtgactagcacacccaccgacgattttcatggccggcggcagcatccttaagaacatgggagtcgccttccttgtcccgctcgcttccaaccacttctacctctcctacgtccgcgccgggggggacactggtgccagcctggtcgcctagtggtgcgtctcgcacctttttctcctcgcaaaagttctcttgttcctcaacgtggacatgctcttctggctcggaggcctactcctctctgaccactggctcatcgacctgtactgggagcgtcatccatgtgatgctgctgcactactacctgggccactcggcatccgtggcggacgctgcgaggtctgccgaggccgtggctctcatgtgggcgtggagaggcaggcttacgcagaactacgtcaggccggaaggttggggagtttgacaatcgctatgactggaggttttacgagatgagcggccattctgacccctcctcgcaggagcatgttgttcttgggggtctacatctaccagtaggtgttcctgatcggtatctgcctggcgatgtacgacatccactctcgttatctcccatgagacgtctgggaatcgttggccgaagccatgtgtcgtgcgagcatcntcatcgttacttcgctgacaccatggtgttagagtcgtgactgtcacgagatgataagcggatgggacagcaacgttctgacttcgaggatggctgtagccgactcgacccctaa

SEQ ID NO: 78799 - DNA, 913 bp, Zea mays
  misc_feature: Ceres CLONE 1563791
  misc_feature: Encodes the peptide sequence at SEQ ID NO. 78800
ctggagctccccgcggtggcggccgctctagaactagtggatcccccgggctgcaggaattcgtctcacccctagaaaaaaagggcagcagagaaagcagctgagcgctgactgtggatctcatccgtatcgcgtatatacgtcgtcctgtttggatccaccgcgttttgctaattcccttcgaaccggccggtggccttcgttctcccaccaggcctgtctgtctgctgtatccgccagagcttccatggattccaccctcttcatcatcggcgtcataggcaacatcatctcagttctcgtcttcatatcgcctatcaagacgttctggaggatcgtgcggggcgggacgacggaggagttcgagccggcgccgtacgtgttgacgctgctcaacgcgctgctgtggctctactacggcctcaccaagcccgacggcttcctcgtcgccaccgtcaatggctttggggctgtcatggaggccatctacgtcgtcctcttcatcgtctacgccgccaaccatgccacaagggttaagaccgcaaagctgggagcagcgttggaacatcggtggcttcggaaacgtgtttggcggccacccacattcgcccgtcagcgaattttgaattgcagaattatgggttatagggaatgataagttccacttcctcaatggggcaacatgacagggctccacccctccgcttcttgggaaaaccgggctattcacctaagaatacgcggtggagagttctggccaattcattccccggtcctcttccctccaacgttccttcacacggaagccttttatgggctaaatgtaatctctgggtcgcttgataccgcgaggtgacttgaggagcaggagtactctggaaaggagggaatagggcttacgctgtcgttttgg

SEQ ID NO: 78800 - protein, 135 aa, Zea mays
  misc_feature: Ceres CLONE 1563791
  misc_feature (6)..(93): Pfam Name: MtN3_slv Pfam Description: MtN3/saliva family
MDSTLFIIGVIGNIISVLVFISPIKTFWRIVRGGTTEEFEPAPYVLTLLNALLWLYYGLTKPDGFLVATVNGFGAVMEAIYVVLFIVYAANHATRVKTAKLGAALEHRWLRKRVWRPPTFARQRILNCRIMGYRE

SEQ ID NO: 78801 - DNA, 951 bp, Zea mays
  misc_feature: Ceres CLONE 1563792
  misc_feature: Translation starting site: 246
  misc_feature (328)..(328): n is a, c, t, g, unknown, or other
  misc_feature (375)..(375): n is a, c, t, g, unknown, or other
  misc_feature (395)..(395): n is a, c, t, g, unknown, or other
  misc_feature (453)..(453): n is a, c, t, g, unknown, or other
  misc_feature (890)..(890): n is a, c, t, g, unknown, or other
  misc_feature (900)..(900): n is a, c, t, g, unknown, or other
  misc_feature (902)..(902): n is a, c, t, g, unknown, or other
  misc_feature (915)..(915): n is a, c, t, g, unknown, or other
ctccccgcggtggcggccgctctagaactagtggatcccccgggctgcaggaattcgtctcacccctagaaaaagatcagctcgcttcgtgacttctctctcctctcgatcgattgcttcctccaccgaggcgggggaaagcgccgcccagatcgccgtaggcaagcggcgatcactccagctttgagcataagggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcngctttgtgatcgatagagaagagtgcttctcgcataacgtggagtantgagggggatactgtccatngtatccttcgtcgtcatcaaggctgacaccccgtggcattacagcgaagaaggcgttngatcttgtggttaaggatcctaatggcgctcaagtccgtgattctcgagataagactagtgataagtttgagttcatagttcagaagaagagcgtccatcgcttctgcttcacgaataaatccccgtaccacgaaactatagacttcgacgtgcatgttggccatttttcatacttcgagcagcatgccaaagatgagcattttgcaccacttttcgagcaaatagccaagttagatgaggcactttacaatatccagtttgaacagcactggctagaggcccaactgacccgtcagcaatatggaacgagacatgagcaggagggcagtccacaagcactcttcgagtcggcggcactgttcgtgggcagcgtcatccaagtctatcttctgcgcggctcttcgagcgcaagctggggacgtctagggtaaaagcntcactggttncnacctctcctgtantaagcacatgatcgtatcgacttaaccgttatggtc

SEQ ID NO: 78802 - DNA, 799 bp, Zea mays
  misc_feature: Ceres CLONE 1563793
  misc_feature: Encodes the peptide sequence at SEQ ID NO. 78803
ctggagctccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccgggagacgatccgcgacccgcgcggggttcgccgtgaagttctacacccgcccagggcaacttggaacctggtggggcaaaaactttccccggctttctttaatccgcgacggaattcaagtttccccgaaagggaatcccggcgtttaaagcccaaaccccgggttcccccttgcaggaataatggggggggggggttccaaattccggtcgcaccctcccccgaaaggtgtggaaccttttttttttctttttttaaaaaaagggggggggggccttccaaaatcccgccaacgggggagggggtgcg

SEQ ID NO: 78803 - protein, 124 aa, Zea mays
  misc_feature: Ceres CLONE 1563793
  misc_feature (18)..(125): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPGDDPRPARGSP

SEQ ID NO: 78804 - DNA, 893 bp, Zea mays
  misc_feature: Ceres CLONE 1563794
  misc_feature: Encodes the peptide sequence at SEQ ID NO. 78805
tccccgcggtggcggccgctctagaactagtggatcccccgggctgcaggaattcgtctcacccctagaaaaatagacgcaccccttcctcgtttcgccgcctccgccgacaccgactgcctacctcagctgccgtcgccatgggcagaaggcctgctagatgctatcgccagatcaagaacaagccataccctaagtccaggtactgccgtggtgtccctgaccccaagatcaggatctacgatgtcgggatgaagaggaagggtgttgatgagttcccctactgtgtgcaccttgtctcttgggagaaggagaatgtctccagtgaggcgctcgaggctgcccgcattgcctgcaacaagtacatgaccaagtctgcaggaaaggatgccttccaccttagggtccgggttcacccgttccatgtcctccgtatcaacaagatgctttcgtgtgctggggctgataggctccagactggaatgaggggtgcctttggcaagcctcagggcacctgtgctagggtggacattggtcaagtcctcctttccgtgcgatgcaaggacaacaatgctgcacatgccagcgaagctctgcgtcgcgctaagttcaagttccctggccggcaaaagatcattgagagcagaaagtggggcttcaccaagttcagccgcgctgactacctgagtacaagagcgaagggtagaattgttcctgatggttcaaacgcaagctgctcggcaccacggcagacttgagagcgtgctcctgggagggcttcctcgatgcccttgctttagtgcgatgccaaatccgacgttttgctttaccgatacttaccttgcctcctggaaacggaattcaaggggtttgaaggtttacaggggcctttg

SEQ ID NO: 78805 - protein, 205 aa, Zea mays
  misc_feature: Ceres CLONE 1563794
  misc_feature (5)..(167): Pfam Name: Ribosomal_L16 Pfam Description: Ribosomal protein L16
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLSTRAKGRIVPDGSNASCSAPRQT

SEQ ID NO: 78806 - DNA, 842 bp, Zea mays
  misc_feature: Ceres CLONE 1563795
  misc_feature: Translation starting site: 161
  misc_feature (641)..(641): n is a, c, t, g, unknown, or other
  misc_feature (642)..(642): n is a, c, t, g, unknown, or other
  misc_feature (715)..(715): n is a, c, t, g, unknown, or other
  misc_feature (722)..(722): n is a, c, t, g, unknown, or other
  misc_feature (724)..(724): n is a, c, t, g, unknown, or other
  misc_feature (732)..(732): n is a, c, t, g, unknown, or other
ctggagctccccgcggtggcggccgctctagaactagtggatcccccgggctgcaggaattcgtctcacccctagaaaaaagcctgactcctccagtcctcacccctgcttgccgcgaacaaagcacagcagactcactatctctccgtggccggcaaacatgatgtccggcggtgggtactccgccctcgacgaccccaaggcctccggatccgtcccggcggccaccgggacagatccgcaggccatcaggtttgccgattccaacctccagacgttcccgccgtccgaggccaggggcaagatcgctggcgcctaccgcccgcccaccgacgccgacgataccttctcgtccaagggcggaggagccggaagcggtggcagaggcggcagcgcagcgtcggatgatgccgcgcagggcggctggttccgcatgttctccgtggcggcgtacaagccctacttcgacgtcgacacgtctgacgttgtcgagaggatctgggagtccgtcttccccttccgcggcacatttaccgagaagacctccgagaacccccgacctgtatgggccattttggacatgcaccaccctgattttcgttgctgcatctattgctacttttgtcacctacctatcccanncaatggcacagaaggaatggaactatgatatcaacttggttacctggtctgctgggtttatctatggctacgngacattngntccctctncttttaaatggtaattcccaggacttctcagcaccttgctggtttgggtgcaatgtggggcccaaaaagggaattccccggttaaaatcaatcccagcatggctttttgt

SEQ ID NO: 78807 - DNA, 955 bp, Zea mays
  misc_feature: Ceres CLONE 1563798
  misc_feature: Encodes the peptide sequence at SEQ ID NO. 78808
  misc_feature (616)..(616): n is a, c, t, g, unknown, or other
  misc_feature (671)..(671): n is a, c, t, g, unknown, or other
  misc_feature (830)..(830): n is a, c, t, g, unknown, or other
ctccccgcggtggcggccgctctagaactagtggatcccccgggctgcaggaattcgtctcacccctagaaaaaagtccagcaccccccctccctccctatctctctgatctctccctcgctctcgcagccgccactgtagaagcttcgaggctgctgctgcgcccatggccgcggaagccaagacgccgtccctcgctgaggaatattcacttccaccacaggaagttccagtggaaaaggcagctgaggagaagccctctagtggtactgagactgaatctgctccttcaaccaatgatgagactccttcatctgtagaagataagaatgaaacgtctgaagtacaagatgctgctgaaaagtcagacgcagaagaaactaacactgctgcagaggaagcaagtgagactgccgaggaggaagaggctgagaaacctgagatcaagattgaaacagctccagcagattttcgtttcccaacaacaaatcaaacgaggcattgtttcacacgctatgttgaataccacaggtgtgtggctgcaaaaggtgaggatgcacctgagtgtgataagtttgccaagtactatcgatccctgttgccaggtgaatgggtngaacgctggaacgagcagcgtgaaaatggcaccttccctggacctctgtaatccntacatgcaaaaggattaggaactcacgatgttgtgccggccttcctcttgggtactgggcgctagttagcagggagagagacaaatcatcctctttggagctctctacaaataagagattctttttgacttgaagatgcccttgtgcctctctaacggncctgtctgcgctgctgaaatacagcgtcccagtacccttttgtccggatttcagttttaaaaaaggatctggatcccccatctttgcccggtacacaccacctgactgggctacggggaaatcca

SEQ ID NO: 78808 - protein, 166 aa, Zea mays
  misc_feature: Ceres CLONE 1563798
  misc_feature (93)..(165): Pfam Name: COX6B Pfam Description: Cytochrome oxidase c subunit VIb
  misc_feature: SWISSPROT Homolog: EC 1.9.3.1 Cytochrome-c oxidase
MAAEAKTPSLAEEYSLPPQEVPVEKAAEEKPSSGTETESAPSTNDETPSSVEDKNETSEVQDAAEKSDAEETNTAAEEASETAEEEEAEKPEIKIETAPADFRFPTTNQTRHCFTRYVEYHRCVAAKGEDAPECDKFAKYYRSLLPGEWVERWNEQRENGTFPGPL

SEQ ID NO: 78809 - DNA, 785 bp, Zea mays
  misc_feature: Ceres CLONE 1563799
tggagctccccgcggtggcggccgctctagaactagtgggatccccccgggctgcggattcgtctcacccctagaaaagattttccttcgactcgcatcatggcgttcctcagatctccgcagagccctcggctctgctcgtcatcgcgcagcggcgcgatcgtctcgcccgccacgccgacgaggtgtggccctgacggaagcgacttccaaaagaggtcgggcaggaacgcgggcgccctccttcaagtttctacccccccatggggggggggccccctgccaaaaaaaaagttttttccccccccccggaggttttttaaaaaaaaatttggggccccccgttttgaaagggcggaaaaactttccctgaaaaaaccaaagggtttctttttttttaacgccccaaaaagttgtttttcccccacaaattgggggagattttttggggggccccccccccccatttttttgggttgtttctcaaaaaaaaggtttccctgggggcccaaaaaaaaaaaaattggggggggcccccccctctctttgggggaaaacccccccccccccaaaaaatttttttttttcacacaaaaaaaaagagggggggccccccttttgttaaaaaaaaaaaagacccccctcctcttttctctaagaagggggggggggggggtgtttttttttttttttttaaaaaaaacaaacctttttttaaaaattttttttttttttttttttagaaaaaaaaaaaaaaaaaaaaaatttttttttttttttttttt

SEQ ID NO: 78810 - DNA, 908 bp, Zea mays
  misc_feature: Ceres CLONE 1563803
  misc_feature: Translation starting site: 176
  misc_feature (534)..(534): n is a, c, t, g, unknown, or other
  misc_feature (535)..(535): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (570)..(570): n is a, c, t, g, unknown, or other
  misc_feature (571)..(571): n is a, c, t, g, unknown, or other
  misc_feature (573)..(573): n is a, c, t, g, unknown, or other
  misc_feature (575)..(575): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (582)..(582): n is a, c, t, g, unknown, or other
  misc_feature (586)..(586): n is a, c, t, g, unknown, or other
  misc_feature (592)..(592): n is a, c, t, g, unknown, or other
  misc_feature (593)..(593): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (619)..(619): n is a, c, t, g, unknown, or other
  misc_feature (622)..(622): n is a, c, t, g, unknown, or other
  misc_feature (638)..(638): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (663)..(663): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (681)..(681): n is a, c, t, g, unknown, or other
  misc_feature (682)..(682): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (712)..(712): n is a, c, t, g, unknown, or other
  misc_feature (713)..(713): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (732)..(732): n is a, c, t, g, unknown, or other
  misc_feature (734)..(734): n is a, c, t, g, unknown, or other
  misc_feature (736)..(736): n is a, c, t, g, unknown, or other
  misc_feature (737)..(737): n is a, c, t, g, unknown, or other
  misc_feature (739)..(739): n is a, c, t, g, unknown, or other
  misc_feature (740)..(740): n is a, c, t, g, unknown, or other
  misc_feature (744)..(744): n is a, c, t, g, unknown, or other
  misc_feature (745)..(745): n is a, c, t, g, unknown, or other
  misc_feature (757)..(757): n is a, c, t, g, unknown, or other
  misc_feature (759)..(759): n is a, c, t, g, unknown, or other
  misc_feature (763)..(763): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (785)..(785): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (812)..(812): n is a, c, t, g, unknown, or other
  misc_feature (813)..(813): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (825)..(825): n is a, c, t, g, unknown, or other
  misc_feature (826)..(826): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (853)..(853): n is a, c, t, g, unknown, or other
  misc_feature (858)..(858): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (883)..(883): n is a, c, t, g, unknown, or other
  misc_feature (884)..(884): n is a, c, t, g, unknown, or other
  misc_feature (896)..(896): n is a, c, t, g, unknown, or other
ggagctccccgcggtggcggccgctctagaactagtggatcccccgggctgcaggaattcgtctcacccctagaaaaaatgccatgcccgccgcgatcgacgtaggaggagagggaggtgttagcaggcttattcgatcggctcgcgccattgcaccgcagcagcgttcggcggcatgtcgtcgtcgccggagacggaggccgccgggagcagcagcagcagcaggaagttcaagggcgtgcggaagcgcaagtggggcaagtgggtgtcggagatccggctgcccaacagccgcgaacgtatctggctgggctcctacgacgcccccgacaaggccgcgcgcgccttcgacgccgccttcgtctgcctccgcggccgcggcgccgccggcgcggacctcaacttcccggactcgccgccgccgtgccgcgcggggggccgcagcagcgaccccgcgggaggtgcaggcggccgcgctctcccacgccaaccgcgccgccgtcacggcccagcaggcggccgccgcctacaganngnnnnnnnggggggggggggggggggttttatttnncntntnnnntntttntttttnngggggttttnnntnnnnnnnnnnntnttntttttttttttttttnttttttttttttttttttttnnntnttnnnntttttttttttnntttttttnnnntnnnnntttnnnntttttnntttnnnntttttttttttntntnntnntttnntttttttttttntntttntnnnntttggnnnnnnnttttntnnnnnnnttnnntttttggttnnntnnttttnnnttttnnttttttttnnntnnnttttnnnttttnttttnttnnntttttttttttttttnnntnntttttttttttntttggtttttgt

SEQ ID NO: 78811 - DNA, 713 bp, Zea mays
  misc_feature: Ceres CLONE 1563804
  misc_feature: Encodes the peptide sequence at SEQ ID NO. 78812
ggagctccccgcggtggcggccgctctagaactagtggatcccccgggctgcaggaattcgtctcacccctagaaaaaaaattatgccatcaaacttaagtctgatagcagttcctggcagaaccagatttcgtctctcattgagagagcaaaaggtcgagcagttacactcatggaatctacacttcagctgtcaaatattgaccttatttttgcatacacgatcaaaggaaaaacaggcagttccatgagagccacatcatttgttcagaatgatattctgagtccaacccttgatgatgctgtgaatttactaggtgactactcgacatggttgagttctagcaatacccgcgaagcaaatgtatatttgggagtgtttctgtgaaagaatggggatgcactgtttgctccggaaaaaaggctctgttagatcaaatgggcttgttatgaagggaggaactcccctaaagcactggaaggctcaatgcagtgctgccgcaaaaatttgaaaaggaaatcgaaattgcttttgaaaatttggagggctaggattgctggaatgccccccttttttgttaaacctggtttttgcaatcccccttaaagaaattttttgccccttggcttttttccaaaggggggggggttttttttgtttttaaaaaaaatttccccgggggggggggggaaaactttttctaaaaaaaaaa

SEQ ID NO: 78812 - protein, 71 aa, Zea mays
  misc_feature: Ceres CLONE 1563804
MESTLQLSNIDLIFAYTIKGKTGSSMRATSFVQNDILSPTLDDAVNLLGDYSTWLSSSNTREANVYLGVFL

SEQ ID NO: 78813 - DNA, 848 bp, Zea mays
  misc_feature: Ceres CLONE 1563806
  misc_feature: Encodes the peptide sequence at SEQ ID NO. 78814
caaagctggagctccccgcggtggcggccgctctagaactagtggatcccccgggctgcaggaattcgtctcacccctagaaaaagccctcttccgttccgtctcattctcatccccgacccccgcaccgcagcgtaaaccctagtccccggcggcgaccttgcggcctccgctgcgctctgactggtgcgcgtttagacgaggagctgcggcggtcaagaccgatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcagtgatgagaggttatctgcgcttggcagttgcatagcctgcaatgaccatgttgcacttacgcaccctgaccttgatcaggagactgaggagttcattgcagatgtgcttggggatcgaggtgtttaggcccactaatgctggaatatccttgggggggagatacggcggcctctctacagggggtgggttgggttgcgacccataccatccgttaaagaccttgaacaaattctccaagctccttgcgagttctttttgttccagagacctttcaaccaaaaaaacggagttttttgttgccgccttaaaaattaaacccccggaac

SEQ ID NO: 78814 - protein, 138 aa, Zea mays
  misc_feature: Ceres CLONE 1563806
  misc_feature (3)..(138): Pfam Name: eIF-6 Pfam Description: eIF-6 family
MATRIQFENNCEIGVFSKLTNAYCLVAIGGSENFYSAFEAELADAIPVVKTSIGGTRIIGRLCVGNKNGLLLPHTTTDQELQHLRNCLPDQVVVQRSDERLSALGSCIACNDHVALTHPDLDQETEEFIADVLGDRGV

SEQ ID NO: 78815 - DNA, 945 bp, Zea mays
  misc_feature: Ceres CLONE 1563808
  misc_feature: Encodes the peptide sequence at SEQ ID NO. 78816
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (109)..(109): n is a, c, t, g, unknown, or other
  misc_feature (143)..(143): n is a, c, t, g, unknown, or other
  misc_feature (155)..(155): n is a, c, t, g, unknown, or other
  misc_feature (691)..(691): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaactgggactccccncggtggcggccgctctagaactagtggatccccncgggctgcaggnaattcgtctcacccctagaaaaaagcacagccacgcacaggggtcaggtcagtcgcctacgaaattcaatagcacagcgagagccaaggaagaagaagaagcaagcggagcgccatggcggcgtccaacggcgagggccacggccggttcgacgtgatcgtggtgggcgcgggcatcatgggcagctgcgccgccctacgcggcgtcctctcgtggcgcgcgcgtgctgctcctggagcggtcgacctgctccaccacgggggctctcgcacgggaaagtcgggaccaattcgggccaactacccgaaaggggataacccggccaatgggggcccctgtcccgggccccttttggaaaaaagccccaggcccaaaccccggggaaaccctgggttttagcccccccccccaaactttttaaattgggggcccccgggggaaaaaaactaggggctctttttcccccccccacaaaaaaaaaaagggggtttccccccccaaaaaaatctcctcccgggggggagaaaaaaaaaatntccccccggggccggggggggggaaagggggtttttatagggggcccccccccccaaaagggtgaaacaacccccccccccaaaaaaaaaaaaaaaggggggggggggggttttttataaaagagccccccccacggggggggggggggggcgcttttttttttttaggggggggggctcccccccccaccaaaaaaaaaaagaggggccccccctctctccccaagagaaaaaaaaaaaaattactatggggg

SEQ ID NO: 78816 - protein, 94 aa, Zea mays
  misc_feature: Ceres CLONE 1563808
MAASNGEGHGRFDVIVVGAGIMGSCAALRGVLSWRARAAPGAVDLLHHGGSRTGKSGPIRANYPKGDNPANGGPCPGPLLEKSPRPKPRGNPGF

SEQ ID NO: 78817 - DNA, 1270 bp, Zea mays
  misc_feature: Ceres CLONE 1563809
  misc_feature: Encodes the peptide sequence at SEQ ID NO. 78818
  misc_feature (55)..(55): n is a, c, t, g, unknown, or other
  misc_feature (64)..(64): n is a, c, t, g, unknown, or other
  misc_feature (65)..(65): n is a, c, t, g, unknown, or other
  misc_feature (1190)..(1190): n is a, c, t, g, unknown, or other
ttactctttgttgcctctcgccccccgggcaccggctcaacactacacaaaaaangaggatctnnttatatgtggagctccccgcggtggcggccgctctagaatagtggatcccccgggctgcaggaattcgtctcacccctagaaaaaattaacttccgccccccaaaatccaaaagcagcgcagcgagggaagcggtcacgcgccgccatgggctaccaggatgcgccgggcggcggcgggaagctatcgctcgccagcgtgggcttcgacggcccgggcgcgggggcaggagggggcggctacaaggagctgctcgtcatggcgctgcctcaggacgacggcctcgacagcgccaaggtctcggaggccatcggcgtcaggctaccggacgtcggagggggcgtgaggactgttttggagagcagagaggcccgagaatttgctaatgggagcactagcgggccccccgtcaaagctattttttggtcctttagagaccatccggacaaggatggtttgcaggaaagaggggcctgggcaaattttttgggaggtgtggcgggaagatcccttgaaacaaaaatggggtgggcaaagggcttttgggggcaggaaaaaacaaagcgcaaaagggcctcgggagattaatttgcaaacaaaaatgcagttcttaaaactcggtgaacactctatgaaatgtggtgcccatgaggggaaccccgggcttgaaaaggcccccaagagagaaatggggaaaaggaacgaaggggggatttcccctcaaggaagatcccaaacttggtgggtataatatttgtaaaaaattgtgggggatcttctcacattctccgcaacgctgttttatgatctcctcgcgggttggacccgacaacgagatcgtggtagtcccggctgggcgaagggataaaatataggtggtcagtactttttggggagtgagtgccatatacctctgcctccaatgatatttgtactccaaagaaacacacatcggggagctcttccctaatctcacgaaagggaggtttcctacaacagaaggtaatgaaacctcttgggcgccttgtagagtagagagtatattgcctgtgaaattctgaacacgaattgttgtagcgggggggtgtcaccaaaatacggtggagcggctgctgcgcccgaaaancactatattggggctagaggcttgtgtctttgattgcgacacagggcggataggtacttgtttggggttgaaacacaacc

SEQ ID NO: 78818 - protein, 146 aa, Zea mays
  misc_feature: Ceres CLONE 1563809
MGYQDAPGGGGKLSLASVGFDGPGAGAGGGGYKELLVMALPQDDGLDSAKVSEAIGVRLPDVGGGVRTVLESREAREFANGSTSGPPVKAIFWSFRDHPDKDGLQERGAWANFLGGVAGRSLETKMGWAKGFWGQEKTKRKRASGD

SEQ ID NO: 78819 - DNA, 916 bp, Zea mays
  misc_feature: Ceres CLONE 1563813
  misc_feature: Encodes the peptide sequence at SEQ ID NO. 78820
gcggtggcggccgctctagaactagtggatcccccgggctgcaggaattcgtctcacccctagaaaaagcagagcccagagtccgcccgtgacaacccgtagcgtctctgatctctctcgtgactcccggtccggaggagcacaggcatggagctggagcagaagccgccgccgccgccggcggggtactggagcggcgtggcgggcgggcgcccctgcgacgcgtgcgccgcgcggccggcgcggctgcactgccgcgcggacggcgcgttcctgtgccccggctgcgacgcgcgggcgcacggcgccgggtcgcggcacgcgcgcgcgtggctgtgcgaggtctgcgagcacgcccccgccgccgtcacctgccgcgccgacgccgccgcgctctgcgccgcctgcgacgccgacatccactccgccaactcgctcgcgcgccgccacgagcgcctccccgtggcgcccttgctcggcgcgctctccgacgcgccggcgccgcagcacttcccctccgcggcggcggcagcgggggaagaagcgtctgcggcggatgatgaggacgggagcgacgaggccgatgcggcgtcgtggctgctccccgagcccgacacagccacgaggacagcgccgccgccgactcattcttcgcggagccggacgcgtacctcggcgtcgacctggacttcgcgcggtgcgtggacggcgtcaaaggcatcggcgtgccggtcacgccggcgccgctcgagctggacatggctgccggcagctttctctacccccacactccatgtatcacagcgtggcgtcctcctctgagtttggcggttaaacagggggaatgaaccggaagcccggctaatgccgtaccctgagatgcgtaaacccgcggttctacaagaacatcgctacc

SEQ ID NO: 78820 - protein, 224 aa, Zea mays
  misc_feature: Ceres CLONE 1563813
  misc_feature (64)..(106): Pfam Name: zf-B_box Pfam Description: B-box zinc finger
  misc_feature (19)..(63): Pfam Name: zf-B_box Pfam Description: B-box zinc finger
MELEQKPPPPPAGYWSGVAGGRPCDACAARPARLHCRADGAFLCPGCDARAHGAGSRHARAWLCEVCEHAPAAVTCRADAAALCAACDADIHSANSLARRHERLPVAPLLGALSDAPAPQHFPSAAAAAGEEASAADDEDGSDEADAASWLLPEPDTATRTAPPPTHSSRSRTRTSASTWTSRGAWTASKASACRSRRRRSSWTWLPAAFSTPTLHVSQRGVLL

SEQ ID NO: 78821 - DNA, 878 bp, Zea mays
  misc_feature: Ceres CLONE 1563816
  misc_feature: Encodes the peptide sequence at SEQ ID NO. 78822
caaagctggagctccccgcggtggcggccgctctagaactagtggatcccccgggctgcaggaattcgtctcacccctagaaaaagtcagggcctcttgatcatcagtcgccagaggagctgttgatcgaggtgagtgaggttgaaaagcaagcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccacagccgaccgtgaaggtgtactgcctcgccaaccccaactacgccatgagcgtccgccacaggaaggtggtgctggcgcctgcaaaccccaaggacgagtaccaacactggatcaaggacatgctgtggagcacgagcatcgaggaccaggaaagttacccggcgttcgcgctggtgaacaaggcgaccggggaggccatcaagcactcactggggcagtcccacccggtgcacctggtgccctacaacccggacttcctggacaagtcagtgctgtcgacgcgagagccgcgacgtctgcgacggcatccgctgcgtccacatggtcaacaacatatacctcaacttcgatgtcctacgcggcgactagtgtcacggaagcgatccctgacggcaccaacgtcatgctactctactggtgcgagggctaccaccttcgctggcagatcctggcctacttctgcaatccacggatgaaatgatcgtctgaacctatcgatagggcacaatcctgccatgctactaaaacaataacaggaggtctta

SEQ ID NO: 78822 - protein, 210 aa, Zea mays
  misc_feature: Ceres CLONE 1563816
MDGGYYGGRDQRYSGGYYGGGGIATPGYAPAVPYGMSQVNIEGNGCGRALPPQPTVKVYCLANPNYAMSVRHRKVVLAPANPKDEYQHWIKDMLWSTSIEDQESYPAFALVNKATGEAIKHSLGQSHPVHLVPYNPDFLDKSVLSTREPRRLRRHPLRPHGQQHIPQLRCPTRRLVSRKRSLTAPTSCYSTGARATTFAGRSWPTSAIHG

SEQ ID NO: 78823 - DNA, 918 bp, Zea mays
  misc_feature: Ceres CLONE 1563818
  misc_feature: Encodes the peptide sequence at SEQ ID NO. 78824
ctccccgcggtggcggccgctctagaactagtggatcccccgggctgcaggaattcgtctcacccctagaaaaaacccacttcacctccgaccacttcacctccgatcccgccaccactacccaccctttcctttgacgtcccgatggcacctgtagatctaacccccaaacagcccaggaaggcctacggcggcgacggcggcgcctactacgagtggagccccgccgacctgcccatgctcggcgtcgcctccatcggcgcagccaagctctcgctcgccgccggcggtctcgcgctccccagctactctgactcagccaaggtcgcctacgtcctccaaggcacgggcacctgcggcatcgtcctcccagaggcgacgaaggagaaggtggtggccgtgaaggagggcgacgcgctggcgctgcccttcggcgtggtgacgtggtggcacaacggacccgccgcgccgaccccgctcacggtgctcttcctcggcgacacctccaagggccacaggccggggcagttcaccaacttccagctgacgggcgcgaccggcatcttcacgggcttctccaccgagttcgtgtcgcgcgcgtgggacctgccggaagcggacgcggcggcgctggtgtcgagccagccggcgtcggggatcgtccgggcgtcctcgtccccgctgccggcgcccgtcgcgcgggaccgcgagggggtggcgatcaactgcctgggagcgccgctggacgtggacatccgggcggggggccccgtcgggtgctcaacacgcccacctgccgctggtcaaggagtcaggctgggcgccaactggtccgatcgacgccactcatgtgctccccgggctctcgtgcgatcggcgtacaggtcactacatgtccgcggagcggcgcgtccagtg

SEQ ID NO: 78824 - protein, 258 aa, Zea mays
  misc_feature: Ceres CLONE 1563818
  misc_feature (6)..(161): Pfam Name: Cupin_1 Pfam Description: Cupin
MAPVDLTPKQPRKAYGGDGGAYYEWSPADLPMLGVASIGAAKLSLAAGGLALPSYSDSAKVAYVLQGTGTCGIVLPEATKEKVVAVKEGDALALPFGVVTWWHNGPAAPTPLTVLFLGDTSKGHRPGQFTNFQLTGATGIFTGFSTEFVSRAWDLPEADAAALVSSQPASGIVRASSSPLPAPVARDREGVAINCLGAPLDVDIRAGGPVGCSTRPPAAGQGVRLGANWSDRRHSCAPRALVRSAYRSLHVRGAARPV

SEQ ID NO: 78825 - DNA, 856 bp, Zea mays
  misc_feature: Ceres CLONE 1563819
  misc_feature (361)..(361): n is a, c, t, g, unknown, or other
  misc_feature (485)..(485): n is a, c, t, g, unknown, or other
  misc_feature (512)..(512): n is a, c, t, g, unknown, or other
  misc_feature (590)..(590): n is a, c, t, g, unknown, or other
  misc_feature (629)..(629): n is a, c, t, g, unknown, or other
  misc_feature (643)..(643): n is a, c, t, g, unknown, or other
  misc_feature (661)..(661): n is a, c, t, g, unknown, or other
  misc_feature (662)..(662): n is a, c, t, g, unknown, or other
  misc_feature (685)..(685): n is a, c, t, g, unknown, or other
  misc_feature (694)..(694): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (794)..(794): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (812)..(812): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (824)..(824): n is a, c, t, g, unknown, or other
  misc_feature (825)..(825): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
aaagctggagctccccgcggtggcggccgctctagaactagtggatcccccgggctgcaggaattcgtctcacccctagaaaaatcttctcgaccagatccggaagttctgtgggtagaggactagagactgcagatcgagggtctggcagcgggccgtggcagttgggtgattacgacgaagagagatgggcctcctcgacaagctgtgggacgacaccgtcgcaggcccgcgcccggacaccgggctcggccgcctccgcaagcagcctgtgcgtcccgccgcccgtcagatcagtgatccggccggggacgctgcggcgttcgtgccgccctcgccggcttcgggtagcgaggagacnccggtgaaggtgacccccagcatcatgattcaagggcccggcgcggaacccctttttgccgaaggagccgggaaagcaccccaccggccctccccactgggggaataccccccgcccatttccncctttttgccgggccccgggtggtttntgtttaaaaaagggaataacttttttccgacgccatatcagaggggggggacccccccccggggggaagaaaagagcncccccctttttctctttgaaagggggggggcaaagggcncccccccccccgcnacaacttgtttttttttnncctccccccccacaacgaggctncccccccgncggcgggaagaaagggggannnaaaaaacgtgtggagaaaaagatttcttttggggggggggggggggggggattttttcttttgaannngtcggttttntcctccnnnnnnnnntgntgtnnnnnntgnntnnnttggtgattatctgcgcgccccggacc

SEQ ID NO: 78826 - DNA, 897 bp, Zea mays
  misc_feature: Ceres CLONE 1563820
  misc_feature: Encodes the peptide sequence at SEQ ID NO. 78827
ctccccgcggtggcggccgctctagaactagtggatcccccgggctgcaggaattcgtctcacccctagaaaaaaggctattgccgccgccgccctacaccagatgcccagttcttcgtcagccccttctccggcaacgagcacctaacaggctgaaaaaaaatcattgatacacgtacgccgtcagaggctgcagtatattctgtgagaatggcatggggtcaaggtgctaagaggtccatactagggcttctctttcgttctcagcaccaaactgctcgggcatactcttcttcagcattccagactcaccaattgagcactcatgttccccaagatggagtgtttattaggagattcggctctgaggtgtcttcttcagagcaaatgaaccttattaagcaactcagacaaagaacgagtgctccaatcaaagatgtcaaggcctctctagttacctgcaactgggatattgaggctgcacagaaggacctaaggaagagaggtgttgctcttgctgccaaaaagtcttcacgcactgctgctgaaggtttgctagctatcgcacaagatgacaaaagggctgctgtagttgagcttaactgtgaaactgatttcgtagcaagaaatgatgttttccagtacctggcttcatcattggcaaagatggctttatctgctcagggtcctggtgattgttcatgcctttttgtcctgagcttttagagacatgcctatcaatctagatcaccctaagctcagggtggaaacaactgtccaaagtgccgttacaaaagtggctgcatgggttggggaagatgtgaaactcagaagaagcttcatgccttccaccaccggaaatggtggtggttcactctaaatgcaatactgcccccc

SEQ ID NO: 78827 - protein, 171 aa, Zea mays
  misc_feature: Ceres CLONE 1563820
  misc_feature (58)..(95): Pfam Name: UBA Pfam Description: UBA/TS-N domain
MAWGQGAKRSILGLLFRSQHQTARAYSSSAFQTHQLSTHVPQDGVFIRRFGSEVSSSEQMNLIKQLRQRTSAPIKDVKASLVTCNWDIEAAQKDLRKRGVALAAKKSSRTAAEGLLAIAQDDKRAAVVELNCETDFVARNDVFQYLASSLAKMALSAQGPGDCSCLFVLSF

SEQ ID NO: 78828 - DNA, 1056 bp, Zea mays
  misc_feature: Ceres CLONE 1563821
  misc_feature: Encodes the peptide sequence at SEQ ID NO. 78829
tccccgcggtggcggccgctctagaactagtggatcccccgggctgcaggaattcgtctcacccctagaaaaaacaccacccaatcactcccgtctcgctctgcaccactcaaacctcttcttcctttccggaaaccacaccagcagtccccgcaggctgcagcttccccggccgccgcgcccaagccccagctgcctcgatcgctcgagagccacaaccaccactccaccagcagggcaaagctggaggatggccgcagtcgcagcgatgaaggctctcgcggtcgccgcctcgccggtgtcggcacggcagccccgtcggtacgtcgcaagtggcgctagccggcggctgcagtcgccgttccacggcgtgtctgtgcagtgccctgcgccaccgctgcgggcgaccccccggcgggggcggcaggtggccggtgttggcggccgctgtcccgccgggagatcccgttcatccaggggacgggaacgagcagacgattccccgacgtgcgggctgacccaaatcccggggacgggaacaaaacggcgcgggccatccttcacctttctaaagaagccgtcggggggtttcaaactcgtcgggcgggaacccctgggggaaaattcacgggggcgtttgtacatggagacgtagtaaccaggggggggtgcctgtccattccccggggagaacttttaacatcgcccaagtgtggcttctcaacagggaaaaagcggtgggccggtgaatccgaaggccccaagtacgtgggtagggcgattaacgccccctggggcaaaggggtgaaaccccttctggaccggttttcatgggatgagcgggaccccccgcaggtaggaggcggccccccaaaatttgttccgaaaaaaccaataaaacccgccctttgtaaataacatatgtttaccatggctgtggaagaagtttaagcgcgaaagtaccagatggacctcagttgtatccgtgacgcccacgccccggactcgctgcctccggatgtggtaatttgaaacagttcgtggaccgtgaagaca

SEQ ID NO: 78829 - protein, 134 aa, Zea mays
  misc_feature: Ceres CLONE 1563821
MAAVAAMKALAVAASPVSARQPRRYVASGASRRLQSPFHGVSVQCPAPPLRATPRRGRQVAGVGGRCPAGRSRSSRGRERADDSPTCGLTQIPGTGTKRRGPSFTFLKKPSGGFKLVGREPLGENSRGRLYMET

SEQ ID NO: 78830 - DNA, 887 bp, Zea mays
  misc_feature: Ceres CLONE 1563822
  misc_feature: Encodes the peptide sequence at SEQ ID NO. 78831
  misc_feature (481)..(481): n is a, c, t, g, unknown, or other
  misc_feature (482)..(482): n is a, c, t, g, unknown, or other
ggagctccccgcggtggcggccgctctagaactagtggatcccccgggctgcaggaattcgtctcacccctagaaaaactgcctcctcgtcccgtccctcccagcgccccgttccattcgaccgccgaccagatccacccccaacacgtccagccatgccggcgccgccgcatccaacgccgctgctgccaccggcgggggagccgttccgcgtgttcgtggggtacgacccgcgggagcacgaggcgtacgaggtgtgccgccgcagcctgctccggcgctcatcgatcccgcttgacgtgcgcccgatccggcaggcggagctgcgcgccgcggggctgtacacccgggcgcgcggccccacggagagcaccgagttctccttcacgcgcttcctcaccccgtacctggcggggtaccgcggctgggcgctcttcgtcgactgcgacttcctctacctggcggaaactgccgactcttnnccggccgcggccgccgcgaacggcgcggccggcgcgggccgcatgccgtagcctgcgtgaagcacgagtaccagcccggcgagcccaccaagatggacggggccatccagaagggggacccgcgccaaaaacgggtcctccatgggggtttaaaagggggggccaccccagaaacgggcccgcccttcctccgggaggcgttaagaacccaaaggggtggctttcccccccgcttttcctgggttcaaaaaaaaaaaaataggggaaggggccccttccctgggaattttcccggggggccaaaaaggggtaaacccggccacccgaaaaacccccccgggggccttcaaaaaatcctcggggggggggggttttgggcctcagggggccgcagattcccccccc

SEQ ID NO: 78831 - protein, 125 aa, Zea mays
  misc_feature: Ceres CLONE 1563822
  misc_feature (109)..(109): Xaa is any aa, unknown, or other
MPAPPHPTPLLPPAGEPFRVFVGYDPREHEAYEVCRRSLLRRSSIPLDVRPIRQAELRAAGLYTRARGPTESTEFSFTRFLTPYLAGYRGWALFVDCDFLYLAETADSXPAAAAANGAAGAGRMP

SEQ ID NO: 78832 - DNA, 984 bp, Zea mays
  misc_feature: Ceres CLONE 1563823
  misc_feature: Encodes the peptide sequence at SEQ ID NO. 78833
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (602)..(602): n is a, c, t, g, unknown, or other
  misc_feature (604)..(604): n is a, c, t, g, unknown, or other
  misc_feature (619)..(619): n is a, c, t, g, unknown, or other
  misc_feature (621)..(621): n is a, c, t, g, unknown, or other
  misc_feature (623)..(623): n is a, c, t, g, unknown, or other
tggcggccgctctagaactagtggatcccccgggctgcaggaattcgtctcacccctagaaaaaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcagagattgattcaaaannnnnnnnnnnnnnnnnnnnnnnnnnnnnnnnnnnnnnnnnnnnnnnnnnnnnnnnnnnnnnnnaaaagatttccccgggggggctctttttntntccctcccctctttntntntttccgttggggaaaaagctgggggaacttggcccggccccccctaagcccagggtccccttgaaaacctttcccagggtttgtttttaaaccttccccggggccaagaaaatttttttgtttcgaaaccccccccccgggaaaacgttccccaaagggaagaaaggcacccggaaggcgcgaaaaaaattctccccaaattatcgcgttgggcccccgggttgattgtggtttttttaaaacggcgttctaatatagaaaacccccccggggggaaacccccccaaaaaaccccaaaaaaaatttcgcctccttcccccggttcagaaagggggcaaataattttgtggtggaaaaaacc

SEQ ID NO: 78833 - protein, 58 aa, Zea mays; identical to SEQ ID NO: 46528
  misc_feature: Ceres CLONE 1563823
  misc_feature (6)..(56): Pfam Name: UPF0057 Pfam Description: Uncharacterized protein family UPF0057

SEQ ID NO: 78834 - DNA, 782 bp, Zea mays
  misc_feature: Ceres CLONE 1563824
  misc_feature: Encodes the peptide sequence at SEQ ID NO. 78835
  misc_feature (409)..(409): n is a, c, t, g, unknown, or other
  misc_feature (412)..(412): n is a, c, t, g, unknown, or other
  misc_feature (413)..(413): n is a, c, t, g, unknown, or other
agagctggagctccccgcggtggcggccgctctagaactagtggatcccccgggctgcaggaattcgtctcacccctagaaaaaacccccacgtctcaactttatagccgccccctccccaccgccgcggccgccacgcgcagcagcaacccggtagcaggagcgcagccagcaagctcagccccccagccctactgccaccgcgccgaacgccatggccgagccggcagagcaccgtccagcggaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctacgggttcgacaaggaggggaaccantgnnaagagcgcggcacaggcactgtgaagctgctcaagcacaaagacacgccaaggtccgcctcgtcatgcgtcaggcgaaagacgcctaaggattggcgccaaacaatcttcggggtgggcaacaactaaaaatgccggaacaccccgggggaccaaaaagtccgggcggggggggacccccctgggaattttcccgaaggggaaagttcaaaaggggaaaagtttggcctatcccttttttgggaatccttcccaagaaatttgacagaaaattttagggggacccttgttttaaaaaaaaatatctcttaaaacccccccggggaaaaaaagcccgggggggaaaaaaaaaaaattttttttgaggctt

SEQ ID NO: 78835 - protein, 108 aa, Zea mays
  misc_feature: Ceres CLONE 1563824
  misc_feature (38)..(102): Pfam Name: Ran_BP1 Pfam Description: RanBP1 domain
  misc_feature (65)..(65): Xaa is any aa, unknown, or other
  misc_feature (66)..(66): Xaa is any aa, unknown, or other
  misc_feature (67)..(67): Xaa is any aa, unknown, or other
MAEPAEHRPAEEEEAAAAGEDEDTGAQVAPIVKLEEVAVTTGEEDEDALLDMKAKLYGFDKEGNXXXERGTGTVKLLKHKDTPRSASSCVRRKTPKDWRQTIFGVGNN

SEQ ID NO: 78836 - DNA, 861 bp, Zea mays
  misc_feature: Ceres CLONE 1563827
  misc_feature: Encodes the peptide sequence at SEQ ID NO. 78837
  misc_feature (536)..(536): n is a, c, t, g, unknown, or other
acccgcggtggcggccgctctagaactagtggatcccccgggctgcaggaattcgtctcaccccagaaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagctgcccctcnttcggcggcggctccccgggcttcagcggcttcggcggcatgcccgggtcgcccaccgccgggctccgtccccgagcacgccaactagccctgaacgcaacaagcgtgggtagtagagtgggtgctactggtactggtagtacgtcgtcgtcttcatgcatgcatgggttcggggtttcccccaagctccataaccaacaataagtggggcctttgcccgtacccgaacgccttagctagttaattttttaggcttggggtccccacgggcttttatgtttaatcccccccccccaccttgaaaaaattgagatgttttcttttt

SEQ ID NO: 78837 - protein, 165 aa, Zea mays
  misc_feature: Ceres CLONE 1563827
MARSSKMMVAAALLALALAVSTAEARNIKTTTTEKKDDAVVQPQTFPPFDRLGGGASPAFGGLPGGSIPGSSIPGFSMPGSGSSLPGFSLPGSGSCPSFGGGSPGFSGFGGMPGSPTAGLRPRARQLALNATSVGSRVGATGTGSTSSSSCMHGFGVSPKLHNQQ

SEQ ID NO: 78838 - DNA, 888 bp, Zea mays
  misc_feature: Ceres CLONE 1563831
  misc_feature: Encodes the peptide sequence at SEQ ID NO. 78839
  misc_feature (846)..(846): n is a, c, t, g, unknown, or other
ccgcggtggcggccgctctagaactagtggatcccccgggctgcaggaattcgtctcacccctagaaaaagcggccacacgcgtttggattttgctccttgctcccttgatccatccacttctgaaagggtcaccatgtctgcctttgtggggaagtacacagatgagctgatcaagaccgccaagtgcctcgcaacgccgggcaagggcatcctggcctccgacgagtcgacgggcaccatcggcaagcgcctatccagcatcaacctcgagaacgtggagtcgaaccggcaggcgctccgcgagttgctcttcacggcgcccggcgtgttcgactacctctccggggtcatcctcttcgaggagacgctgtaccagaagacctccgacgggaagccgttcgtggacgtgctcatcgcgggcggagtggtccctgggatcaaggtcgacaagggcaccgtggagatcgcgggcaccgacggcgagaccaccacgcagggcctcgactccctgggcgcgcgctgcgccaagtactacgaggccggcgcgcgcttcgccaagtggcgcgccgtgctcaaggtcggccccgcggggcaggggcagccctccgagctcgccgtcaggcagaacgccgagggcctcgcgcggtacgcgctcatctgccaggagaacgggctggtgcccatcgtggagcccgagatactcaccgacggcggccacgacatcgggtactgcgccgccgccacggagcgcgtcctcgccgccctctaaagtcgctcagcgaacacaaagtcctgctcgaagccacgctcctcatgacaacatggtcacccccggttcgatagncccaggtctccgcgtatgtgataagcgagtacacggtggcgc

SEQ ID NO: 78839 - protein, 211 aa, Zea mays
  misc_feature: Ceres CLONE 1563831
  misc_feature (11)..(211): Pfam Name: Glycolytic Pfam Description: Fructose-bisphosphate aldolase class-I
  misc_feature: SWISSPROT Homolog: EC 4.1.2.13 Fructose-bisphosphate aldolase
MSAFVGKYTDELIKTAKCLATPGKGILASDESTGTIGKRLSSINLENVESNRQALRELLFTAPGVFDYLSGVILFEETLYQKTSDGKPFVDVLIAGGVVPGIKVDKGTVEIAGTDGETTTQGLDSLGARCAKYYEAGARFAKWRAVLKVGPAGQGQPSELAVRQNAEGLARYALICQENGLVPIVEPEILTDGGHDIGYCAAATERVLAAL

SEQ ID NO: 78840 - DNA, 909 bp, Zea mays
  misc_feature: Ceres CLONE 1563833
  misc_feature: Encodes the peptide sequence at SEQ ID NO. 78841
ctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgccaggtcgtgctcatgggcgccgtcgagggctaccgcatcgccggctgcccgctcggcgatgtcgtcgacccgctctacccctgcgcagcttcgacccgctcggcctcgccgacgaccccgaggccttcgccgagctcaaggtcaggagctcaagacggccgcctcgccatgtctcatgttcggattctcgtcaggcatcgtcaccgggatggccgctcgatacccgctgacactttgcgacccgtcacaaaacgcttgggctacgcaccactcg

SEQ ID NO: 78841 - protein, 255 aa, Zea mays
  misc_feature: Ceres CLONE 1563833
  misc_feature (65)..(232): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGCPLGDVVDPLYPCAASTRSASPTTPRPSPSSRSGAQDGRLAMSHVRILVRHRHRDGRSIPADTLRPVTKRLGYAPL

SEQ ID NO: 78842 - DNA, 846 bp, Zea mays
  misc_feature: Ceres CLONE 1563836
  misc_feature: Translation starting site: 227
  misc_feature (603)..(603): n is a, c, t, g, unknown, or other
  misc_feature (751)..(751): n is a, c, t, g, unknown, or other
ctggagctccccgcggtggcggccgctctagaactagtggatcccccgggctgcaggaattcgtctcacccctagaaaaagccctcttccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagccctgcatgaccatgttgcacttacgcaccctgaccttgacaggagactgangagttcattgcagatgtgcttggggtcgagggtgttaggcagactattgctggaaatatcttttgtgggggagtactgcgcctctctaacagggggtgggtttggttctcccccatacatccgttgaaagactttgacaagctctcangcctcctccaagttcctctgtccccaggacttgtgaccgaggaagccaggtcttgcttccggcttgaaagtgaccaagggactggccttttgggg

SEQ ID NO: 78843 - DNA, 820 bp, Zea mays
  misc_feature: Ceres CLONE 1563838
  misc_feature: Encodes the peptide sequence at SEQ ID NO. 78844
  misc_feature (706)..(706): n is a, c, t, g, unknown, or other
  misc_feature (771)..(771): n is a, c, t, g, unknown, or other
  misc_feature (794)..(794): n is a, c, t, g, unknown, or other
ctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaggccggcgcgcagatcttctcggagggcgggctggactacctgggcaacccccaacctggtgcacgcgcagagcatcctgggcgtgctcggcttccaggtcatcctcatgggcctcgtcgaggggcttcgcatcacgggnctcgacggcgtcggggaaggcaacaccttctacccgggcggcagtactttcacccgttgggcttngccgaagaacccggtacccttgnccaagctaaggggcagggagatcaaa

SEQ ID NO: 78844 - protein, 222 aa, Zea mays
  misc_feature: Ceres CLONE 1563838
  misc_feature (69)..(222): Pfam Name: Chloroa_b-bind Pfam Description: Chlorophyll A-B binding protein
  misc_feature (206)..(206): Xaa is any aa, unknown, or other
  misc_feature (214)..(214): Xaa is any aa, unknown, or other
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVRVDFKEPVWFRPARRSSRRAGWTTWATPNLVHAQSILGVLGFQVILMGLVEGLRITGLDGVGEGNTFYPGGSTFTRWAXPKNPVPLXKLRGREIK

SEQ ID NO: 78845 - DNA, 852 bp, Zea mays
  misc_feature: Ceres CLONE 1563840
  misc_feature: Translation starting site: 201
ctggagctccccgcggtggcggccgctctagactagtggatcccccgggctgcaggaattcgtctcacccctagaaaaagcatgcttccttgcttgctcttttgtcgcgcctgcttctcccccctctgcctcttggtgctgcttcctggtgggggaagggaaggagaaggctgtgctgtgcgtcctgcgccgataacgcgatggtgtccattgtcaccgaggtatgggcgctcgctggatgcggcccggcgtccaaggcggcggcggtagcggcgcaggagttgccggcgcagcatccttctcctgccgcagcgggagcgggaggagggaaggccaagaagagagccgtgccagtgtcgttcagaggcgtcagcagcggcggtggccaggaccaccagcgtgaggccgccgccgccgtctcgttcggggcggcggcgcggcctcgcgtcgtgcgcgctcgccgccgtcgccgcctcgttctccgcccgcgctgaccgccccgcgcgggcgcttgtcctcgaggaagacgacgacatcgagctgctggagcgcgtgaaggaggacaggaagaagcggctgcagaagcagggcatcatcagctcctccggcgccgagaccgggtatttgcaggacctcatctacaggctcagcaaagtcgggcaggccattgacaacgacgacctcccagccgcgagcagcgtgctgggaccaagctcagacgcccagtgggtgcagaacatcaatgcagctttctcaagctcagctcaagccggagcagaggaacgtggtcgacagcttcacagctcgctggccacactgtttacatcagtgagcaagctcgacctgaatccc

SEQ ID NO: 78846 - DNA, 932 bp, Zea mays
  misc_feature: Ceres CLONE 1563841
  misc_feature: Encodes the peptide sequence at SEQ ID NO. 78847
  misc_feature (729)..(729): n is a, c, t, g, unknown, or other
ctccccgcggtggcggccgctctagaactagtggatcccccgggctgcaggaattcgtctcacccctagaaaaattttttcctagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccatccaggtcgtcgtcgacgcgatcatcaacagtggaccccgtgaggatgccacccgtattggttccgctggtgttgtgaggaggcaggccgtggatatctcacccctgaggagggtgaaccaggccatctacctcctcaccactggtgccagggagagtgctttccggaacatcaaaaccattgccgagtgccttgcagatgagctgatcaacgctgccaaggggctcatccacagttacgccatcaagaangaaggacgagattgagcgtgttgcccaaggccaacgttgaactgagcttgtatcctggtgcactctgcgctgggaacttttatgtcgctggcagtcgtatcggttctgggttacccaatgtttaaagttttgagacctatatgcggttttggttttcgtgcacatttaaaataccggagtatgtagtgattgggaccaaatgg

SEQ ID NO: 78847 - protein, 191 aa, Zea mays
  misc_feature: Ceres CLONE 1563841
  misc_feature (44)..(186): Pfam Name: Ribosomal_S7 Pfam Description: Ribosomal protein S7p/S5e
  misc_feature (187)..(187): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGVVRRQAVDISPLRRVNQAIYLLTTGARESAFRNIKTIAECLADELINAAKGLIHSYAIKXEGRD

SEQ ID NO: 78848 - DNA, 882 bp, Zea mays
  misc_feature: Ceres CLONE 1563842
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (306)..(306): n is a, c, t, g, unknown, or other
  misc_feature (315)..(315): n is a, c, t, g, unknown, or other
  misc_feature (321)..(321): n is a, c, t, g, unknown, or other
  misc_feature (347)..(347): n is a, c, t, g, unknown, or other
  misc_feature (639)..(639): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnaaaagctggagctccccgcggtggcggccgctctagaactagtggatcccccgggctgcaggaattcgtctcacccctagaaaaaacctccccctccctccccttttgaccctccctcaccagctgcaaaaccgcgggccgcatcccgcccgcgccgcccaccggcggccacagccgcctacataaaccactaatcgaccactcgccgaactaaccaccacccaccaancccatggcngtcatnctctctcgcccgtcccgaacctagcntcgtcggcggcgccggcccccgcggggccttccccggcttttccgggtgcagggccacctcccggcgggggggctcggggcttccccccccccccaaaaaaacccgggggcctcccccggtgggccccccccctttgggggggggggagaattccaaaaaagaggggagaaaaccccccccgggaaaaaagaaaaggacccccccccccccacaaaaattttctccccccccccaaaaaaaaaaaggggggggccccccggggggtcccccggggggggtcccccttcgggnggggggggggcgcccgttttttttttnnnggggggcggcctctttatattttttccccccnnnnnntgtttgttttcctccgggggggaggggagaaaatattttttcctcccccccccccccccccctcctcaaaaagaggggagggccgcccccccggcggggggggggggggggccgcccccctcctcttttttttttattaaataaaagaaaaataatatttttgtgcggccccccccc

SEQ ID NO: 78849 - DNA, 894 bp, Zea mays
  misc_feature: Ceres CLONE 1563843
  misc_feature: Encodes the peptide sequence at SEQ ID NO. 78850
acccgcggtggcggccgctctagaactagtggatcccccgggctgcaggaattcgtctcacccctagaaaaaatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccggcccgctccgccccggggtcgatcaggtcgagggcaccgtgaaggccgtcgtcggccccgtctacgaccgtttccacgccgtcccgctcgacctcctcaagttcatcgaccgcaaggttggtgagtccgttgaggagatagaccgccgcgtccctccagtggtgaaggaagccccaaccttggcccgctcggctgcgaaggaggttcgccagtccggcctggtgggcacggccactgggccttgcaagtcagccatcgcccgcgccgaagcaaaagcccgggtagctctacacccgctacgagcttgtggcagagcggcgtgccgccgagtcctgggtggccctgaaccgtctccctcgggtgccctgcgtcacaaggtccgtcctccccactgcgcaaaggtctctggcagttacattccgccggtgcctgatggtgccaaacgcggggaacgcctgggccacctattctccggtgggggccacggagcgggctcgcccgcgggttcatgtc

SEQ ID NO: 78850 - protein, 237 aa, Zea mays
  misc_feature: Ceres CLONE 1563843
  misc_feature (29)..(227): Pfam Name: REF Pfam Description: Rubber elongation factor protein (REF)
MADSATNDAPLVASNQPTEEEVTVERAAATEEQEEERLRYLEFVQQAAAQALVLAAAAYAYAKQGAGPLRPGVDQVEGTVKAVVGPVYDRFHAVPLDLLKFIDRKVGESVEEIDRRVPPVVKEAPTLARSAAKEVRQSGLVGTATGPCKSAIARAEAKARVALHPLRACGRAACRRVLGGPEPSPSGALRHKVRPPHCAKVSGSYIPPVPDGAKRGERLGHLFSGGGHGAGSPAGSC

SEQ ID NO: 78851 - DNA, 848 bp, Zea mays
  misc_feature: Ceres CLONE 1563845
  misc_feature: Encodes the peptide sequence at SEQ ID NO. 78852
  misc_feature (538)..(538): n is a, c, t, g, unknown, or other
acccgcggtggcggccgctctagaactagtggatcccccgggctgcaggaattcgtctcacccctagaaaaagagaagcatcccagagacccagacagcaaggaaccttgagcctgccggcaactctaacgacgacgatggccgaaggggacggtccaactccagcccgcggcgctcgcgtcgtgctgttcccactgccgtcccagggccacctcagcccgatgctgcacctcgccagcgcgctccacgcgcgggggctcgcagtcaccgtcctccacacggcgtacaacgcgccggaccccgcgcaccacccggggctagccttcgtcgccgtgcccgacgtcatcccggaggccgtggcggcgacgacgaatggcatcgcgaagatcctcgccctgaacgccgccatggaggcgtcgtgtcacgtccgctgcgcgctcgcgtcgctccctcgcgatgaagcgggcggacatcggctggcgtgcctcatcttcgactccaccctcttcgccgcccataatggccgctgctgccctcnggctgcccacgctccgtgctggaaaccggtagcgccgccgggcttccgtctggttcaaggccgaaaacctacaaatgggtccccggaaaaggggcttttcgcccccccacaaattccaaacctaaacttgccgggtaagggaacctccccccccctgcaaattgaagggaaccgtttccaaaccaaaggaaactccccaaaaaaggggaaaccgggccaaaaaaaacttgggggccccccccccggaaaaaaacaaaaaaaaatttttccggggcgaatacctctaaaaaagttttaagggcgcccccgc

SEQ ID NO: 78852 - protein, 232 aa, Zea mays
  misc_feature: Ceres CLONE 1563845
  misc_feature: SWISSPROT Homolog: EC 2.4.1.121 Indole-3-acetate beta-glucosyltransferase
  misc_feature (134)..(134): Xaa is any aa, unknown, or other
MAEGDGPTPARGARVVLFPLPSQGHLSPMLHLASALHARGLAVTVLHTAYNAPDPAHHPGLAFVAVPDVIPEAVAATTNGIAKILALNAAMEASCHVRCALASLPRDEAGGHRLACLIFDSTLFAAHNGRCCPXAAHAPCWKPVAPPGFRLVQGRKPTNGSPEKGLFAPPQIPNLNLPGKGTSPPLQIEGNRFQTKGNSPKKGKPGQKKLGGPPPGKKQKKIFPGRIPLKKF

SEQ ID NO: 78853 - DNA, 920 bp, Zea mays
  misc_feature: Ceres CLONE 1563848
  misc_feature: Encodes the peptide sequence at SEQ ID NO. 78854
  misc_feature (529)..(529): n is a, c, t, g, unknown, or other
  misc_feature (734)..(734): n is a, c, t, g, unknown, or other
  misc_feature (784)..(784): n is a, c, t, g, unknown, or other
  misc_feature (825)..(825): n is a, c, t, g, unknown, or other
  misc_feature (844)..(844): n is a, c, t, g, unknown, or other
  misc_feature (846)..(846): n is a, c, t, g, unknown, or other
  misc_feature (906)..(906): n is a, c, t, g, unknown, or other
tggagctccccgcggtggcggccgctctagaactagtggatcccccgggctgcaggaattcgtctcacccctagaaaaaatcaaacggactcacagctcgcagcacctgcaggacattgagaaccagccagctaaccaaccaaccaaccggcggagccaaagccaagaaggaaggcaacgtgcccatccagtcaggatgtgcaactccaacgtcaagtccgcgggggtggcccagatcgacggccgcccggtgctgcagccggcgggcaaccgcgtggcggcgccggagccggacgcctcccgcccgctcaagaagtccctccagaagtcgctctccatgccggcctactacgacagcaatgccaccgcgggcgcccgtcctgcgccggccgagaacaccacccgtgcagcggctaattcgtctccgctgcctcccgcgaaggcggcgacgaaggcagcgggcgctttccccgcggagaagagcggcaggtccaaggcagccaggaggccaggcgccgtgccgccgccnggtggtggcgttcgcggcgctggacgcgttggagccggcggggagcatcgccgcggcgcagcgggagcacgccgcgcaggcgcaggcgcagcgcaaagctgcggatcgcgcactacggccgcaccgcgtccttctccgggtggaggggggccaaataagtcgggcgccgcggccgcccgccccccgagcggggccgtcaccgccntcccccgcccgggcaggaacgagaaagcgctgcagctttcatcacgcccntactcagaacccccttgtatgtcgcgtaccacgacgaaagnaaatgggggaagtgcctgntncaacgaacgaacgagtttgctattcggagatgctcaacccctgtcctgggcgttgcaagntcgggggccgaact

SEQ ID NO: 78854 - protein, 241 aa, Zea mays
  misc_feature: Ceres CLONE 1563848
  misc_feature (180)..(180): Xaa is any aa, unknown, or other
  misc_feature (210)..(210): Xaa is any aa, unknown, or other
  misc_feature (216)..(216): Xaa is any aa, unknown, or other
  misc_feature (217)..(217): Xaa is any aa, unknown, or other
  misc_feature (237)..(237): Xaa is any aa, unknown, or other
MCNSNVKSAGVAQIDGRPVLQPAGNRVAAPEPDASRPLKKSLQKSLSMPAYYDSNATAGARPAPAENTTRAAANSSPLPPAKAATKAAGAFPAEKSGRSKAARRPGAVPPPGGGVRGAGRVGAGGEHRRGAAGARRAGAGAAQSCGSRTTAAPRPSPGGGGPNKSGAAAARPPSGAVTAXPRPGRNEKALQLSSRPYSEPPCMSRTTTKXNGGSAXXNERTSLLFGDAQPLSWALQXRGPN

SEQ ID NO: 78855 - DNA, 924 bp, Zea mays
  misc_feature: Ceres CLONE 1563849
  misc_feature: Encodes the peptide sequence at SEQ ID NO. 78856
  misc_feature (924)..(924): n is a, c, t, g, unknown, or other
ctccccgcggtggcggccgctctagaactagtggatcccccgggctgcaggaattcgtctcacccctagaaaaaaccaagccaacagccaaatccaattcgccgacgactctctttattcctcccgctcgccgccgccgccaccgcctgaggggaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggcccgttcggtgcccctcccgtcctggatctgttgcgcgagagcgcggcagcgcgcgagattcgcccccttctcttctcataggaagcaggaagcaagccgatcgctcgctgagcgccgccgccgatggccgtcgcggtgccgatgaagctctggagggtggagacccgcggcaagcccgccgccgcgggggcccgacgaccccctgcgcgtcctggtgaccgtgaaccgtccttcggagcgccggcccgttgccgctcatcgtcctcgagggggacaggtcgccgcgctcatccgggggggcttgggctggcttccccgcaaggccccatgccgctgctcggaacctaaccgggcggggttcgtcctctccccgccaaagggggatccgggccccccggaaaaaaaaaaggtcagcttcaacgggggcggaacttcctgctttggcaaaagccgcggcttagggtgccgcccccaccagtggggcccaaatcttaaggcacccggtaccccgaggaaggcaccgtggattan

SEQ ID NO: 78856 - protein, 74 aa, Zea mays
  misc_feature: Ceres CLONE 1563849
MAVAVPMKLWRVETRGKPAAAGARRPPARPGDREPSFGAPARCRSSSSRGTGRRAHPGGLGLASPQGPMPLLGT

SEQ ID NO: 78857 - DNA, 694 bp, Zea mays
  misc_feature: Ceres CLONE 1563850
  misc_feature: Translation starting site: 104
  misc_feature (282)..(282): n is a, c, t, g, unknown, or other
ctccccgcggtggcggccgctctagaactagtggatcccccgggctgcaggaattcgtctcacccctagaaaaaccctgagcagctcatcagtggcaaggaggatgccgctaacaatttcgcccgtggccactacacaattggcaaggagattgttgatctgtgccttgaccgtatccgcaagcttgctgacaactgcaccggcctccagggcttcctggtcttcaatgccgttggtggtggcaccggctctggccttggttctctcctccttgagcgcctngtctgtggagtacggcaagaaatccaagctgggcttcactgtgtacccatctccccaggtgtcaacctctgttgtggagccttacaacagcgtcctctccactcactcactcctggagcacactgatgtctctatcctgctcgacaacgaaggccatctatgaacatctgcagggcgcctcccctccgacatttgaggaaggcccaaactacctcccaaccttgaaaatccgcccttgttggccccccaggggggaaatctcaatcctcttgaaaatgggctttcccctttaaagggtttccaaaagggggggcccccttcccaaaatgggggggaatgtgttgaaaaaccaaaatttttcccaaaaaacccaaaaccccctgggggttttccccctttttaaaccccccgg

SEQ ID NO: 78858 - DNA, 900 bp, Zea mays
  misc_feature: Ceres CLONE 1563851
gcggtggcggccgctctagaactagtggatcccccgggctgcaggaattcgtctcacccctagaaaaagttctcctggattgaattcacaaaacaactgtttgttattttcttctcccgttcacttctctttggcccgaaaccgagagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcatacccttcctgctacaactgagtcattagcccaagctcaagaggctaaggatgcttcagagtccatttcaatcccctttaccgtgtcattcaggacccatcttctttctgctgatgcactgagaacaaaagaagttgccatttacaaatcttacaaaactaccctcactaaagaaaaaacagagcttgaaaagcttgcgtaatcttttttgacccagctcaaaacccatttttttgcaattttttccctaaggcaaaaaaactggcaaaaaattggccccgggggaaataaattgatggctggtcgcccaaaaataccctgggaaacctcaaaatctttccagattttccactctggccaaggaaaatgaattagaatgggaccccctgccagaaaaaaaccgtaactttccctcccgggcaaacctgttggaaaggctaaggttgggccaccccccggttttgaggaatcccgggaggttttcctggaagccctttacccgcgggtttactagtctttatcaaggaagttccgggaaaacttgttgacaaatttcctttctgggggaacattaccctttttg

SEQ ID NO: 78859 - DNA, 926 bp, Zea mays
  misc_feature: Ceres CLONE 1563853
  misc_feature: Translation starting site: 170
  misc_feature: SWISSPROT Homolog: EC 1.11.1.11 L-ascorbate peroxidase
  misc_feature (775)..(775): n is a, c, t, g, unknown, or other
  misc_feature (825)..(825): n is a, c, t, g, unknown, or other
ctccccgcggtggcggccgctctagaactagtggatcccccgggctgcaggaattcgtctcacccctagaaaaacgacgcaggcaccccagcagctcttgcggtcgtccctcagccgcgtcgcaccgcatcgcattctacgattcgaagctctctgctcgcaggggaccatggcgaagaactacccaaccgtgagcgccgagtacagcgaggccgtcgagaaggccaggcgcaagctccgcgccctcatcgccgagaagagctgcgcacccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgacttctaccagcttgccggagttgtggccgtcgaggtcaccggtgggcctgagatccccttccacccaggcagggaggacaagcctcagccgccacctgagggccgtcttcctgatgccaccaagggttctgaccacctgaggcaagtctttggcaagcagatggggttttgagtgatcaggacatcgttgccctctctggtggccacacccttgggaaggtgcacaaagagcggtctggttttgagggtgcctggactacgaaccccttgggtctttgacactctaacttcaaggaacttctgagtgggtacaggaggcccntcttcagctccaagtgacaaagcctgctgagcgccctgtcttccgcctcntgtggagaaattgctgcaaagagaaggcatctttgatactacaagaagcccactcagctttcccgacgggggtagctgatgctaaaaggccatatctggac

SEQ ID NO: 78860 - DNA, 808 bp, Zea mays
  misc_feature: Ceres CLONE 1563857
  misc_feature: Encodes the peptide sequence at SEQ ID NO. 78861
  misc_feature (688)..(688): n is a, c, t, g, unknown, or other
agctccccgcggtggcggccgctctagaactagtggatcccccgggctgcaggaattcgtctcacccctagaaaaacatctcaattctcaccacacacacgcacacacactatcgtccagcaagctcgctgttgcttgccacccaccgcctcagctcgatcgcaacgcgcttggcatggcgtccgaggtgtggctatcgccggcgtctcgcctcccatccctctccaacgcaccacctcgcttacgctccaagcctgccaccacaaccgcctctttgctctctccctgtccccgccctgcccgcgccctgcctgtgctgcgtgtccgtcgccgccgccgacttcgcgccaccgagcagcaaggccaggttcaggagcaagatgacgaggtgccggacaggaacatcctcccctactgcagcatcgacaggaagcagaagaagacgctgggagagatggagcaggagttcctgcaagccctccaggccttctactatgaccagaaggccatcatgtccaacgaggagttcgacaacctcaaggaggagctcatgtgggaggggagcagcgtcgtcatgctaaacgaagatgagcaaaagcttttggaagcttccttggcctatacctccggcaacccaatcatgtctgatgctgagttcgacgaactgaaacttagataaagacagacngcattgtcattgttgaggaagggtccaggtgcagcttaaggactcctaaggggaacagggacttgaatgtgactaccaaaagatgtccctcctaaagttccagccaccccgtagctttgg

SEQ ID NO: 78861 - protein, 167 aa, Zea mays
  misc_feature: Ceres CLONE 1563857
MASEVWLSPASRLPSLSNAPPRLRSKPATTTASLLSPCPRPARALPVLRVRRRRRLRATEQQGQVQEQDDEVPDRNILPYCSIDRKQKKTLGEMEQEFLQALQAFYYDQKAIMSNEEFDNLKEELMWEGSSVVMLNEDEQKLLEASLAYTSGNPIMSDAEFDELKLR

SEQ ID NO: 78862 - DNA, 930 bp, Zea mays
  misc_feature: Ceres CLONE 1563861
  misc_feature: Translation starting site: 160
  misc_feature (694)..(694): n is a, c, t, g, unknown, or other
  misc_feature (741)..(741): n is a, c, t, g, unknown, or other
  misc_feature (882)..(882): n is a, c, t, g, unknown, or other
ctccccgcggtggcggccgctctagaactagtggatcccccgggctgcaggaattcgtctcacccctagaaaaaaaaacacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctcctacccgcggcgctgctcccttcgttgcagcccgccaggaggcacacgctgcagccgcccgccgcagccgccgagtccgcaggggaggccaagtctgtgggtttcctggagaagtacccggccctggtcaccggcttcttcttcttcatgtggtacttcctcaacgtcatattcaacatcctcaacaagaagatctacaactacttcccatacccatactttgtgtccttgatccatctagtagtgggtgtcgtatactgcctcatcagctggagtgtcggtctccccaagcgagcgcctatcaatggcacgctcctcaagcttctctttccagtcgccctgntgccatggtattggtcacatcactagcaatgtgtccttcgctgctgntgcagtctcatttgctcacactatcaaagcctctgaagccttcttcagcgcagcggctactcagtttatccttggacagcaagtcccttctctctgtggctttctctgccccggggggccatggtgtttcaatgcatcccntacgaactttcattcactggactggctcttcatgccatgaatcaacat

SEQ ID NO: 78863 - DNA, 889 bp, Zea mays
  misc_feature: Ceres CLONE 1563864
ggagctccccgcggtggcggccgctctagaactagtggatcccccgggctgcaggaattcgtctcacccctagaaaaagccggcagtagaattctctcctcttccgttcctctcctggctgtagctatagaacgtgtgtgtcactcgtcaatgagaacgaaatgggaaggcgagctactcgtcccgctcatcagtgcatcacttctgctaaggcttgaccgtgggaacttcttctatgtcctcctcgacccactccttatcatgaattggaggttccgtgcttctcgccgcggctgctgccgtcgcgttcgcgggctttctcgttatattccggctctggcggacgcacctctccaatgtcgctcagcctgagccatagcccgacccggagggaggtacgtcggagcattccctgaccccctgtctcttgtcgtcaaagacgcccgcacgcggggcctaggcggaagcgaaggcaaggacaccctcgggtgataatcccttgcggttatcgcccgacatggtcgacaatgtaggctgcccgggccgctacatgtcctccaagttcgccaccgccgactcgtcgtcatcctcggctgccactgcaggaacgcgtcctagtcagaggagcatacgatgcctgtctaccgtgaagtgctctatcgaaagtgctactggacgctacgccatcaggtcactacttcactgacgaccctgaagtggccaggctcaacagactctagaacaattggtcggtgaaggagactccatagatgatccgtttcttgttcgcgtttagcattaccttcaaatgccgacgttgatttgagaagtcgcctttccccaacgggtttgttactttacatttgactacttccttattaaaaaaggg

SEQ ID NO: 78864 - DNA, 838 bp, Zea mays
  misc_feature: Ceres CLONE 1563865
  misc_feature: Encodes the peptide sequence at SEQ ID NO. 78865
  misc_feature (787)..(787): n is a, c, t, g, unknown, or other
  misc_feature (829)..(829): n is a, c, t, g, unknown, or other
ctccccgcggtggcggccgctctagaactagtggatcccccgggctgcaggaattcgtctcacccctagaaaaaagtccttccatttccccgttttggctgcgtgcatgcccgcgtgttcccagaccgcaaggaatcaaatccgcccgccgcccgacatctcgcctcgccgcggcatttcctcaaacgccccgctcacagcgcccatgggctcccttccggtgccggcctcaacggaatgcaccccgcaggggcgcgccacggtgtcggcgtcggacctggcgccgctcttctccgcgcagcgccggcacctggaccacttcttcgaccgcctcgacatgtcgcaggcggcggcgttcgcgcaggtgctgctcgacgcgccgggcgccgtcttcttcacgggcgtcggcaagtcgggcatcgtggcgcgcaagaccgcgcagacgctggcgtcgctgggcttcgcgcgcgccggcttcctcgcccccgtcgacgcgctccacggcgacatcggcgcgctcttccccggggacgtgctcgtgctcctctccaagtccggcgcctccgacgagctgctcgcgctcgtaccctgcgcgcgcgccaagggaggctacctcgtctcggtcacctccgcggcctcggggggcgactgcccgctcgccgcggctggcgacctcaacgtccacctccgctgcaaggggggaagtgtgccctttcgggctcgcgcccgtcacctcaccgccatccagatggtgttcggggacacggttatcgccgccatcatgganggcaaggcgactctccagggacagtacgccctccaccaatcntgctggcaa

SEQ ID NO: 78865 - protein, 211 aa, Zea mays
  misc_feature: Ceres CLONE 1563865
  misc_feature (55)..(191): Pfam Name: SIS Pfam Description: SIS domain
  misc_feature: SWISSPROT Homolog: EC 5.3.1.13 Arabinose-5-phosphate isomerase
  misc_feature (194)..(194): Xaa is any aa, unknown, or other
MGSLPVPASTECTPQGRATVSASDLAPLFSAQRRHLDHFFDRLDMSQAAAFAQVLLDAPGAVFFTGVGKSGIVARKTAQTLASLGFARAGFLAPVDALHGDIGALFPGDVLVLLSKSGASDELLALVPCARAKGGYLVSVTSAASGGDCPLAAAGDLNVHLRCKGGSVPFRARARHLTAIQMVFGDTVIAAIMXGKATLQGQYALHQSCWQ

SEQ ID NO: 78866 - DNA, 911 bp, Zea mays
  misc_feature: Ceres CLONE 1563866
  misc_feature: Encodes the peptide sequence at SEQ ID NO. 78867
  misc_feature (784)..(784): n is a, c, t, g, unknown, or other
ctccccgcggtggcggccgctctagaactagtggatcccccgggctgcaggaattcgtctcacccctagaaaaagataagccccggatgagcccccgatggccaaggtctcgcctcctcctcgggatcatcatgtcgtcgttggtccctcgagagcggcaaattaataagtaaatgagcaactttttctcgcgtgtggtccagactcccgtcttcttcctcgaccgctaaccttaccggtccccaaatgtcgcctctcgtgctgctgctcctcgcgcacctactcgccacggccactgcagcgggagcagcgcggaccagggacgacgggcctcctgctccgtcgtcgtcgtccccgcgggtgccggcgacgacgccgccgtggccggaccagttccacgcggtggtggtgacgaacctgagcgcgcgcggcggcgggctgcagctgatcgacctgtactacgactggccgcgagggcgcgacctgaacatcgtccgcgaccagctgtccggcgagcggcgctggagctggaacgtggagtggagcaacggcaccgccttcctgttcgactccgcgtcctgccgcaccttccagttcgccgtgggcctcctgccgcccgactgtaaggcccgcggcgccgcctacctggggcgcgaccgcgtcgactgcttcgactggcacgtctgggtcaactttcgtctcgcccgctactacgaggacgtcgccaccggacgccccgtcagctggaacttcaatgggctgcagcggcatgtgctgagcttcnaggcgggggcagtgctgcaggactccttctagtggcaggcgccggcttactgcttcaccaaacccattggagcattgccgacgccccgctttctcttccggaatcacgtcgcttgggctcgggagtc

SEQ ID NO: 78867 - protein, 189 aa, Zea mays
  misc_feature: Ceres CLONE 1563866
  misc_feature (180)..(180): Xaa is any aa, unknown, or other
MSPLVLLLLAHLLATATAAGAARTRDDGPPAPSSSSPRVPATTPPWPDQFHAVVVTNLSARGGGLQLIDLYYDWPRGRDLNIVRDQLSGERRWSWNVEWSNGTAFLFDSASCRTFQFAVGLLPPDCKARGAAYLGRDRVDCFDWHVWVNFRLARYYEDVATGRPVSWNFNGLQRHVLSFXAGAVLQDSF

SEQ ID NO: 78868 - DNA, 939 bp, Zea mays
  misc_feature: Ceres CLONE 1563867
  misc_feature: Encodes the peptide sequence at SEQ ID NO. 78869
  misc_feature (774)..(774): n is a, c, t, g, unknown, or other
  misc_feature (775)..(775): n is a, c, t, g, unknown, or other
  misc_feature (874)..(874): n is a, c, t, g, unknown, or other
  misc_feature (939)..(939): n is a, c, t, g, unknown, or other
ctccccgcggtggcggccgctctagaactagtggatcccccgggctgcaggaattcgtctcacccctagaaaaaatccgtccaatcaaccgggctgctctgctgcctctccggcgccattgacgagcaagagagtgctccgacacctggtccgtcgcgtgccgtgcccacccgctaaggccagggcgccccgactcgagctcaccgcgtcgaactcgaaccgctgctgttcctcggcagggggcagggtcgtcgaggatgccggagcactcagagaacgcggcggcggacctgatgggcaacatcatggagaccatcgcggagaacctcccgaggcagaagtccgtgcggttcgacgacggcgacggctcctccatctccgagcaggccaagaagctgttcagcggcggcgagagcaggaagaagtcggtccaccacgtgctgggcggcggcaaatccgccgacgtgctgctgtggcggaacaagaagatctcgtccagcgtgctgggcgtggcgacgctggtgtgggtgttcttcgagtggctggactaccacttcctcaccatcctctgcttcgtgctcgcgctcggcatggccgtccagttcgcctggtccatcttctcgtccagcgtgcctcgcgtgcagctgccggaagagctgttcgcgagcgccggcgcggccgccggcgccctagtgaacagggcgctgggcttcctccagacgtggcctgcggacgcgacctcagcggctggtcatcgtgatcgccgggttctcnnctgcgcgtcgtcggcagcttctgcaactcctgacgtcatctacatcgggttcgtgtgcgcgcaacccctgccggtgctgtacgagagtaccagaccagntggacgagtcctgtacacatgctagggctgtgcaaaccagtcagcagctgaaagcagggctcccn

SEQ ID NO: 78869 - protein, 213 aa, Zea mays
  misc_feature: Ceres CLONE 1563867
  misc_feature (67)..(212): Pfam Name: Reticulon Pfam Description: Reticulon
  misc_feature (173)..(173): Xaa is any aa, unknown, or other
  misc_feature (206)..(206): Xaa is any aa, unknown, or other
MPEHSENAAADLMGNIMETIAENLPRQKSVRFDDGDGSSISEQAKKLFSGGESRKKSVHHVLGGGKSADVLLWRNKKISSSVLGVATLVWVFFEWLDYHFLTILCFVLALGMAVQFAWSIFSSSVPRVQLPEELFASAGAAAGALVNRALGFLQTWPADATSAAGHRDRRVLXCASSAASATPDVIYIGFVCAQPLPVLYESTRPXGRVLYTC

SEQ ID NO: 78870 - DNA, 942 bp, Zea mays
  misc_feature: Ceres CLONE 1563868
  misc_feature: Encodes the peptide sequence at SEQ ID NO. 78871
  misc_feature (722)..(722): n is a, c, t, g, unknown, or other
acccgcggtggcggccgctctagaactagtggatcccccgggctgcaggaattcgtctcacccctagaaaaaagtccagcaccccccctccctccctatctctctgatctctccctcgctctcgcagccgccactgtagaagcttcgaggctgctgctgcgcccatggccgcggaagccaagacgccgtccctcgctgaggaatattcacttccaccacaggaagttccagtggaaaaggcagctgaggagaagccctctagtggtactgagactgaatctgctccttcaaccaatgatgagactccttcatctgtagaagataagaatgaaacgtctgaagtacaagatgctgctgaaaagtcagacgcagaagaaactaacactgctgcagaggaagcaagtgagactgccgaggaggaagaggctgagaaacctgagatcaagattgaaacagctccagcagattttcgtttcccaacaacaaatcaaacgaggcattgtttcacacgctatgttgaataccacaggtgtgtggctgcaaaaggtgaggatgcacctgagtgtgataagtttgccaagtactatcgatccctgtgcccaggtgaatgggttgaacgctggaacgagcagcgtgaaaatggcaccttccctggacctctgtaatcctacaatgcaaaaagaattaggaactcacgatgttgtgccggccttcttcctggntactgggcgcaagttagcagggagagagacaatcatcctctttgaagctctctacaaataggagattctttttgacttgaagaatgccttggtgctcttccctaacgtcttgttctgcgctgctgaataacagcgtcacagttacatttttgtccgtatttcaggttttaaaaagaatcatgattccccatctttgccccgtaacaaccagctggacggg

SEQ ID NO: 78871 - protein, 166 aa, Zea mays
  misc_feature: Ceres CLONE 1563868
  misc_feature (93)..(165): Pfam Name: COX6B Pfam Description: Cytochrome oxidase c subunit VIb
  misc_feature: SWISSPROT Homolog: EC 1.9.3.1 Cytochrome-c oxidase
MAAEAKTPSLAEEYSLPPQEVPVEKAAEEKPSSGTETESAPSTNDETPSSVEDKNETSEVQDAAEKSDAEETNTAAEEASETAEEEEAEKPEIKIETAPADFRFPTTNQTRHCFTRYVEYHRCVAAKGEDAPECDKFAKYYRSLCPGEWVERWNEQRENGTFPGPL

SEQ ID NO: 78872 - DNA, 712 bp, Zea mays
  misc_feature: Ceres CLONE 1563869
  misc_feature: Encodes the peptide sequence at SEQ ID NO. 78873
  misc_feature (465)..(465): n is a, c, t, g, unknown, or other
ctggagctccccgcggtggcggccgctctagaactagtggatcccccgggctgcaggaattcgtctcacccctagaaaaaacaccgcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatcccgcagtaccagaagagcacggagctgctgatccgcaagctgccgttccagcgcctggtgcgggagatcgcgcaggactttcagaccgacctacgccttcagagctctgctgtctccgcgctgcaggaagcggctgaagcctactttgtcggggcttttcgagaaanccaacttttgggccattcacggccaagggggttacccatcatgcccaaggaacatccagttttggccgccgcaattcccggggggggaaggggcccaaaccgcccaaattttttcggggccaacaggggggcccaatttcgaaaaaatttttaagaaaaaaatccgggggggctctctaaaattttgggggggtttcactggcgaaaaaatacccccgggggggggggggggggtgggacccccggg

SEQ ID NO: 78873 - protein, 158 aa, Zea mays
  misc_feature: Ceres CLONE 1563869
  misc_feature (58)..(132): Pfam Name: Histone Pfam Description: Core histone H2A/H2B/H3/H4
  misc_feature (108)..(108): Xaa is any aa, unknown, or other
MARTKQTARKSTGGKAPRKQLATKAARKSAPATGGVKKPHRFRPGTVALREIPQYQKSTELLIRKLPFQRLVREIAQDFQTDLRLQSSAVSALQEAAEAYFVGAFREXQLLGHSRPRGLPIMPKEHPVLAAAIPGGGRGPNRPNFFGANRGAQFRKNF

SEQ ID NO: 78874 - DNA, 858 bp, Zea mays
  misc_feature: Ceres CLONE 1563870
  misc_feature: Encodes the peptide sequence at SEQ ID NO. 78875
  misc_feature (836)..(836): n is a, c, t, g, unknown, or other
agctccccgcggtggcggccgctctagaactagtggatcccccgggctgcaggaattcgtctcacccctagaaaaagctggaagctggtcacacaaacctacgtagagtgacataccttgtgttggatgaggcggaccggatgctagatatggggtttgagccccaaattcggaaaatagtagcacagatccgcccagacaggcaaaccttgtactggagtgccacatggcctagagaagttgaagccttagcaagacagtttctacaaaatccttacaaggtaatcataggctcacctgaacttaaagctaatcattccatacaacaaattgttgaagttatttcagatcatgagaagtatccaagactcagtaagctcttgtctgatctaatggatgggagccgtatcttgatattcttccaaacaaaaaaggattgcgataagatcacccggcagcttagaatggatgggtggccagcattatctatacatggtgataaagctcaagctgaacgggactatgttcttgcagagtttaagagcggcaagagccccataatggctgccacagatgtggcagcacgtggtcttgatgtgaaggacataaagtgtgtgataaattatgattttccaacaactcttgaagattatattcacaggataggtcgaactggccgtgctggtgctagcggaactgcatttacttttttcacacacgcaaatgcaaagttctcaaggaatctagtgaagattctgcgagaagctggccaagtcgtgaatccctgcctagaatccatgtcccagtcttcgaaactcacgggaggagggcatttncggtctagaggcaaaaggtggg

SEQ ID NO: 78875 - protein, 239 aa, Zea mays
  misc_feature: Ceres CLONE 1563870
  misc_feature (106)..(182): Pfam Name: Helicase_C Pfam Description: Helicase conserved C-terminal domain
  misc_feature (232)..(232): Xaa is any aa, unknown, or other
MLDMGFEPQIRKIVAQIRPDRQTLYWSATWPREVEALARQFLQNPYKVIIGSPELKANHSIQQIVEVISDHEKYPRLSKLLSDLMDGSRILIFFQTKKDCDKITRQLRMDGWPALSIHGDKAQAERDYVLAEFKSGKSPIMAATDVAARGLDVKDIKCVINYDFPTTLEDYIHRIGRTGRAGASGTAFTFFTHANAKFSRNLVKILREAGQVVNPCLESMSQSSKLTGGGHXRSRGKRW

SEQ ID NO: 78876 - DNA, 791 bp, Zea mays
  misc_feature: Ceres CLONE 1563872
  misc_feature: Encodes the peptide sequence at SEQ ID NO. 78877
  misc_feature (529)..(529): n is a, c, t, g, unknown, or other
ctggagctccccgcggtggcggccgctctagaactagtggatcccccgggctgcaggaattcgtctcacccctagaaaaagccaaaccagcacccgccgccgacagggaacatcgccggccgagatcggctgcacatctgtgctgcttcagggcgccggagttcgcgtcgtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctcccccaggggcgtatcctcctcctccaggggcatatcctcctccacctggggcatacccaccacaatatgggtaccctcagccaggtggctacccacctcaaggtggatatcctcctgcaggctaccccggctcatctcaccaggggtatgggagcagccacggcgggggccacggggggcacatggggacnggggcatgctagcgggaggtgctgccggcgcccgctgcgctttatggagcaacaagctttctcatgggcataacggaaaccggtgggaaatggggccttttgaaggctatgggtcccgggggtttacggccccccgggtttgggggggccccccggcaaattttaaaaccaggggttccgggggcccccccggggggaaatttttaaaaaccggggggcccccggaaaaatttttaaaaccattgggggaaaaacaacccgg

SEQ ID NO: 78877 - protein, 115 aa, Zea mays
  misc_feature: Ceres CLONE 1563872
MGGGKDKHDESDKGLFSNMMHGVAGGHGYPHQGYPPQGYPPQPGAYPPPPGAYPPPPGAYPPPPGAYPPQYGYPQPGGYPPQGGYPPAGYPGSSHQGYGSSHGGGHGGHMGTGAC

SEQ ID NO: 78878 - DNA, 913 bp, Zea mays
  misc_feature: Ceres CLONE 1563873
  misc_feature: Translation starting site: 152
  misc_feature (385)..(385): n is a, c, t, g, unknown, or other
  misc_feature (688)..(688): n is a, c, t, g, unknown, or other
  misc_feature (689)..(689): n is a, c, t, g, unknown, or other
  misc_feature (799)..(799): n is a, c, t, g, unknown, or other
  misc_feature (875)..(875): n is a, c, t, g, unknown, or other
  misc_feature (877)..(877): n is a, c, t, g, unknown, or other
acccgcggtggcggccgctctagaactagtggatcccccgggctgcaggaattcgtctcacccctagaaaaagttctccaccagccccggaggtcgacacgtgcgccacaccatagggcagggcccagggagcccggcgacctccatctccatggccgagtgcgaggagctggtggagagcggcggcgccgaggaggacatgccccgcgtcgtagccgccctcgccggcatcctggagcgcgtcgcgaaccgcaacgacgcggcggcggtcgcagaggtctcggccgtagccccggcgtcggcgttccgggcgacgacgaagccgggcatctcggtgcgcgcgtacatggcgcgcatcgcgcggttcgctgggtgcagccccgcngtgctacgtcgtggcctacgtctacctcgaccgcctcctgcgccgcggccgcctcctggcgctggccgtcgactcctacagcgtgcaccgcctcctcattaccgccgtgcttgccgccgtcaagttcatggacgacatatgctacaacaacgcctacttcgccaaggtcgggggcatcagccctggtggagatgaactacctggaggtggacttccctgttcggcgtcggcttccacctcaacgtggcggcccgagacgttcggcgactactgcgccgtgctgcggtcggagctactgtgcgnncgagctgccccccgcgcactcaggctgcagcactgctgcctgtcccgagatgacgcccgggccggatgcagcgcccagcagcagctcgctgcatgaatgaaagaaacttnagcccatcgatcgatcgacgactcatcccgtggcttggggcgcaggagttgtaagccggtgccaatggtccaaatnantagatggttttgtctttccaagattataagctttca

SEQ ID NO: 78879 - DNA, 800 bp, Zea mays
  misc_feature: Ceres CLONE 1563874
  misc_feature: Encodes the peptide sequence at SEQ ID NO. 78880
  misc_feature (490)..(490): n is a, c, t, g, unknown, or other
  misc_feature (567)..(567): n is a, c, t, g, unknown, or other
ctcaccgcggtggcggccgctctagaactagtggatcccccgggctgcaggaattcgtctcacccctagaaaaatccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcggggccggcgcgnacccgagcgccatcgcgcccttctccttcgggtcgctgctgggcacgcagctgctgctgatggggttggtggagtcnaaacggtggggtgactttcttcaccccgaactccaggccgtggagtggggcacgccctgggtcgcgcaccgctgaaaacttccccaaactccacggggaagcagggctacctggggcggaaagttcttcgaccccgttggggcttcccgggaccgtaaagggaaggggtttaattccccgaaattaaaaagtttgaagggggttaggcggggcgaaaataaaacccccccccc

SEQ ID NO: 78880 - protein, 168 aa, Zea mays
  misc_feature: Ceres CLONE 1563874
  misc_feature (54)..(160): Pfam Name: Chloroa_b-bind Pfam Description: Chlorophyll A-B binding protein
  misc_feature (119)..(119): Xaa is any aa, unknown, or other
MALAPTSAAVLKTPFLGARRALAKPAPRRALVIAAAAAAKKSWIPAIKSDAEIVNPPWLDGSLPGDFGFDPLGLGKDPAFLKWYREAELIHGRWAMAAVLGIFVGQAWSGIPWFGAGAXPSAIAPFSFGSLLGTQLLLMGLVESKRWGDFLHPELQAVEWGTPWVAHR

SEQ ID NO: 78881 - DNA, 918 bp, Zea mays
  misc_feature: Ceres CLONE 1563877
  misc_feature: Encodes the peptide sequence at SEQ ID NO. 78882
  misc_feature (863)..(863): n is a, c, t, g, unknown, or other
ccgcggtggcggccgctctagaactagtggatcccccgggctgcaggaattcgtctcacccctagaaaaaagcttcctcattggccatccttcgtcttccatggagaggctccttgccggcctactactcggcttcctattattgatcgcgtcagtaggaagccatgcaactcgtgctccagatcagtactggaagtctgctcttcccgacactcccatgccgagctccctctcccaactcctcaacaccccagctggcaagggcggcgtcggtggaggcagcagcggcaagaagcccggcggcaccacggtgggagttgggaaagggggagtgggcgttaacgttaaccctaccaaacccggcggcgccggtacaaccgttggcgttggcaaaggtggcgtcggcgtcggcgtcaatcccgggtacggcaagccgggtggcaccacggtgggcgttggcaagggcagggttggcgtccacgtgaacccgggcaagaagcccgtccacgtccccgtcggccctttccagtacgagtacgccgcatcggagacgcagttgcacgacgaccccagcgtggcgctcttcttccgagaggaggacctgcagcccggtaagaagacgaccgtccagttcgccaacaccgcgatggccggcgccaagttcctcccgcgaagcgatgccgaaggcatcccgttctcctccgagaaagtccccgagatcctcggccgcttctcggtggacccggactccatgaaggcggcggagattgcgcatacgcttcacgactgcgaggcgcccgccggcatggtcgaaaagaaagcttgccccacgcccctggaatcctgggtggaatttgcaccgncagcctcggggcccaccacctgaaggccccctccaacggctgtggggaagggagg

SEQ ID NO: 78882 - protein, 261 aa, Zea mays
  misc_feature: Ceres CLONE 1563877
  misc_feature (160)..(262): Pfam Name: BURP Pfam Description: BURP domain
  misc_feature (255)..(255): Xaa is any aa, unknown, or other
MERLLAGLLLGFLLLIASVGSHATRAPDQYWKSALPDTPMPSSLSQLLNTPAGKGGVGGGSSGKKPGGTTVGVGKGGVGVNVNPTKPGGAGTTVGVGKGGVGVGVNPGYGKPGGTTVGVGKGRVGVHVNPGKKPVHVPVGPFQYEYAASETQLHDDPSVALFFREEDLQPGKKTTVQFANTAMAGAKFLPRSDAEGIPFSSEKVPEILGRFSVDPDSMKAAEIAHTLHDCEAPAGMVEKKACPTPLESWVEFAPXASGPTT

SEQ ID NO: 78883 - DNA, 778 bp, Zea mays
  misc_feature: Ceres CLONE 1563878
  misc_feature: Encodes the peptide sequence at SEQ ID NO. 78884
  misc_feature (494)..(494): n is a, c, t, g, unknown, or other
  misc_feature (590)..(590): n is a, c, t, g, unknown, or other
ctccccgcggtggcggccgctctagaactagtggatcccccgggctgcaggaattcgtctcacccctagaaaaacctctcttgcgccgccgctggcccagcgcggccgccgtgctccttctccactcgtgcttcccaagctgcttcgccggaagcaatgcgagggccctgccccggtggaggcgtctcggcgtcttttgccccgagcttcaacggctcccgcgccatgatctggccggcaacagtaaattgcacgagacggatccgcatttcattcatccaaacagccaaaacggggccgttccgcgcaggcgacagggctacgggaggaatttgctatgctagccaggcggttgaattgctgcccactttgtaccctgaaatcgtggtccgagacgcacggctcgaggactgctgggaagtggctgacactcactgcagctcgttctttcctggttacaagttcccgttggaccttgttctccggattgatcngtacattgctctcctctctggattttcagttccacccggctgcatgaggacttgccttgttggcgtcaattctaattctgtaaatagtagttccancatcgagtgtggagatgctacaggatgccaactttgaaaaatacaatctcagtaaaaggctcgttagctgccattccttacccttgaatacagtgggcaaaactatctttcccaagaagggggacccctgaaacccaaaaaagggaccgggtttttgccgtttaatagccaaaaccgtccccggggga

SEQ ID NO: 78884 - protein, 156 aa, Zea mays
  misc_feature: Ceres CLONE 1563878
  misc_feature (113)..(113): Xaa is any aa, unknown, or other
  misc_feature (145)..(145): Xaa is any aa, unknown, or other
MRGPCPGGGVSASFAPSFNGSRAMIWPATVNCTRRIRISFIQTAKTGPFRAGDRATGGICYASQAVELLPTLYPEIVVRDARLEDCWEVADTHCSSFFPGYKFPLDLVLRIDXYIALLSGFSVPPGCMRTCLVGVNSNSVNSSSXIECGDATGCQL

SEQ ID NO: 78885 - DNA, 1117 bp, Zea mays
  misc_feature: Ceres CLONE 1563879
  misc_feature: Encodes the peptide sequence at SEQ ID NO. 78886
  misc_feature (1060)..(1060): n is a, c, t, g, unknown, or other
  misc_feature (1117)..(1117): n is a, c, t, g, unknown, or other
ctctccgcggtggcggccgctctagaactagtggatcccccgggctgcaggaattcgtctcacccctagaaaaagacgccgccagcagctcgctctcgcaccgaccgtcccagaaatatctcgtcggcggtcagttgagctgcgagcaaccatcaaccaatcaaggacgacgacgcacggatcgatggccacgctctcctcctgcagccgcctgagtagcggcaccggcgccgcggctatccgccggcagccgaagccgacccgtgcaggagtcctgttcaccagccggcggggctcctccgcgagcgttcgcacggccgccgccgctgccactgcggcgccggccgccctatagcagcagaacacgggggtgtcggtgtccctgccgacgtgggccgaattcgagctcgggcgggggccggtgttttggaagaccagcaacgggcctggcgtcctccccgggggaggggggtgaccctgtttctacaaccccggcggggaagcaaaaagggcccccaaaaaaacgtgttccgggtggggcggttcaaagggggggtgtcaaaccaatccgattattgttgtggcggggtaacacccaaggcaaaacaaacaaccgtcagggtcccgcccgggaaaaagacaaacccctgcccctctcttacacacattctaagagaataacccggttggtcgttcaatcccacgcccccaaacaaggcattggtataaacttctatccactctccacaacacaatgggggcactaattatggaggaactgagccccgccccaccacctctcaaggatgtgaggggggcgccctagaaaccccctttgtatgaacaaaataacccgcccggtagttctccatcataccaataggcccgtgacgagaaccacactcaccaaatgtgggaggggcccttctcatcatcttgttcaccctcaccacggttagaaaaaaaatactatgtcttctaacgggcgcactgtggagcgcgtgttctcatcagataatggcgggcggggtgtcgcttcttttattactttgtttgagtngtcggggtgcccacacacccagtatgttttcgtgggggcgtgtatggctacaaagcn

SEQ ID NO: 78886 - protein, 56 aa, Zea mays
  misc_feature: Ceres CLONE 1563879
MATLSSCSRLSSGTGAAAIRRQPKPTRAGVLFTSRRGSSASVRTAAAAATAAPAAL

SEQ ID NO: 78887 - DNA, 869 bp, Zea mays
  misc_feature: Ceres CLONE 1563880
  misc_feature: Encodes the peptide sequence at SEQ ID NO. 78888
  misc_feature (140)..(140): n is a, c, t, g, unknown, or other
  misc_feature (374)..(374): n is a, c, t, g, unknown, or other
  misc_feature (579)..(579): n is a, c, t, g, unknown, or other
  misc_feature (638)..(638): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (668)..(668): n is a, c, t, g, unknown, or other
  misc_feature (669)..(669): n is a, c, t, g, unknown, or other
  misc_feature (671)..(671): n is a, c, t, g, unknown, or other
  misc_feature (673)..(673): n is a, c, t, g, unknown, or other
  misc_feature (676)..(676): n is a, c, t, g, unknown, or other
  misc_feature (713)..(713): n is a, c, t, g, unknown, or other
  misc_feature (714)..(714): n is a, c, t, g, unknown, or other
  misc_feature (722)..(722): n is a, c, t, g, unknown, or other
  misc_feature (794)..(794): n is a, c, t, g, unknown, or other
ggagctccccgcggtggcggccgctctagaactagtggatcccccgggctgcaggaattcgtctcacccctagaaaaaaccccactggctcggtgttcacttccggtcggggccatggcgcgcgctcggcgtctctaccngcgccgctctcccgcactcaccttcctcccaccacgtaccttccctcctccacaacacgcagcacgcactccctcctcctccggccccagcgcaaggggcccgccaccaccgcggggggcgctgccccccggccgcggacctcccggggctgtcccctccccgccgcgggcgccgcggctgccgcgctggcggcggcggtgtgactttccgaccccgagcggcggcggcgctcncaaggcgagagaggccgccgagaagaaaacagaagggaggtcgcccccacttaaaattcacaggggttcgagcggggggggacaaatatcagggcgcgaacgagagggtgaacaccccggcaactttgacatccgcgaaggccagcccgcaaaacacagggggggcgcggttgccaagcttcccaaacccccccgggaggggggnggggggcccccccccctttgccccccggcccgctccgacaaggagggctggcctctctnccctccgcggcgggcgcgannnaacccggnngncntcncgcaaaaactcacccaaagcatgtgcgagccacgagnncgcgccantcgtcgtcgcctcgtacccgatgcccgccggtcaaatccccgacctgaaagcctggagggcggtaacaaacntgtgggtgtggctggacctgctcatccactacccgcgggaagagccccgccccagatcccggccccctcgcttcg

SEQ ID NO: 78888 - protein, 42 aa, Zea mays
  misc_feature: Ceres CLONE 1563880
  misc_feature (18)..(18): Xaa is any aa, unknown, or other
MPAGQIPDLKAWRAVTNXWVWLDLLIHYPREEPRPRSRPPRF

SEQ ID NO: 78889 - DNA, 1104 bp, Zea mays
  misc_feature: Ceres CLONE 1563885
  misc_feature: Encodes the peptide sequence at SEQ ID NO. 78890
  misc_feature (1008)..(1008): n is a, c, t, g, unknown, or other
tccccgcggtggcggccgctctagaactagtggatcccccgggctgcaggaattcgtctcacccctagaaaaattccacgcgtccactgtccacccacacgcaaggtcgcaggtcgcaacccgcgggcggaggggcaggcacaggaccgttgcgttgctgccgccgccagcacgagatcgaggagggatcccccgctctcacgccgctccaggtcgagggccgagcgagatggtgaacaccttcttcctcttctgcgggtgcgtggaccaagccagcgtggcggaggtggagaagtggggccgcttcctccgcctcgccgacccgggcctccacttcttcaaccccctcgccggggagtgcgtcgcgggctccctcaccacacgcgtccagtccccccacctccgcgtcgagaccaagaccaaggatcatgtcttcgtcccactggatcgcacaatccagtaccgttgtttgccagcggaaaatgctgatggatgctttcctatgaagtttgcagaaatcccccaggcagcaaaattcccaggccctacggcccttttggatagttgggtccgggccccgaagccgccccaaaatattaaaatcttgggacccatttctcttttggagggaagaaaaaaacctaatggtgggcccccaatgcctcgttatttggggagggaaaggccttgtgaaatataggggtgatatctgggcaaaccattttattggtgtgtaacccgcccattttggaggcccctgtttccgccacatggagattgaataaacaaggtctcctggaaaggccttgtctgggtccctttataagggattcctgcatcgcgaatatttaaaagcggtgccccgcaataggcgctttccaacctggcccaaatgggtttccactatgggtgtgtaacgcagaagataacaaacccttcttctggtggcaaagacaaccggatagtgttataacccgcgaggccaaaattattctttctggggcggtncggtatccttttaacatgcgctgggggggaataccccaccgccgtcgataaagaacaccctgaacatctcctcacatccgggtgcggggcgccggg

SEQ ID NO: 78890 - protein, 156 aa, Zea mays
  misc_feature: Ceres CLONE 1563885
MVNTFFLFCGCVDQASVAEVEKWGRFLRLADPGLHFFNPLAGECVAGSLTTRVQSPHLRVETKTKDHVFVPLDRTIQYRCLPAENADGCFPMKFAEIPQAAKFPGPTALLDSWVRAPKPPQNIKILGPISLLEGRKKPNGGPPMPRYLGRERPCEI

SEQ ID NO: 78891 - DNA, 1044 bp, Zea mays
  misc_feature: Ceres CLONE 1563887
  misc_feature: Encodes the peptide sequence at SEQ ID NO. 78892
  misc_feature (759)..(759): n is a, c, t, g, unknown, or other
tccccgcggtggcggccgctctagaatagtggatcccccgggctgcaggaattcgtctcacccctagaaaaagtgtcatccactccgccgcacaggcgctcagctccgcaacgccgtcggaaatggtcgccgccaccgccatggccaccgctgcatcgccgctactcaacgggacccgaatacctgcgcggctccgccatcgaggactcagcgtgcgctgctctgctgtggcgggcggcgcggcctaggcaccggcttccacgggcgcgcggctctccgcggactgcgtcgtggtgggcggaggcatcagtggcctctgcaccgcgcaagcgctggccacgcggcacggcgtcgggggactgctttgtcacgggaggcccgcgcccggcccgggggtaaaatttaccacaccccgagccgccccgaggaaggggtaccctctggggaggaagggggcccaaaaagcttccaagcccctccggacccccgtttctcaccaatgggccgtgggacagcggggaccggaaacgaatgaacttgggttttttgggggaaccccaaaacccccccccggtttttccttggtgggtggggaagggggaaaccctgaagggcccccgtggcccattcaaaaggcccccccggaaccctactccgtttttttcgatattcttctagtgggcgattccccaaggggaaaaaacctccagggggcccggtgctctagggcgccccctttgtggttatcgtgtcccgcgnctccttcccagaggcccccgaaaatagctacgtgtggagggagattttttgggccccccaaaccccccgggggcggaaaggttatttaaggcgaccccactggaacctcttttccctccagggtgccttaggcgggggggaccctttctacaccctcactgggaggcgcccctttgggacgggtttgcccgctgtaataaaacccgggaggattttttttgggggaactttcacgccacttgggggagggaggtaatccatacccccgggggtgccccctttcag

SEQ ID NO: 78892 - protein, 41 aa, Zea mays
  misc_feature: Ceres CLONE 1563887
MVAATAMATAASPLLNGTRIPARLRHRGLSVRCSAVAGGAA

SEQ ID NO: 78893 - DNA, 867 bp, Zea mays
  misc_feature: Ceres CLONE 1563888
  misc_feature: Encodes the peptide sequence at SEQ ID NO. 78894
  misc_feature (492)..(492): n is a, c, t, g, unknown, or other
  misc_feature (616)..(616): n is a, c, t, g, unknown, or other
tggagctccccgcggtggcggccgctctagaactagtggatcccccgggctgcaggaattcgtctcacccctagaaaaaagtgtcacctgcacattgcagaccgcctcagcgcctcaccaagcgaaactcgttggcggctagggttttgctgcctcccgagcccaaaccctagagcacccgcgcccatcccatggcgtgctaggcttcgattgagactggggggattagtaccgcaggctgggattagagcaagcgccgagcggaaatggcatcgagtaaccaattcgatctacttggagacgtcgagaacgacgaccctgcccacctcctcgcagctgccgaagaagaaggcggccgcggtgcctaagcccgcgcccgcgccggccaagttgcccaccaagcctccgccgcccgcgcaacctgtgagggaggaaaggaactatggtgctccaccgcgcgatggtccaggacgtgaaagaaggcggccgcgntgcaggactggcccgaggcgagatttttgcgatgctgatgcccacgcttttagggggggtaatggggcggccggccgccgttttgggaaagggtgattttctcccggtaaaatggtaaagtagnccccccaaaaagggggcctggggcccccccagcttacccgggaaagtgggcaaaattgggggggaaccaccaagggccagccgggaaaaaattttaaaactccctccccggggaattaaaccccccaaggggcaaagggccgtggttttcgggaaaaaaaccctaaagaggctgggccctggaaaattggggaaacccccccttagaagcgctttaaaaaagcacacggggaggtgttataatctcgggaa

SEQ ID NO: 78894 - protein, 55 aa, Zea mays
  misc_feature: Ceres CLONE 1563888
  misc_feature (17)..(17): Xaa is any aa, unknown, or other
MVLHRAMVQDVKEGGRXAGLARGEIFAMLMPTLLGGVMGRPAAVLGKGDFLPVKW

SEQ ID NO: 78895 - DNA, 913 bp, Zea mays
  misc_feature: Ceres CLONE 1563889
  misc_feature: Encodes the peptide sequence at SEQ ID NO. 78896
  misc_feature (880)..(880): n is a, c, t, g, unknown, or other
  misc_feature (890)..(890): n is a, c, t, g, unknown, or other
ctccccgcggtggcggccgctctagaactagtggatcccccgggctgcaggaattcgtctcacccctagaaaaaatcagcctcatcaacctcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacatcaccgcgggcgaccccgacctagcgacgacagccgaggcgctgcggctgctggacggctgtggcgccgacgtcatcgagctgggcgtgccctgctcggacccctacatcgacgggcccatcatccaggcgtctgtggcgcgggctctggccagcggcaccaccatggacgccgtgctggagatgctcaaggaggtgacgcctgagctgtcgtgccccgtggtgctcctctcctactacaagcccatcatgtctcgcagcttggccgaccatgaaagaggcgggggtccacggtcttatagtgcctgatctgccgtacgtggcggcgcactctctgtgtatgaagcccagaacacaacattgcagctggtgctgctgacacacatgcctaccatagaccggatgaacgaatcacgaggcntcagaaggcntcgtctacctgtggagcgtggaa

SEQ ID NO: 78896 - protein, 117 aa, Zea mays
  misc_feature: Ceres CLONE 1563889
  misc_feature (1)..(118): Pfam Name: Trp_syntA Pfam Description: Tryptophan synthase alpha chain
  misc_feature: SWISSPROT Homolog: EC 4.2.1.20 Tryptophan synthase
MAALMAKGKTAFIPYITAGDPDLATTAEALRLLDGCGADVIELGVPCSDPYIDGPIIQASVARALASGTTMDAVLEMLKEVTPELSCPVVLLSYYKPIMSRSLADHERGGGPRSYSA

SEQ ID NO: 78897 - DNA, 955 bp, Zea mays
  misc_feature: Ceres CLONE 1563890
  misc_feature: Encodes the peptide sequence at SEQ ID NO. 78898
  misc_feature (762)..(762): n is a, c, t, g, unknown, or other
ctggagctccccgcggtggcggccgctctagaactagtggatcccccgggctgcaggaattcgtctcacccctagaaaaaatccccccgcgtagaggagaggagaggaagaagaagaacccagccaaatcctcagtcctcaggctgctcacagctcgtgccgtccactctcccccgagccagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtgacccccgcgtcgccgtctggcaagaagaccctccgcaagggcacagcggtcatcaccggcgcgtcgtccggcctcggcctcgccacggcgaaggccctcgcggagacaggcaagtggcacgtcatcatggcctgccgcgacttcctcaaggcgtcgcgcgcggccaaagcggccggcatggacaaagacagcttcaccgtcgtgcacctggacctcgccttcctggacagcgtccgccagttcgtccagaacgtgcgcaagctggagatgcccatcgacgtggtggtctgcaacgccgccgtgttacagcccaccgccaagaagcggtcctacaccgcgaacgcttcntgatgagcgtcggggtcaacaacttggccacttcttcctcggggggagtccttagggacctcagtcctccgactaccctcttaacgcttaatattgtgggctccctcaccgggaacacaaaccgctgggcggggacctgcccccgaaagcgaccgtggggacctggggggctcccgggggcctcaaagtgttg

SEQ ID NO: 78898 - protein, 186 aa, Zea mays
  misc_feature: Ceres CLONE 1563890
  misc_feature: SWISSPROT Homolog: EC 1.3.1.33 Protochlorophyllide reductase
MALQAATSFLPSALSARKEGSVKDSASFLGVRLAADGLKLDTTALGLRTVRVSRSADIRAQTAAVSSPSVTPASPSGKKTLRKGTAVITGASSGLGLATAKALAETGKWHVIMACRDFLKASRAAKAAGMDKDSFTVVHLDLAFLDSVRQFVQNVRKLEMPIDVVVCNAAVLQPTAKKRSYTANAS

SEQ ID NO: 78899 - DNA, 943 bp, Zea mays
  misc_feature: Ceres CLONE 1563891
  misc_feature: Translation starting site: 369
  misc_feature: SWISSPROT Homolog: EC 2.7.11.1 Non-specific serine/threonine protein kinase
  misc_feature (625)..(625): n is a, c, t, g, unknown, or other
  misc_feature (651)..(651): n is a, c, t, g, unknown, or other
  misc_feature (666)..(666): n is a, c, t, g, unknown, or other
  misc_feature (733)..(733): n is a, c, t, g, unknown, or other
  misc_feature (817)..(817): n is a, c, t, g, unknown, or other
  misc_feature (820)..(820): n is a, c, t, g, unknown, or other
ggagctccccgcggtggcggccgctctagaactagtggatcccccgggctgcaggaattcgtctcacccctagaaaaattatacccagccaaaatggacttctctgtaagccccaactgttaaaaagggaccatgaaggtcttttattgccttatctggactacctttgtcaagactcaagaagtcaggaggctgttagcattgacagagttggaagcgtatactgctcttagctggatttcaattcagcactgtaattccttgtgaaattctctccttggaaatgaaattactggacttgcataacagcacttagagtgtcttctttaagaggacaatgttgtaatgcatcaaccatcaaatctgagatgcctagcctaaccaactcctgctgtgattttattgctaattttggtagctcttgcagcttgaagcgtgtgcacatccattctttgatgagttgcgagagccacatgcgaggttgccaaatggacggccatttcctccactgttcaactttaaacaggaactagcatatgcctccccggagctcatcaacaggctgatcccagaccatgctaggcggcatcttgggctcactttattgcccaccactggaccatangcgaaggctctatggtgttttaaccnttgctcttctgattnctcgttgtgccataggcaattcaaggtgtagaatctgaccattattggaaagccaacacgagctggncgccatgtgttgcataaggagaagcggtatgttcgtgcagccagccttttgttcgcctgtttaatgcaaatctgatttactaancantgtaaaggaattggggttggggtttttgtttaacctattgaaggattcaatccctgggattgtattacttctcaacctttaatgttggaaattcgcctgtaagggtccacatcgccttgtgct

SEQ ID NO: 78900 - DNA, 934 bp, Zea mays
  misc_feature: Ceres CLONE 1563892
  misc_feature: Translation starting site: 148
  misc_feature: SWISSPROT Homolog: EC 3.4.25.1 Proteasome endopeptidase complex
  misc_feature (608)..(608): n is a, c, t, g, unknown, or other
  misc_feature (622)..(622): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
ctccccgcggtggcggccgctctagaactagtggatcccccgggctgcaggaattcgtctcacccctagaaaaaccctccgatcgtcgtcgacgacgcatccaccccaacccttctccgcgaaatagccgtcgccgcagctccggctatgtcaatcttcgagtacaacgggtccgccgtggtggcgatggtggggaagaactgcttcgcgattgccagcgaccggcggctcggcgtgcagcttcagaccatcgcaacagacttccagcgggtgttcaagatccacgacaagctctacatcggcctctcagggctcgccaccgacgcccagacgctgtaccagcggttggtcttcaggcacaagctgtatcagctgcgcgaggagagggacatgaagcccgagacatttgccagccttgtctctgcgctcctctacgagaagagattcgggccatatttctgccagccagtcattgctggacttggagatgacaacgtaccattcatttgtaccatggactgcctcggtgcaaaggagctggccaaggatttttgttgtttctgggacagcatcagaatctttgtatggtgcttgtgaatccatgtacnagccggacatgcancctgatgaactcttcgagactatatcccaagctctgaattcatcagtagatcgtgactgccttagcggatggggtggctatgtgctgattgtgacaccgactgaagtgagggagcatgtgattaagagcggatggactaaataatgcccactagattattagctgggtcccatgcttaagaaccaagtttgtgtttggattcttggagaacattgtttcatcacagtttgtattgagaagaacctttgatttcaaaaaaannnnnnnnnnaaaaacaacaaaaaatttaaaaaaaaaaaacaagacctcggg

SEQ ID NO: 78901 - DNA, 866 bp, Zea mays
  misc_feature: Ceres CLONE 1563893
  misc_feature: Encodes the peptide sequence at SEQ ID NO. 78902
agctccccgcggtggcggccgctctagaactagtggatcccccgggctgcaggaattcgtctcacccctagaaaaaaatctcgcgtctcctccgccgcccccgtcttctcctcccctcttgctaaagcaaagcaacctgcaacccgcaattattcctcccccgcacgcgaaatccgcccgcagctcttcgtccccggaggaccaagcctgcgcaccagagatgtcgtacgcctacctgttcaagtacatcatcatcggcgacacaggcgtcggcaagtcgtgcctgctgctgcagttcaccgacaagcgattccagcccgtccacgacctcaccatcggcgtcgagttcggggcccggatgatcaccatcgacaacaagcccatcaagctccagatttgggacacggctggtcaagagtcattcagatccataactagatcatactacagaggcgctgctggtgctcttttggtttatgacataactaggagggagactttcaaccaccttgcaagctggctggaggatgcgagacagcacgccaatgctaacatgacaataatgcttgttgggaacaagtgcgatctgtctcacaggcgtgcggtgagctatgaggaaggcgagcagtttgcaaaagaacatggtcttatcttcatggaagcctctgcgaagaccgcacagaatgtcgaggaggcatttgttaagactgctggagcaatctacaagagattcaagatggtgttttcgatgtatctaatgagtcctatggaaatcaaagtggatatggcatccctgggcaatctggaggtgcgtgtagctcgtcttctccaaggtggtggctgctgcagctaatctgctaacgcgt

SEQ ID NO: 78902 - protein, 210 aa, Zea mays
  misc_feature: Ceres CLONE 1563893
  misc_feature (8)..(169): Pfam Name: Ras Pfam Description: Ras family
  misc_feature (8)..(122): Pfam Name: Miro Pfam Description: Miro-like protein
  misc_feature: SWISSPROT Homolog: EC 2.7.11.1 Non-specific serine/threonine protein kinase
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTIMLVGNKCDLSHRRAVSYEEGEQFAKEHGLIFMEASAKTAQNVEEAFVKTAGAIYKRFKMVFSMYLMSPMEIKVDMASLGNLEVRVARLLQGGGCCS

SEQ ID NO: 78903 - DNA, 881 bp, Zea mays
  misc_feature: Ceres CLONE 1563896
  misc_feature: Encodes the peptide sequence at SEQ ID NO. 78904
  misc_feature (814)..(814): n is a, c, t, g, unknown, or other
  misc_feature (823)..(823): n is a, c, t, g, unknown, or other
ctggagctccccgcggtggcggccgctctagaactagtggatcccccgggctgcaggaattcgtctcacccctagaaaaatagaaaaaagtctggggataataatccatactccacaagcagccatggcgccacccatcacgtccctgtcgtctctgatggcgtccagcccaatcccgacgccgccgccgctcccgaagaccagcggaagagcgctctccgtcgcgccctgcggctccgcgtcgtcctcggcgccgtccacttcctcgactcctcatccggtggcggcgtctgcgtcgagcgggcaggagggggctgctggcgctgggcgccgggttcctggcctcagccgcgctgctgtccccggcgggcgacgccggcgccacgcgcatcgagtactacccgacggtcggggacaagatgtgcgacctgagcctcgtcaagtccggcctcgcgtactgcgacgacgaggtcggcaccggtgtccagcccccgcgcggcgagctcatcaatgtgcactacaccgcgagatttcccgacggtacgctgttcgacagcagctacaagcgcgggaggccactgacgatgcgcataggcgcatgcaatatcctccgagggcttgcacaggggatcagtcggccgcggcggagagccgcccatgcttgttggtggacagcgcaagctgatgatacctgcgctcactggcgtacgagcactgaacgcgcaggctgcttctcacgagactgcaacatacctgacactccacacttctatatcacattatccgtcatcgggatctacagctgagctctcgnatgacaggnaatggtcagaacctacgagctgataccaagacgaattccctgggctgtgcaaagcacc

SEQ ID NO: 78904 - protein, 128 aa, Zea mays
  misc_feature: Ceres CLONE 1563896
  misc_feature (19)..(122): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MCDLSLVKSGLAYCDDEVGTGVQPPRGELINVHYTARFPDGTLFDSSYKRGRPLTMRIGACNILRGLAQGISRPRRRAAHACWWTAQADDTCAHWRTSTERAGCFSRDCNIPDTPHFYITLSVIGIYS

SEQ ID NO: 78905 - DNA, 863 bp, Zea mays
  misc_feature: Ceres CLONE 1563897
  misc_feature: Encodes the peptide sequence at SEQ ID NO. 78906
  misc_feature (716)..(716): n is a, c, t, g, unknown, or other
  misc_feature (731)..(731): n is a, c, t, g, unknown, or other
  misc_feature (733)..(733): n is a, c, t, g, unknown, or other
  misc_feature (734)..(734): n is a, c, t, g, unknown, or other
  misc_feature (740)..(740): n is a, c, t, g, unknown, or other
  misc_feature (843)..(843): n is a, c, t, g, unknown, or other
ctccccgcggtggcggccgctctagaactagtggatcccccgggctgcaggaattcgtctcacccctagaaaaacagacagactaactgagcacccgctgcaaggagtccgcgcccatggcgagcaccaacatggcgtcggccacctcgcggttcatgctggccgcgggcgtgcccaccggcagcagcggcggccgcgtcaacttcgcctcggcgcccaaccggcttggcaggaggctcgtggcccgggccgacaacgaggccgccgcagctgaggcggcggaaggggagggtgccgtggccaccaagcccaaggccgagaagccgccgccgatcgggcccaagaggggcgccaaggtgaagatccttaggagggagtcctactggtacaacgggatcggcaacgtcgtcaccgtcgatcaggatcccaacacccgctacccggtggttgtgcggttcaacaaggtgaactacgccggcgtgtccaccaacaactacgccttggacgaggtctcagaggtgaaatgagtggggccggccggctcaagggctccgcgctagctaccgtgtgattgatttgtagtagttgtgaaatgaggctgtgaagctgcatgctgtgctggctagcgtacaacatcgatcctatgtgtaatagcataatcacataatcatatcatgtaattgggctgctttatcaccgtgtactcaatatctctnctgctctctaaaatngnntgatgntataatgggggtttgtacatgcacataaatcgctctctgccacaaaaaaaaaaaaaaaacaatctgctcggcaagtcgagctctctgcatccctcgggggccnagggcgtcccccagatcacc

SEQ ID NO: 78906 - protein, 136 aa, Zea mays
  misc_feature: Ceres CLONE 1563897
  misc_feature (75)..(136): Pfam Name: PSI_PsaE Pfam Description: Photosystem I reaction centre subunit IV / PsaE
MASTNMASATSRFMLAAGVPTGSSGGRVNFASAPNRLGRRLVARADNEAAAAEAAEGEGAVATKPKAEKPPPIGPKRGAKVKILRRESYWYNGIGNVVTVDQDPNTRYPVVVRFNKVNYAGVSTNNYALDEVSEVK

SEQ ID NO: 78907 - DNA, 960 bp, Zea mays
  misc_feature: Ceres CLONE 1563899
  misc_feature: Encodes the peptide sequence at SEQ ID NO. 78908
  misc_feature (763)..(763): n is a, c, t, g, unknown, or other
  misc_feature (827)..(827): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (946)..(946): n is a, c, t, g, unknown, or other
ctccccgcggtggcggccgctctagaactagtggatcccccgggctgcaggaattcgtctcacccctagaaaaagatgttggacatttgaaaagaattgtgaaatcaaaatatccatatgttgagagcaatcttgagctaattgcttacactgtctggaatgcacttgagtattcttatgccttcgaaggaatagctgagcaactaaagaaggaacggctggaacaggtggcactgaaaagtggtcagaccagtgatgaagtgactcctttggatgctgacattgataggagtaattttgattcatctgatcagtctgcaaatgtcaatgttgcttctggtagtagggctggttttatgagtgaagcagctttgatcagcagcatccacctagaggacaaaactcaaaccatgtcctcagttaagacctctcagaccttgctaggccagatcagaccagtgaataaggatgtcctgagcaataatatacatcagcaggctattcaggacctaagtctcactttaaaagctctaaaaggaaacttggcatctggaggagagtcaaatgagcaggctgggatcaacgtggagaactttagatcttctgtatttccttcccggcagttgtctggtgaggtaaaaccatttttatcaaatcctgggatgcaccagtgagaatgtttggatttcaacaactcagacaaacgagacaatgaagctgtgcaacacaacttactacagacagcttccaggacatagcactngagtcataaaccaagaagtacaggaagtttccagaagtcggtgagacgtcaatcttttccaccntcnnnagtacagaaatgagattcataccagtagccgtcctgatgtatgcagaaaggagaaaaagatgacccctgtcattgatccttggtgtgctagtgcacatattgactgtagagacnaagaactggggctg

SEQ ID NO: 78908 - protein, 223 aa, Zea mays
  misc_feature: Ceres CLONE 1563899
PRGGGRSRTSGSPGLQEFVSPLEKDVGHLKRIVKSKYPYVESNLELIAYTVWNALEYSYAFEGIAEQLKKERLEQVALKSGQTSDEVTPLDADIDRSNFDSSDQSANVNVASGSRAGFMSEAALISSIHLEDKTQTMSSVKTSQTLLGQIRPVNKDVLSNNIHQQAIQDLSLTLKALKGNLASGGESNEQAGINVENFRSSVFPSRQLSGEVKPFLSNPGMHQ

SEQ ID NO: 78909 - DNA, 1024 bp, Zea mays
  misc_feature: Ceres CLONE 1563900
  misc_feature: Encodes the peptide sequence at SEQ ID NO. 78910
ggagctccccgcggtggcggccgctctagaactagtggatcccccgggctgcaggaattcgtctcacccctagaaaaaacatccaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgtcgccgcctctgcccccgccgccgccgccgcacgccctccacgttatctaccgagtctgattattgggctcattttttctcaaggggtttcagcctactgcccgtccattgggcgcccacccactagccctgcgcttggaggcagctagtagtagataacggtagggtggaccagtgatcccccggggtgttttcccgcctttcccttttggccgggtggattttcaatgggcaaaaccaccacggggcccgtaaaaggaacaatttagttcccgcccttttaaagcccccccctttggggggaaaaaaatttttggaaaaacccgggaccccggggaaaaaaaatctttcccttttgtaaaaaaaaaaaaaaacttttaaccatcttttttttttctccccccgcccccccccccccccccttgtcccggaaggaaaaaaggagggaccctaggggcccccccccccccgtggggtgcccccccacccgttttggaacccccggccccctttaaaaaataaggggccctgggggtcccccctttttttgtccggggtgtttcgcgtaaaccccccacggggtcttaatatgaaaaaaaacgggcgccctcttttgttcctagagagagatgtttctcccccccaacaccccaagggagatatggtgtttctccaaaaaccactctagaaaaaaccccctctggcgccgctgttggaa

SEQ ID NO: 78910 - protein, 65 aa, Zea mays
  misc_feature: Ceres CLONE 1563900
MILVAIVAELLEEYTALVARVLEQLLNDAPFPRRMRFLMLRSLPFVSPPLPPPPPPHALHVIYRV

SEQ ID NO: 78911 - DNA, 937 bp, Zea mays
  misc_feature: Ceres CLONE 1563903
  misc_feature: Translation starting site: 207
  misc_feature (937)..(937): n is a, c, t, g, unknown, or other
ccgctctagaactagtggatcccccgggctgcaggaattcgtctcacccctagaaaaagaaattttccgtttgcacctaccgagaggtgacgacgagtgaggagtctgtgtgaccagtgctcgccgtcgtcccctgcctctggccctctgctagccgctaggcgacgggcctttcgccgggcgacgggcacaccgcccctgttaccatggcagcgatgaatactggtatgggaggtttaggtggcaggccgatacattcacaagcaaatccttttggaactgccttgcagggtgctggaccaggattgatccgtactgggctagaaacatatggcggaaggattttagattcaagttctgagtttatgcagagcacccccaacacaatatttgtccgaccctcagtactactttcaagtcaacagccagtatgtgaggaacaaactgaaggtcatcttgttccctttcttgcacaggggtcactggacaagaataactgaaccagtaggaggaaggctgtcctacaaacctccagtccaggatatcaatgcaccggacttgtacatccctttgatggcatttggcacccacattgtacctgctgggtatgccttgggtgtttctggaaggtttacccctggagcactgaccctacagttttcctaaaggaaacttggggtgggttcttcaaatccaccccaataaagggcctgctgttccccccggggaagcggggaaactcccttgcctgaaacttcttggcgtaagctgggataggtttccctggggccttcccttgtaagggggggccccaaccttctggaagttcctggtattatttccttcttccatggttcttgcctctggcagggaaacctcccttgtggaataccctaaaaagggttctctcgtggcgtggccagtgcctctccaaaan

SEQ ID NO: 78912 - DNA, 975 bp, Zea mays
  misc_feature: Ceres CLONE 1563905
  misc_feature: Encodes the peptide sequence at SEQ ID NO. 78913
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (105)..(105): n is a, c, t, g, unknown, or other
  misc_feature (150)..(150): n is a, c, t, g, unknown, or other
  misc_feature (151)..(151): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (792)..(792): n is a, c, t, g, unknown, or other
  misc_feature (793)..(793): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactggaagctccccncggtggcggccgctctagaacagtggatccccctgggctgcaggnnaattcgtctcacccctagaaaaactcccaaagccatcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggaccctgctctgaattggcaagggaccctaacggcaccgaactgaaaatggaaaaaccttccagggttcaaaccacctttggatgggaacccaaaaattaaatgggggaaagggtgccaaaccaaaaaccttgggggggcaaaaagggaaattttcgggggcggggggtgtccatttaaacccttggtttttttggcaaaaaaaccctggggggggggtttttccctttttaaaaaaagggggaaaacccccccttttttaaaaccccccccccccattttttttggcccaaacacctatatattggggggggaaaaaaacaaccccccccctttnnnggnnaggtttttccccgtggtccccccccggggtttattaaaagggggggccccacaaaagcgggggggggtgccccccccgccgggggggagaaaaaaaaaacatttttttttttattttgggggggggaaagttttattaaaaaacccccccccccccccccggtggggggggcccgcgccccc

SEQ ID NO: 78913 - protein, 108 aa, Zea mays
  misc_feature: Ceres CLONE 1563905
  misc_feature (4)..(109): Pfam Name: Enolase_N Pfam Description: Enolase, N-terminal domain
  misc_feature: SWISSPROT Homolog: EC 4.2.1.11 Phosphopyruvate hydratase
MAATIQSVKARQIFDSRGNPTVEVDVFCSDGTFARAAVPSGASTGVYEALELRDGGSDYLGKGVSKAVNNVNSVIGPCSELARDPNGTELKMEKPSRVQTTFGWEPKN

SEQ ID NO: 78914 - DNA, 874 bp, Zea mays
  misc_feature: Ceres CLONE 1563906
  misc_feature: Encodes the peptide sequence at SEQ ID NO. 78915
  misc_feature (645)..(645): n is a, c, t, g, unknown, or other
acccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcnaggggtaccgcgtcgccggcgcccgctcggagagtcgtcgaaccgctctaccccggcgggagcttcaacccgctcggcctcgccgacaaccctgtaggccttcgcggacctcaagtgaaggagctcaaaaacgccccctcgcctgttccccatgttggggttctttgtcaaggcatcttcaccggaaagggcccgcttaaaaactcccgaacaccctgccgaaccggta

SEQ ID NO: 78915 - protein, 237 aa, Zea mays
  misc_feature: Ceres CLONE 1563906
  misc_feature (64)..(220): Pfam Name: Chloroa_b-bind Pfam Description: Chlorophyll A-B binding protein
  misc_feature (172)..(172): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIXGYRVAGARSESRRTALPRRELQPARPRRQPCRPSRTSSEGAQKRPLACSPCWGSLSRHLHRKGPA

SEQ ID NO: 78916 - DNA, 865 bp, Zea mays
  misc_feature: Ceres CLONE 1563909
  misc_feature: Encodes the peptide sequence at SEQ ID NO. 78917
  misc_feature (739)..(739): n is a, c, t, g, unknown, or other
  misc_feature (754)..(754): n is a, c, t, g, unknown, or other
ctggagctccccgcggtggcggccgctctagaactagtggatcccccgggctgcaggaattcgtctcacccctagaaaaacgttgcgaaatggggacgctctgtttatgtcaacatccaaaagtttgtgcagttccagctgactgttaatgttgtcgcacttctggttaacttctcttcagcgtgctttacaggagatgctccactgaccgctgttcaacttctttgggttaacatgatcatggataccctaggagcgcttgctcttgcaactgaaccacctgatgacaacttaatgaagaaatcaccagtcggaaggacagggaggttcatcacgaacgtgatgtggaggaatattgtggggcagtcaatattccagtttgtggtcatttggtatctacaaacacaaggggaatacttgtttgggcttgaaagctctgaagctaatactgttctaaatacaatcatattcaacactttcgtattctgccaggttttcaatgagataagctcgagagacatggaggagatcaatgttttgaagggtttgccacagaactccattttcatgagcatcctcggtggcaccatcattttccagttcatcctggtccagttcctaggagattttgccaacaccacgcctctcacccatctccaatggctcgtcagcattctctttggcctcctcgggatgcccattgctgctgcccatcaaactgattcctgtggaaacctcncgaagatgatggccnggataccataatcatgtacattaagagcaatagatcagctttcccagctgctaaatactgtaaactttacctaatccacaagaataggagccgagcacccatttggtgaag

SEQ ID NO: 78917 - protein, 176 aa, Zea mays
  misc_feature: Ceres CLONE 1563909
  misc_feature (23)..(167): Pfam Name: Cation_ATPase_C Pfam Description: Cation transporting ATPase, C-terminus
  misc_feature: SWISSPROT Homolog: EC 3.6.3.8 Calcium-transporting ATPase
  misc_feature (169)..(169): Xaa is any aa, unknown, or other
  misc_feature (174)..(174): Xaa is any aa, unknown, or other
MIMDTLGALALATEPPDDNLMKKSPVGRTGRFITNVMWRNIVGQSIFQFVVIWYLQTQGEYLFGLESSEANTVLNTIIFNTFVFCQVFNEISSRDMEEINVLKGLPQNSIFMSILGGTIIFQFILVQFLGDFANTTPLTHLQWLVSILFGLLGMPIAAAHQTDSCGNLXKMMAXIP

SEQ ID NO: 78918 - DNA, 957 bp, Zea mays
  misc_feature: Ceres CLONE 1563910
  misc_feature: Encodes the peptide sequence at SEQ ID NO. 78919
  misc_feature (643)..(643): n is a, c, t, g, unknown, or other
  misc_feature (751)..(751): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
acccgcggtggcggccgctctagaactagtggatcccccgggctgcaggaattcgtctcacccctagaaaaaaacactccacagcgcccgcgcaggctcgctgcaagcgcaaagcagccacagcaccccctgcacctgcagactgcaaccgcaatgtcggctctcgggacgctctccggcggcgctgccggtgtctccggactcctccgcctccgccgccgggccgccccagcccccgcgattcgcgcgccgtcgcacctccccgctggggacgtcaagtgcgcggccgccgtgcccgatgccgcccccatcttctggggccgttagtttcgccccggggtcctcccacccccgtttttgtttccctttttttattccccccagaagaaaaccctgtattcccccccccccaaccccccaaatcccccagggaaaggccaaagcctggggggtttcccgggaaaaaaaacccggccctggttaaccgggtttcttccttttttcaagggggggaacttccccccaacgtttatttaaaaaatcccccaaaaaagaaaaaattctcaaatttcttttccccataaccccaaaacctttttgtggcccttgatacccccctccacataaaagggggggggggggnggcaaaaagccccccccccatacaagggggggggggggggggggggggccccccccacacagagggccccccacttggggggcgcccccccaaaaatttttttttttnttaaaacaccccacccnnnnnnnnggttgttgttcaccccccctcaacagtggggccctccgcccgcggggggggggccctcttttttcccccaataataaatgcgggagcctcttttccgccgggggggatatttttttttttgggaaaaaaatcccccccccgcggggtttcttcccccccctgggattttttttttttttaca

SEQ ID NO: 78919 - protein, 57 aa, Zea mays
  misc_feature: Ceres CLONE 1563910
MSALGTLSGGAAGVSGLLRLRRRAAPAPAIRAPSHLPAGDVKCAAAVPDAAPIFWGR

SEQ ID NO: 78920 - DNA, 863 bp, Zea mays
  misc_feature: Ceres CLONE 1563911
  misc_feature: Encodes the peptide sequence at SEQ ID NO. 78921
  misc_feature (750)..(750): n is a, c, t, g, unknown, or other
  misc_feature (767)..(767): n is a, c, t, g, unknown, or other
  misc_feature (768)..(768): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (790)..(790): n is a, c, t, g, unknown, or other
  misc_feature (825)..(825): n is a, c, t, g, unknown, or other
ctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagccccggggcagcgactagaccgcgcccgccggccgccccccgccggctagctatagctcctgcgtgagctagtagctagctagtggcatgcgtcgtctctgtcgttcggttttgcttcngggtcaccgtacccttnngcttgctggnnnttctcttccntttttccttttttttttctttcccccggccatggntcctttgctttccagtttcctctgcgggatgggaagat

SEQ ID NO: 78921 - protein, 170 aa, Zea mays
  misc_feature: Ceres CLONE 1563911
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPRGSD

SEQ ID NO: 78922 - DNA, 1024 bp, Zea mays
  misc_feature: Ceres CLONE 1563914
  misc_feature: Encodes the peptide sequence at SEQ ID NO. 78923
  misc_feature (49)..(49): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (62)..(62): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
ttttcgttttttcgttctgtttcccacgcccccgcgcattctgctaaantttnnnnnntatntttnnnttttatctggagctccccgcggtggcggccgctctagaactagtggatcccccgggctgcaggaattcgtctcacccctagaaaaaaatctcccggcctgaggattcgattattctgttcgctctcgcccaagtcatcgtctggtcgtcgcccgcagaggcgcagacgcccaaaaccggaaggggcgccatggccgcgtcggatctggagagcaaggccaaggaggccttcgtcgacgacgacttcgagctggccaccgagctctacagccaggccatcgacgccgggcccgccaccgccgacctctatgccgaccgcgcccaggcgcacatcaagctcggcaactacactgaggctgtggcggatgctaacaaagcaattgagcttgatcctatgatgcataaaccttactaccggaaaggtgctgcatgcattaagcttgaagaataccaaactgcaaaggctgctcttgagttgggttcttcttatgcatcaggcgattcaaggtttgctcgtctattgaaggaatgtgatgagcgcatcgctgaggaatctagccaggcaccagtaaagaatgttgaggctactgtggctgctactattgaggacaaggaggatttcacaaatatggagaatacaccaccagtgatagaacccccaagcaaaccaaaatacaggcatgactactacaacagtgccacagaagtggtactgacaatatttggctaaggtgttcctgctgatagtgtagtcattgatttgggtgaacagatgttgagtgtatccattgaaggtcctggggaaggaacataccattttcagccccgtctgtgttctaaattttcccctgaaaatggaaatatcaagtcttatccaccaaggtcaaaaatcccctgccaaaagctgagcaggtgacatggacaaccccggaatttatggggaaaaaccaagaccga

SEQ ID NO: 78923 - protein, 179 aa, Zea mays
  misc_feature: Ceres CLONE 1563914
  misc_feature (37)..(70): Pfam Name: TPR_2 Pfam Description: Tetratricopeptide repeat
  misc_feature: SWISSPROT Homolog: EC 3.1.3.16 Phosphoprotein phosphatase
MAASDLESKAKEAFVDDDFELATELYSQAIDAGPATADLYADRAQAHIKLGNYTEAVADANKAIELDPMMHKPYYRKGAACIKLEEYQTAKAALELGSSYASGDSRFARLLKECDERIAEESSQAPVKNVEATVAATIEDKEDFTNMENTPPVIEPPSKPKYRHDYYNSATEVVLTIFG

SEQ ID NO: 78924 - DNA, 886 bp, Zea mays
  misc_feature: Ceres CLONE 1563917
  misc_feature: Encodes the peptide sequence at SEQ ID NO. 78925
  misc_feature (664)..(664): n is a, c, t, g, unknown, or other
ctccccgcggtggcggccgctctagaactagtggatcccccgggctgcaggaattcgtctcacccctagaaaaacgcctggtgttcttgtatatcacgcgtccacgccactgctaagctgctccccgttcgccaggtcggcgaccaggcgaaacgtgctgctgctgccgctgcaagaagaagaataggtacacagacagcatgtccggagttcaggcgatgccgacggccgtgggcgtcgcggggctgagagggtcagggttggttagcagcagcagtaccagcttgttcgccggcgactgcaagaggaaggctcgccgcccgtcgtactcggcctgggccctcaggcagagccggatcggcagcaggagcaggatcaggagcaagaggggcctcggcatcgtctgcaacctcgcgggacagtacgaggattccttcgacgacgtccagcggcaactgatgaactacttcacgtacaaggccgtgaggaccgtgctgacccagctctacgagctgaacccgccgagctaccgctggttctacaacttcgtcgctgtcaacaagcctaccgacgcaagcatttccctcgtgctctcggcaaggaaagcaggagctcgcaaagcgagtgatggtcacaggcttcccctgtacggaaaatggataanaaatgcgacatgcccaaacgtccgaaaaaatccccaacaaaaacctgcccttatcccggaccggcttaaggaaaaggttatttgggccaaccaaaaaaaaccccggaaaaaaacggggtatcccatatccccccaagggcccaaccctttgggggggggagaaaataaaaccccctttaaaaggaaaaacaacccgggggtttttttaaaaaacccccaaaa

SEQ ID NO: 78925 - protein, 228 aa, Zea mays
  misc_feature: Ceres CLONE 1563917
  misc_feature (155)..(155): Xaa is any aa, unknown, or other
MSGVQAMPTAVGVAGLRGSGLVSSSSTSLFAGDCKRKARRPSYSAWALRQSRIGSRSRIRSKRGLGIVCNLAGQYEDSFDDVQRQLMNYFTYKAVRTVLTQLYELNPPSYRWFYNFVAVNKPTDASISLVLSARKAGARKASDGHRLPLYGKWIXNATCPNVRKNPQQKPALIPDRLKEKVIWANQKKPRKKTGYPISPQGPNPLGGGENKTPFKRKNNPGVFLKNPQ

SEQ ID NO: 78926 - DNA, 763 bp, Zea mays
  misc_feature: Ceres CLONE 1563918
  misc_feature: Translation starting site: 146
  misc_feature (552)..(552): n is a, c, t, g, unknown, or other
  misc_feature (582)..(582): n is a, c, t, g, unknown, or other
  misc_feature (594)..(594): n is a, c, t, g, unknown, or other
  misc_feature (595)..(595): n is a, c, t, g, unknown, or other
agctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacattcgccaagaaccgggagctggaggtgatccactcccgctgggccatgctgggcgcgctcggctgcgtctttccggagctgctcgcccgcaacggcgtcaagtcggcgaaggcgtgtggttcaggccggctccnagatcttcagcgagggtggactggactacntcgggaaaccgnnagctcatcacgcgcagagcatcctcggcatctgggccttgccaggtcgtgctcaatggggcgccgttcaagggctaaccgcatcgccgggggcccgctttggggaagggtcgttcaaccccgttttaatcccgggggggaggtttttaaacccgttttggcccttccc

SEQ ID NO: 78927 - DNA, 997 bp, Zea mays
  misc_feature: Ceres CLONE 1563919
  misc_feature: Encodes the peptide sequence at SEQ ID NO. 78928
ctggagctccccgcggtggcggccgctctagaactagtggatcccccgggctgcaggaattcgtctcacccctagaaaaaaggcgagaaccgcctccccctccgctccttccagctcgctctgtaatctgcatcagcctcgcccgccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaaaagactaaacataaaggcactgagggtattattcagattgaaaatcccaaacttggtgaaagccaagaatataaaagcccagggaagttgattttggcaaagacaactgaactctcaagggcgtgaaaggaaaggagcttgaaaaaccaaaaagctcatggaacgttttatggaagctcccggagccagggaaaaacagaaccagccccgaaaaagaattggaaccgtcttgcttttaataaaaaaaccaaaaggctgaatccggcgaaaaaaaccccaaaaagaaaaaaacctgcccaaggaacccaaggaaatccccaaacccccgaaattaacggccaaaagtccgggggaccaaaagtccccccaaaaggccaaaaaggccccatcccgcccccaaattggaaattttgttttttaaaggacccaccttcccctttttaaaaacaccggcccccttttttgttctcccacaaaaaaaagggtgtggaaggtgtgacccaacctccccggggcggggggtttctcccggaaacctgggctgtgccaaaaccgagaaaaggggaaaaaacccccccccccaaaaaaaaaaaaaaaaaaaaaaagactcgggggcgcccctcttcccccaattaggaggtatatcccccccccccct

SEQ ID NO: 78928 - protein, 101 aa, Zea mays
  misc_feature: Ceres CLONE 1563919
MGRGKFKGKPTGRRNFSTPEEIAAGTSGRPRTFKKKEEEEDEEEVEREESEEESEEDSDEKTKHKGTEGIIQIENPKLGESQEYKSPGKLILAKTTELSRA

SEQ ID NO: 78929 - DNA, 878 bp, Zea mays
  misc_feature: Ceres CLONE 1563920
  misc_feature: Encodes the peptide sequence at SEQ ID NO. 78930
  misc_feature (559)..(559): n is a, c, t, g, unknown, or other
  misc_feature (563)..(563): n is a, c, t, g, unknown, or other
  misc_feature (603)..(603): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
ggagctccccgcggtggcggccgctctagaatagtggatcccccgggctgcaggaattcgtctcacccctagaaaaattcaggctccggagtccggacggagtcgcgggccgtggccctgcctcagtatttcctcttccccgcgataggcaacagaaaccgcagcataacaaggaaagcgaagcgaaccctcgccgcgcgagttagcgatggccggagaggacgccgccgccgcgaggaggcccccgaaggaggaggaggaggaggaagatgacgacgatttggacaacgttccgctggcactttccagggccaagaaaccgggtaatgcgagcgcctccaaggtcaagaaggaggaggaggacgatgacgacgacttggacaacgttccgctcgcactttccagggctaagaagggaaacgagaagcagaaaggcaacaatagcaatatgaaggcttcttcgaaagtcaagaaagaagtcagttctgatgatgattttgtcatgccaacggcgcagaagaaaagtgcaggtgctgctggaagtaatgccagacatccnaggntaaaaaaattaaagatgaagatttggaagatctcaagganggacagaaaggaagaaacgagtgggtgtcaagaaaagaggcaagtggccttggccattgtaaggggagagaaggtaagaaagagaggaaatgtgatggtttgccgggcagaagcatgatcctcttgagaaagggatcatttgagatattctatgaatcactctatgaacaggtccccaccagtgacatggctgcaacctggtgaaagggatggggtttgccttcccgtggatgttggctagaaaacggggnnnnnnnnnnnnnnnnnnnnnnnnn

SEQ ID NO: 78930 - protein, 170 aa, Zea mays
  misc_feature: Ceres CLONE 1563920
  misc_feature (119)..(119): Xaa is any aa, unknown, or other
  misc_feature (132)..(132): Xaa is any aa, unknown, or other
MAGEDAAAARRPPKEEEEEEDDDDLDNVPLALSRAKKPGNASASKVKKEEEDDDDDLDNVPLALSRAKKGNEKQKGNNSNMKASSKVKKEVSSDDDFVMPTAQKKSAGAAGSNARHPRXKKLKMKIWKISRXDRKEETSGCQEKRQVALAIVRGEKVRKRGNVMVCRAEA

SEQ ID NO: 78931 - DNA, 919 bp, Zea mays
  misc_feature: Ceres CLONE 1563921
  misc_feature: Pfam Name: PG_binding_1 Pfam Description: Putative peptidoglycan binding domain
  misc_feature: Pfam Name: Peptidase_M10 Pfam Description: Matrixin
  misc_feature (269)..(269): n is a, c, t, g, unknown, or other
  misc_feature (487)..(487): n is a, c, t, g, unknown, or other
  misc_feature (535)..(535): n is a, c, t, g, unknown, or other
ctccccgcggtggcggccgctctagaactagtggatcccccgggctgcaggaattcgtctcacccctagaaaaagtgttctctgcgcggtcggcccggcgaacttcctctggttcctgatgatggatgtatcgcaagttgccgcagccgtggcgctgatggcgttcgcggtcgcgtttccggcgtcggccttcccgtccggcttcccgcctgggacaccatcagcgttcccgaatccgtgggcggcattccagaacctgtctggctgtncacatgggggaggagcggcagggcctggccgggctcaaggactacctcagccacttcggctacctcccgccggcgccgccgtcgtcccccttcagcgacgcgttcgaccagaacctgtaggcggccatcgcgacgtaccagcgcaacttctgtctcaacgccaccggcgctctggacccgtccaccgtctcgcagatggtcgcgcctccgctgcggcngtggccgacgtcatcaaacggcacgtccaccatgggcgaggagctccntccgccgacgcccatcgccacgggaggcacctgtacgcctacttccccggctggccgacgtggccgcccgtccccgcgggactcaagtacgcgatcaccgcgacctcggtcgcgtccatcgaccggtcacgcctgagcgacgtcttcgcgcgcgccttctcccggtgggcgccgcacccacctgcgttcgcggagaacgcgtcggattcgacgcgaactcacatcggcttctactcgggctccacgcgaacgctacccttcgacgggccctggggacctgggcaggctttcgccaagggacgccggtccactggaccccccgaggctgggtgcccggaacaactttcacctctcggggaccgggcgggaccttatgcggggcgg

SEQ ID NO: 78932 - DNA, 859 bp, Zea mays
  misc_feature: Ceres CLONE 1563922
  misc_feature: Encodes the peptide sequence at SEQ ID NO. 78933
  misc_feature (718)..(718): n is a, c, t, g, unknown, or other
  misc_feature (719)..(719): n is a, c, t, g, unknown, or other
ctggagctccaccgcggtggcggctcgctctagaactagtggatcccccgggctgcaggaattcgtctcacccctagaaaaagaaaaagagaaaaaaaaacgtgctgtcttcccgtctcttcccaatgcggcgtctcgctctcctcttcctcctgcctctcctcctcgccaccggcgtcaccacggcgtcagcggagcccgcgacccctcccgcctctcctcctcctcctccaccaccaccaccaacgcccccaaagatgctgctgatgaagaagatgctgccgatggtcatcatctacactggcaccatcaccggcttcgtcatcgggcacagcagcggcatcgacgtcaacgacggcgggcgacgacgacgacaactacttcgactacttctacttcacccccacgggggtgaagaagggacaacaacatcttcaaaggtccaacctcggaattgggcaggcttcttccacaaccttgaaaaacaaacaacctccaccaataaagaatttggctcccccccccccccccaaaaaaaaatttccggggccttggtggaagggagaaggcaaaaacccctcagcggggaagaaaattttaatttttaaaatctttcggaaaatttaaagaggggggggggggccacgcccccccccccccctcgggggttcaacaaaaaaaagaaaaaatgggggcctttgtttctttttttgggggnnaaaaagggggggaaaaaaaaaacccgccattatgttttgggtgggcggggggggcaaaaaccttttttctctccttttaaggggggggggggcaaaaaagagggattttttttttaaaccccccccaaaaagagagtctt

SEQ ID NO: 78933 - protein, 160 aa, Zea mays
  misc_feature: Ceres CLONE 1563922
MRRLALLFLLPLLLATGVTTASAEPATPPASPPPPPPPPPTPPKMLLMKKMLPMVIIYTGTITGFVIGHSSGIDVNDGGRRRRQLLRLLLLHPHGGEEGTTTSSKVQPRNWAGFFHNLEKQTTSTNKEFGSPPPPQKKISGALVEGRRQKPLSGEENFNF

SEQ ID NO: 78934 - DNA, 892 bp, Zea mays
  misc_feature: Ceres CLONE 1563924
  misc_feature: Encodes the peptide sequence at SEQ ID NO. 78935
  misc_feature (418)..(418): n is a, c, t, g, unknown, or other
  misc_feature (439)..(439): n is a, c, t, g, unknown, or other
  misc_feature (514)..(514): n is a, c, t, g, unknown, or other
  misc_feature (771)..(771): n is a, c, t, g, unknown, or other
  misc_feature (772)..(772): n is a, c, t, g, unknown, or other
ctggagctccccgcggtggcggccgctctagaactagtggatcccccgggctgcaggaattcgtctcacccctagaaaaagaaagataagaaaggcggtggtcaacttgtgtcctgaggtgcccgtagaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcaggacaagaagatttacatagactgcgtccgttgagctatcgtggtgctgatngttttctgctcgccttttctnctatcagcaaagcaagctatgagaatgtctctaagaaagtgggttcctgaaataaggcactatgcctcctggcgntgcccataaatctttggtggggacaaaactttgatcttgcttggatgataaagcagttttttggtgaatcacccctggggggctgttcccaatttcccccttccccagggcgcaaaagactaaagaaaacctaattgggggccgtccccccccaccttccaaatggcggtttcaaaaaccccccccaaaaaacttaaaaaagggggtggttggacccccccaaattaaaaggggggggttccccccgcccccccccnnggcccaaaaaaaagaggggaaaaaaaaaggggtgggcaaaaagggggaactcccccctctttttgtgtaccccccaaagcccgggggagagggggcgaaacctcttctcgcgccgcgggg

SEQ ID NO: 78935 - protein, 102 aa, Zea mays
  misc_feature: Ceres CLONE 1563924
  misc_feature (8)..(101): Pfam Name: Ras Pfam Description: Ras family
  misc_feature (80)..(80): Xaa is any aa, unknown, or other
  misc_feature (87)..(87): Xaa is any aa, unknown, or other
MSASRFIKCVTVGDGAVGKTCMLISYTSNTFPTDYVPTVFDNFSANVVVDGSTVNLGLWDTAGQEDLHRLRPLSYRGADXFLLAFSXISKASYENVSKKVGS

SEQ ID NO: 78936 - DNA, 999 bp, Zea mays
  misc_feature: Ceres CLONE 1563925
  misc_feature: Translation starting site: 126
  misc_feature (454)..(454): n is a, c, t, g, unknown, or other
acccgcggtggcggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatggggctgtgggacggtcggaggtgccggagtacctcacccggagaggtccctggagactatggctacgaaaccttttggctgggcaagaaagcagaagacntccgccaagtaccaggccctacgagctgatcccatgccagaatgggccatgctccggtgccgcttgggcctgtcatcccagaagcctgcaaaaagtttcggggcctactgggggccctgaagggttcttgggtttaaaaaacgggggccctttgtccctgggaagggaaaaccccctaaaataattttggggaaaaaaattcccccataaaaccgggggggggggcccctgaaaccccggggggtctactcccgttgggggggggcccaaatttttctcggggacccccccgggggtggggccctgggagaaaaaggccccccccggggggggccttttaaccccggggggtgggggagaaaccccaaaaaggggcccccctctaggggagaaaaaaaaaaaaaaggcggggggggggggtttctcaaaggtgcctcttttttccgggctcttccgggggagagggcggggggaaacccccaaaacctccccccccctggtaaaaaagtgttttttttttgccggcgaaaaaaaaacctcttgag

SEQ ID NO: 78937 - DNA, 869 bp, Zea mays
  misc_feature: Ceres CLONE 1563927
  misc_feature: Encodes the peptide sequence at SEQ ID NO. 78938
  misc_feature (760)..(760): n is a, c, t, g, unknown, or other
  misc_feature (776)..(776): n is a, c, t, g, unknown, or other
ctccccgcggtggcggccgctctagaactagtggatcccccgggctgcaggaattcgtctcacccctagaaaaattttttcctagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccatccaggtcgtcgtcgacgcgatcatcaacagtggaccccgtgaggatgccacccgtattggttccgctggtgttgtgaggaggcaggccgtggatatctcacccctgaggagggtgaaccaggccatctacctcctcaccactggtgccagagagagtgctttccggaacatcaaaaccattgccgagtgccttgcagatgagctgatcaacgctgccaagggctcatccaacagttacgccatccagaagaaggacgagattgagcgtgttgccaaggccnaccgttgaactgagcntgtatcctggtgcactctgcgctggaaacttttatgtcgctggaagtcgtatccggtcttgttttaccaatgtttagagtttttgaaacctat

SEQ ID NO: 78938 - protein, 199 aa, Zea mays
  misc_feature: Ceres CLONE 1563927
  misc_feature (44)..(199): Pfam Name: Ribosomal_S7 Pfam Description: Ribosomal protein S7p/S5e
  misc_feature (198)..(198): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGVVRRQAVDISPLRRVNQAIYLLTTGARESAFRNIKTIAECLADELINAAKGSSNSYAIQKKDEIERVAKAXR

SEQ ID NO: 78939 - DNA, 868 bp, Zea mays
  misc_feature: Ceres CLONE 1563928
  misc_feature: Encodes the peptide sequence at SEQ ID NO. 78940
ctggagctccccgcggtggcggccgctctagaactagtggatcccccgggctgcaggaattcgtctcacccctagaaaaaagaagcttcgaggctgctgctgctgcgcccatgaccgcggaaggcaagacgccgtccctcgccgaggagtattcacttccaccacaggaagttccagtggaaaaggcagctgaggagaagccctctagtggtactgagtctgaagctgctccctcaaccaatgatgaaactcctccatctgtagaagacaagaatggaacttctgaagtacaagatgctgctgaaaatccagaggcagaagaaactaacactgctgcagaggaaacacctgctgtagaggaagcaagtgagactaccgaggaggaagaggctgagaaacctgagatcaagatcgaaacagctccagcagattttcgtttcccaacaacaaaccaaacaaggcattgtttcacacgctatgttgaatatcacaggtgtgtggctgcaaaaggtgaggatgcacctgagtgtgataagttcgccaagtactatcgatccctgtgcccaggttgatcgctggaacgagcaacgcgaaaacggcaccttccctggggactctgtatccctacatgcaaaagaagtatgaactcacgatgttgtgcccggctcttcttccttggtactgggcgccagttaaccttttttggagctctctacggaatagaaatccctttttggctggaagaatgccctgttgctcttccttacgggcatggtgggcgcttgctagaaactgccgtccagttaacaatttcctttatacgttccaaaaatggatcgggatcccccaaatttgcccgtggaccaac

SEQ ID NO: 78940 - protein, 153 aa, Zea mays
  misc_feature: Ceres CLONE 1563928
  misc_feature (99)..(154): Pfam Name: COX6B Pfam Description: Cytochrome oxidase c subunit VIb
  misc_feature: SWISSPROT Homolog: EC 1.9.3.1 Cytochrome-c oxidase
MTAEGKTPSLAEEYSLPPQEVPVEKAAEEKPSSGTESEAAPSTNDETPPSVEDKNGTSEVQDAAENPEAEETNTAAEETPAVEEASETTEEEEAEKPEIKIETAPADFRFPTTNQTRHCFTRYVEYHRCVAAKGEDAPECDKFAKYYRSLCPG

SEQ ID NO: 78941 - DNA, 875 bp, Zea mays
  misc_feature: Ceres CLONE 1563929
  misc_feature: Translation starting site: 151
  misc_feature (799)..(799): n is a, c, t, g, unknown, or other
acccgcggtggcggccgctctagaactagtggatcccccgggctgcaggaattcgtctcacccctagaaaaagtccctctccccagcctgcaccaattcctgaggcaccaaccaagcctctcttgttgactccgacgccgatcgacggccatggggacccaagcgccggagaaggagaactacccccctgaaaaggatgcgaggagcgcacgggagaaggccatcgacgagtggctcccgatcacctcgtcgcggaacgccaagtggtggtactccgccttccacaatgtcaccgccatggtgggcgccggcgtgctcagccttccctacgccttgtccgagctcggctggggccctggcatcgccgtgctggtggtgtcgtgggtgatcacgctgtacacgctgtggcagatggtggagatgcacgagatggtgcccgggaagcggttcgaccggtaccacgagctggggcagcacgcgttcggcgagaagctgggcctgtggatcgtggtgccgcagcagctggtcgtggaggtgggcgtgaacatcgtgtacatggtgaccggcggcaggtcgctgaagaagtccacgacgtgctggtgtgcggcgacggcggggcgtcgtgccaggggaaggacaacatcaagaccacctacttcatcatgatcttcgcctccgtccacttcgtcctctcccagctccccaactttcactccatctccggcgtgtcgctgggccgcgccgtcatgtcgctcagctactccaccatcgcgtggggcgcgtcggtggacaagggcangtatggcgggcttgaactacactgcgcgcgacacgacccccgggaaggtgttcggcttcttcgcgcgctgggcgaa

SEQ ID NO: 78942 - DNA, 828 bp, Zea mays
  misc_feature: Ceres CLONE 1563930
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (317)..(317): n is a, c, t, g, unknown, or other
  misc_feature (358)..(358): n is a, c, t, g, unknown, or other
  misc_feature (809)..(809): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctgggactcaccgcggtggcggccgctctagaactagtggatcccccgggctgcaggattcgtctcacccctagaaaaagtgcgccatcacacacaagacacaaccccactcacccggcagggaggccctcttcgtcggcggaggccatggtttccctcaangccgcagaagaggctcgccgcgggagtcctaaaatgtggcnaaggggaaaggttgtggcttgaccccaacgaggtctacgagatctcgatggctaactcgcgtcaagaacatttcgtaaagccgggggtgaaaggaatgaatttcataaattaaagaaggccacagaaaaatcccactccaaggtccccgggccaagaaggggcccatggaggccaaaccagaaagggggaggcacctctgggtttaccggaaacccccaggggtaacccagggggaaggcctagggcttcccccccccccaaaaaaatccccttttttggaaatcccccccaaggaaaaacccttttgtcccccctaaggggggttttttggctttgggcccaaaaaaaattttccttggggaaagccccccaaaaaaaaaaaaaatttcggccccaaaaaaaaccccccgtgttgtttccccccccccccccaaaaaaaagggggggttntaatgggggtaaaaaaaaa

SEQ ID NO: 78943 - DNA, 799 bp, Zea mays
  misc_feature: Ceres CLONE 1563932
  misc_feature: Encodes the peptide sequence at SEQ ID NO. 78944
  misc_feature (381)..(381): n is a, c, t, g, unknown, or other
  misc_feature (403)..(403): n is a, c, t, g, unknown, or other
  misc_feature (505)..(505): n is a, c, t, g, unknown, or other
ggagctccccgcggtggcggccgctctagaactagtggatcccccgggctgcaggaattcgtctcacccctagaaaaagcaagcctgtggacgccagtgagtgaacaccagccgtcttggcccgcttctcccctgctgcggccatggcgacctccgcggcgctctcgaccgccgccaaccccacccagctctgccggtcccgcgctgcgctgggcaagccagtgaaggggcttggcctggggatggggcgggagcgcgcaagccagcggagcatcacgtgccaggcggcgagcagcatccccgccgaccgcgtccccgacatggagaagcggaagctgatgaacctcctcctcctgggcgccatatcgctgcccaccgtcnggcatggtcgtcccctacggcngccttcttcgtccccgccggctccgggaacggcggcggcgggacctacgccaaggacaagctggggcacgacatcacgggtgggaggaagttgctccaacangcaccggttcccaacgaaccgacagcttcgcaaggggctcaagggtaacccccccctcccttggggggggaaaaaaggaaaaaaaacctggcccccccaggggaataacagcccggtgggcaccccccccgggtggttttttggccgggaaaaagccccccaaaaaaaaatattttcttcccccccccccccgggggggccccccaaaaaaaaaccacggggggggaaggggggggggttctaaaaaaaaaaaccccccccccttggggggggggggggtgggggttgtaccac

SEQ ID NO: 78944 - protein, 201 aa, Zea mays
  misc_feature: Ceres CLONE 1563932
  misc_feature (55)..(89): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
  misc_feature (80)..(80): Xaa is any aa, unknown, or other
  misc_feature (87)..(87): Xaa is any aa, unknown, or other
  misc_feature (121)..(121): Xaa is any aa, unknown, or other
MATSAALSTAANPTQLCRSRAALGKPVKGLGLGMGRERASQRSITCQAASSIPADRVPDMEKRKLMNLLLLGAISLPTVXHGRPLRXPSSSPPAPGTAAAGPTPRTSWGTTSRVGGSCSNXHRFPTNRQLRKGLKGNPPLPWGGKKGKKTWPPQGNNSPVGTPPGWFFGREKAPQKKIFSSPPPPGGPPKKKPRGGKGGGF

SEQ ID NO: 78945 - DNA, 957 bp, Zea mays
  misc_feature: Ceres CLONE 1563933
  misc_feature: Translation starting site: 197
ccccgcggtggcggccgctctagaactagtggatcccccgggctgcaggaattcgtctcacccctagaaaaatctgcaccgcgcgcaatcggccgctcatcccctcttcctatcgcccgccgccgccgccgccgccgcccgtccgcttcagtacgacgtcgagcaaggggaggtaaaagttcgtttggcgtgcgccatgtttaagaagttctcttcagaagatatatctggacagaatcaagttaaggcttctgtacaacgaaagattcggcaaagtatcgctgatgagtaccccagccttgaacctttgctagatgacttgctcccaaaaagtcacctatgattgtttgttaaatgccaaaatcatcttaatcttgtagtggtgaataatgttcctctattttcaatatacgtgatggtccttacatgccaaacctgcgtcttcttcatcagtatcctgatatcctggaaaaagtcccaggtggatagagggggcttcaaattttgttctttctggggcaaaaataatgggtccctggggtgacttcacctgggggggccctttaacaactaatccaaggaggaaaccacggggggctttattgggggaaaaaaaaaaccccccccgggatttggtatttcaaatattgccccaaaaaattttggggccccccccaagggaatgtgggttaaaatttgcccttttttatattgggcccttggaaaatagaaagccccccaaaaaaaaaaatccccgggggggttaaaattttgcggcaaaatttttgtgggggaattaaaccccgggcgccttttgttgcccggggtgggttcttaaaaaaaaaaaaataaaaaaatttttttcttcgggagaaatgtttgttttccccccctttggtggtggggggtgaaaaaaaaaattaatagagtgggtgggccggccttcccaatagtgtt

SEQ ID NO: 78946 - DNA, 775 bp, Zea mays
  misc_feature: Ceres CLONE 1563935
  misc_feature: Encodes the peptide sequence at SEQ ID NO. 78947
ctggagctccccgcggtggcggccgctctagaactagtggatcccccgggctgcaggaattcgtctcacccctagaaaaaagatccactcgtcacacatccgcgttaccccctctcccttggtttcctctcccaccaccaacccccatcccggttatctccgccgccgcccgctttgggaaggcgcgacgaaggcaggcgagaggctccagccggacgaggaggaaagaggagcagcagggccggaggagagatgttcctgtgggactggttctacggggtgctggcctccctcggcctgtggcagaaggaggcgaagatcctcttcctcggcctcgacaacgccggcaagaccacgctgctccacatgctcaaggacgagcggttggtgcagcaccagccgacgcagcacccgacgtcggaggagctcagcatcggcaagatcaagttcaaggccttcgacctcggcggccaccagatcgcgcgccgcgtctgggaagatactacgcaaagggtgatgctgtagtatacctggtagatgcgtatgataaggagcgatttgctgaatcaaaaaaggagctgggacgctctcctgtcagatgattcccttggcaaaatgttccatttccccatccttgggcaaccaagatgaaaaatcccgtaatgctggcctcctaaaaagggaacttgcggtattccccctaggggccctttaccaacttttccaaacccgggaaaaagggcaagggtcaaccccttgggcgacatccccaagg

SEQ ID NO: 78947 - protein, 90 aa, Zea mays
  misc_feature: Ceres CLONE 1563935
  misc_feature (6)..(90): Pfam Name: Arf Pfam Description: ADP-ribosylation factor family
MFLWDWFYGVLASLGLWQKEAKILFLGLDNAGKTTLLHMLKDERLVQHQPTQHPTSEELSIGKIKFKAFDLGGHQIARRVWEDTTQRVML

SEQ ID NO: 78948 - DNA, 958 bp, Zea mays
  misc_feature: Ceres CLONE 1563937
  misc_feature: Translation starting site: 163
  misc_feature (466)..(466): n is a, c, t, g, unknown, or other
gcggtggcggccgctctagaactagtggatcccccgggctgcaggaattcgtctcacccctagaaaaactttttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccnaaccccatccaggtcgtcgtcgacgcgatcatcaacagtgggccccgtgaggatgccacccgtattggttccccctggtgtttgtgaaaaaggcaggccgggaatttccccccccctggaggaagggggaaccaggccatcttacctcctccacccttggggccagggaaaagggctttccggaaattcaaaaaccctttccccaaggcccttcaaaataaacttaaaaaacccggccagagggctcccccacaagtttccccccccaaaaaaaaggaaaaatttttgggggtggccaagggaaaccttataaaagaacttttttcccgggggcccccccgcggggaaattttttggtgtgggggggcaaaaagggcccttttttaaaaggtttaaagtttttgaaacccaccgggggtggtgttttcgcccccaaataaatccggaaattgttttgtgggaaaaaaaagcgggtttaaaaaacactttctt

SEQ ID NO: 78949 - DNA, 889 bp, Zea mays
  misc_feature: Ceres CLONE 1563941
  misc_feature: Translation starting site: 142
ctccccgcggtggcggccgctctagaactagtggatcccccgggctgcaggaattcgtctcacccctagaaaaagctgagcccagagtccgcccgtgacggcgcgtatcgtctctgatctctctcgtgactccaggtccggatgagcacatgcatggagctggagcagaagccgccgccgccgccggaggagtactggagcggcatgtcgggcgggcgcccctgctacgcgtgcgccgctctgcctgcgcgtctgcactgcctgggtgtactgcgcgttcctgtggcccggctgcgacgcgcgggcgcactgtggccggtcgctgcacccgagcgcgtggactgtgcgaggtctgcgagcacgcccccgcctccgtcacctgacgcgtgcgacgccgactcgctctgcgccatctgcaacgcccacatgcactccggcaactcgctcgcgcgccaccactagctcctccacgtggcgcccttgctctggtggctctccgacgcgcctgcgccgcagctcttccactccaagtgggccgcggctggcgtagaaccgtctgccgccgatgatgaggacggtagcaacgaggcctacgccgcatcctggctgctccacaatccccacacggaccgatgacttcgccgacaacgactcattctcggggagacgacgcgtacctcagatctactgaacttccgcagcgctttgacgcgtgaagacgtcggatgcattcctccgaggcgctctagatgaagggtgcaggaattctttaccccagatcgtgaacccgcgtgcagctctacaggtgggggtacggcgaagggcagagcctgctgaacggacctagacccatatcgcggtcaagacttcgtcactcagaggtttcagt

SEQ ID NO: 78950 - DNA, 921 bp, Zea mays
  misc_feature: Ceres CLONE 1563943
  misc_feature: Encodes the peptide sequence at SEQ ID NO. 78951
  misc_feature (752)..(752): n is a, c, t, g, unknown, or other
  misc_feature (828)..(828): n is a, c, t, g, unknown, or other
  misc_feature (854)..(854): n is a, c, t, g, unknown, or other
acccgcggtggcggccgctctagaactagtggatcccccgggctgcaggaattcgtctcacccctagaaaaaatgtggctcatggaaagtctactgttgtgaaggctatatccggagttcagactgttcggttcaagaatgagctggaacgtaacattactataaagctgggctatgctaatgcaaaaatctacaaatgtgaggatgacagatgtccacgaccaatgtgctacaaggcctatggaagcggaaaagaagatagccctctatgtgatgtgcctggatttgaaaacactagaatgaagctcctgagacatgtttcttttgttgattgcccgggacacgatattctcatggctacaatgcttaatggagctgctatcatggatggagctcttcttttgatcgcagcaaatgaaagttgtccacagccccagacatctgagcatcttgctgctgttgaaatcatgcgccttcaacatatcatcattctgcagaacaagattgatcttatccaggaaagtgcagcaatgaatcaacatgaagcaatccaaaaattcatccagggaacaatagctgaaggtgcacctgtggtgcctatatctgcccagctgaaatacaacattgatgttatttgcgaatacattgtgaagaaatccccatccccgaaaggactttacctcgcctcccaacatgattgttattcgttcctttgatgtaaacaagccctggtcagaggtgacgaaattagnagtggtgtagctgggtgcagtatccctcagggaagtcttagggtgaacaagagattgaaagtcgccctggcattgntatgaaagatgagaatggaaacattnagtgcacgccaatctactcaaggattgtctcactctatgctgagcagattgagctccatttgctgtt

SEQ ID NO: 78951 - protein, 163 aa, Zea mays
  misc_feature: Ceres CLONE 1563943
  misc_feature (22)..(147): Pfam Name: GTP_EFTU Pfam Description: Elongation factor Tu GTP binding domain
  misc_feature: SWISSPROT Homolog: EC 2.7.7.4 Sulfate adenylyltransferase
MCYKAYGSGKEDSPLCDVPGFENTRMKLLRHVSFVDCPGHDILMATMLNGAAIMDGALLLIAANESCPQPQTSEHLAAVEIMRLQHIIILQNKIDLIQESAAMNQHEAIQKFIQGTIAEGAPVVPISAQLKYNIDVICEYIVKKSPSPKGLYLASQHDCYSFL

SEQ ID NO: 78952 - DNA, 813 bp, Zea mays
  misc_feature: Ceres CLONE 1563944
  misc_feature: Encodes the peptide sequence at SEQ ID NO. 78953
  misc_feature (447)..(447): n is a, c, t, g, unknown, or other
  misc_feature (508)..(508): n is a, c, t, g, unknown, or other
ctggagctccccgcggtggcggccgctctagaactagtggatcccccgggctgcaggaattcgtctcacccctagaaaaagccgcctctccccactccctctcgtcgccgtcctctcccgttcgcaacgccacgctccccaccgccgaaatggccccgaagcgaggtggcagggcaccggtgccggccaagaagaagacggataaagtgacgaaccctctgttcgagaaaaggccgaagcagttcggcatcggcggcgcgttgcctcccaagaaggacctgcaccgattcgtcaagtggcccaaggtcgtgcgcatccagcgccagcgtcgcatcctcaagcagcgcctcaaggtgcctccggcgctcaaccagttcacccgcaccctcgacaagaacctcgctaccaacctgttcaagatgcttcttaagtaccggcccgaagacnaggctgccaagaaggagaggcttctgaagaggggccaggctgagaatgaaggaaaaactgntgaatccaagaaaccaatttgttgtgaagtatgggccttaaccatgtgaccttacctcattgagcagaaccagggttcagcctcggtggcatcccctcaggaaggggggatcccaattgaacccgggtttgtttgggcttcccacccccctgtcccaggaaaaaaagggaggtcccccctaccggcgatttgttaaaagggaaaaagggctccccccccttggggaaaacaaattttttccccaaaaaagaaaacaccggcccccccccctcctttttgggggttttaaaaaacaccaacttttt

SEQ ID NO: 78953 - protein, 135 aa, Zea mays
  misc_feature: Ceres CLONE 1563944
  misc_feature (100)..(100): Xaa is any aa, unknown, or other
  misc_feature (120)..(120): Xaa is any aa, unknown, or other
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDXAAKKERLLKRGQAENEGKTXESKKPICCEVWALTM

SEQ ID NO: 78954 - DNA, 868 bp, Zea mays
  misc_feature: Ceres CLONE 1563946
  misc_feature: Encodes the peptide sequence at SEQ ID NO. 78955
  misc_feature (346)..(346): n is a, c, t, g, unknown, or other
  misc_feature (741)..(741): n is a, c, t, g, unknown, or other
ctacccgcggtggcggccgctctagaactagtggatcccccgggctgcaggaattcgtctcacccctagaaaaaaggccgcagctcccacgtcccaacaacttgccaattcgcaccgcgggaccggcgccgtcttgttgctccgctccggccgtgacacgagcgcacccgccaccaccgccagcccctcctcccccgtcgactcgagccacaggacaaggcatcccaaccgccgcccatctcctatcgtcatctgccgatccctcctcggttcctcacagtcacagagcctcacgtcacgtgtacctcccccaacgcaacccagcccaacccagcccaaaacctancgggcgaggggccggggaaccgaccgccggacgcggagatggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgccgccgcggtcaacaaggccggcctcgccaagctcatcggcctcgccggagagaccaacgtccagggcgaggagcaaaagaagctggatgtcctgtccaacgaggtcttcgtgaaggcgctcgtcagcagcggccgcacctgtgtcctcgtgtctgaagagaagaggagggcatcttcgtcgacacggccctccgcgggaagtactgcgtctgcntcgacccgctggaatgggtctccaacatccgactggggtgtctcaatcggaacgatcttttgggatttacatggtcaaaaacaaggacaacgtgacccttggaggaatgtgctgcagcccgggaaat

SEQ ID NO: 78955 - protein, 161 aa, Zea mays
  misc_feature: Ceres CLONE 1563946
  misc_feature (13)..(161): Pfam Name: FBPase Pfam Description: Fructose-1-6-bisphosphatase
  misc_feature: SWISSPROT Homolog: EC 3.1.3.11 Fructose-bisphosphatase
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEEKRRASSSTRPSAGSTASASTRWNGSPTSDWGVSIGTIFWDLHGQKQGQRDPWRNVLQPGK

SEQ ID NO: 78956 - DNA, 661 bp, Zea mays
  misc_feature: Ceres CLONE 1563947
  misc_feature (152)..(152): n is a, c, t, g, unknown, or other
  misc_feature (387)..(387): n is a, c, t, g, unknown, or other
  misc_feature (388)..(388): n is a, c, t, g, unknown, or other
  misc_feature (428)..(428): n is a, c, t, g, unknown, or other
  misc_feature (531)..(531): n is a, c, t, g, unknown, or other
  misc_feature (542)..(542): n is a, c, t, g, unknown, or other
  misc_feature (568)..(568): n is a, c, t, g, unknown, or other
  misc_feature (572)..(572): n is a, c, t, g, unknown, or other
acccgggtggcggccgctctagaactagtggatcccccggctgcaggaattcgtctcacccctagaaaaaacgctctcgtctactcccacggtcccactcctcaggagcgtccagagtttaggtgctcgtggagtcgtggtggaggtggtangtgtcaatggcctttaagctggccacaaaggccggcggcgggcgtcccccgcttgctgcttaaccccggggggtctccccccggggggcccgaagggaaaaaaaccccccttttcccttttggaaacaaagcgccccaaaaaaaaaaaaaaagggggcctttccccccccggggggcaaaaaaaaaaaaattctctccccaggaaaaaccccccccccgggggggggggtttttnnggggggggaaaaaaaaaaaaaaaaaaggggggggtttgtntttttttcccccccccccccaccaagaggaggaggtgggaaaaaaaaaaaaaaaaatatttttttgccacccccccttttttttttgaagaaaaaaaaagggnaaactagatgnttgttttttagaaaaaaagaaaaagngggngggttttcctttttttgtggtggtgttgggaagaagccccctccccccgcgcaaaaaaaaaaagagaccgggccgcctttttttttttg

SEQ ID NO: 78957 - DNA, 974 bp, Zea mays
  misc_feature: Ceres CLONE 1563951
  misc_feature: Encodes the peptide sequence at SEQ ID NO. 78958
  misc_feature (469)..(469): n is a, c, t, g, unknown, or other
  misc_feature (798)..(798): n is a, c, t, g, unknown, or other
  misc_feature (818)..(818): n is a, c, t, g, unknown, or other
  misc_feature (828)..(828): n is a, c, t, g, unknown, or other
  misc_feature (840)..(840): n is a, c, t, g, unknown, or other
  misc_feature (883)..(883): n is a, c, t, g, unknown, or other
  misc_feature (893)..(893): n is a, c, t, g, unknown, or other
  misc_feature (894)..(894): n is a, c, t, g, unknown, or other
  misc_feature (974)..(974): n is a, c, t, g, unknown, or other
ctggagctccccgcggtggcggccgctctagaactagtggatcccccgggctgcaggaattcgtctcacccctagaaaaaacaccttgagaggccgcaagccgcaccgccgtagccatcttcccttgttcgcgtctccactcgtccagttccccaccttcccgcctgccccacgtcctcctattctctgtccacgcggataactcgcccggtgcgcctccgatccattccacgccggttccgggctccggctggccactcgcccggtgcgcctccgatcaccgctccctccccctacgggctcccaagaaaagggcagatgctcaggcttgctgaatttgaaattgacacaagatatgaagcgccaaatgaggtatagactgaaacagaagtacttcaatgggatatctgcaaatcaagtgaggactacatcgcctatttcaagcatgtctgacaattagtggagaaangttggtggagaagttgtctgccccaaatcacaagaagcaagaaaaacataaggatgttgaacctagtgcaatagatcttttcaaggagatgcgttgcagcaagaagaaaggttgacatggaagaaatggtagcagcaccagttcatgatggacaacaaccaaaatctcctgtagaagttgttttctatgtgctatcgagctctagtgtgttcctacgcaatgggtcatctcagtccaccctctagaaaagctccacaatgaaaagttatgcaaacgttcaacaactttcgtgattaactggagacgagtagcaagaaaaaaatggcctncgggtaagaagtggaaaccntgaaagctcnagaaacagcatnctcaggagacattgaaagtatgaagaagccgatggatgaaaantacacctccnntcgtcactataagctaccatcgaggccagtgcctccatcttagtctgttgaacactataaacctgtaccttatgctgctn

SEQ ID NO: 78958 - protein, 34 aa, Zea mays; identical to SEQ ID NO: 65775
  misc_feature: Ceres CLONE 1563951

SEQ ID NO: 78959 - DNA, 1140 bp, Zea mays
  misc_feature: Ceres CLONE 1563961
  misc_feature: Encodes the peptide sequence at SEQ ID NO. 78960
ctggagctccccgcggtggcggccgctctagaactagtggatcccccgggctgcaggaattcgtctcacccctagaaaaaacgagaaatatctatcaggagacggggattccagagagcccctgtcgggtagggaagggaaggagaggcgaagcggaggcgagatgggggcggccgaatccgtgccggagacctccatacacgaattcaccgtcaaggattgcaacggcaaggaagtgagcctggaaacctacaaggggaaggtcctccttgttgttaacgtcgcctccaaatgtgggttcacggagaccaattacacgcagctgacggagctttatcagaagtacagggactaagacttcgagatattggcattcccttgcaatctgttcttgcgacaggacccacgtactgatcagcagatacaagactttgcttgcacctgatttaaagctgattacccagtttctccgaaggggtcgcgttaacgggtccttatgctggcgccgggttttcaaagtttctgaaaagctaggcgagccttggtttcgtttggggtccatcgaggaatcaaaatgggaactttttcccaagttttcccggttggcaccaaagatggggaacgggccatgtctagaaagattccgggaacccctcctaacaggctccccattgggcaaatttggagaaaggtatctattcccagaagggggcccctttggaagggaaatataattttgtttggtggaaagctttggtgttttcgtttcttcatttcacaaccaacaacaagcttttgacaagaaaaaaataatgagggcacctttggccggagaaaatatttccccggtcggtatatataaccttgtcaaagaacccgtgaccggcctctttgtccttttatctcgggagggaaaaaaaattctctggtggataagtgtttgacccttcctttttttcacccctccgcgtttcggggattaatgagaaggttgtgtttttagatattcccttccgccctgtctaggcgttttcccccctctctgtgtgggaggaaataagatacttgtttctctgtgaggccaagattacacgtgtggtggtggctctagagcttgaaatatattaatcataaccgcct

SEQ ID NO: 78960 - protein, 63 aa, Zea mays
  misc_feature: Ceres CLONE 1563961
  misc_feature (12)..(64): Pfam Name: GSHPx Pfam Description: Glutathione peroxidase
  misc_feature: SWISSPROT Homolog: EC 1.11.1.12 Phospholipid-hydroperoxide glutathione peroxidase
MGAAESVPETSIHEFTVKDCNGKEVSLETYKGKVLLVVNVASKCGFTETNYTQLTELYQKYRD

SEQ ID NO: 78961 - DNA, 933 bp, Zea mays
  misc_feature: Ceres CLONE 1563963
  misc_feature: Encodes the peptide sequence at SEQ ID NO. 78962
ccccgcggtggcggccgctctagaactagtggatcccccgggctgcaggaattcgtctcacccctagaaaaaatcgatggatatccaccgttccttctccccgttcctaatgtcagacgtgcagcctctccactgcgcccacttcttatactcccaccttctgctccctctcacggacgcttcgctctagtcggaacgtttccaggaactcccgggctcgaggagatcgggactatgatgggagggcgcgctctgctgctgctcctggactctgcgctgctcgttcagatccgcgcctctgacccactgctgtacgagccgtttgatgaggacttcgatggcatacggatcctctccaacaatgatgaataccaacgtgtatggaagcatgccaagagtgatgggcatgaggactatgggctccttgttagtcgacaggcgaggcaataccccatgatcaaagaagcttgatgatccagttaccattaatgattggacagtggtccctgcaatttgcagtgagaactcacaagggcctttggatggacacggtgcttccttgaggtacatccggccctaaggatgctggatgggaatgccaaaaagttttgataaagaaaactccgaacgcaatttttggcttggacccgaataattgggggttaatcaacaggcgttgattcggttccctaagcaaaaaacccctaaaatgggaacctttttaaggctcccccttaatttccccccttttttccccaaaaaaaaaacccccaggggcaccccgtctccggggggcaaaaaaattgggaaaattttttaaacccggggaaaaaaaaaaaaaaagaaaccccccttcgggggtggattgtgccaccaattttcccctcaaaaaacttctcttcttaaaaaaaaaacccgggggttggggggggg

SEQ ID NO: 78962 - protein, 78 aa, Zea mays
  misc_feature: Ceres CLONE 1563963
MMGGRALLLLLDSALLVQIRASDPLLYEPFDEDFDGIRILSNNDEYQRVWKHAKSDGHEDYGLLVSRQARQYPMIKEA

SEQ ID NO: 78963 - DNA, 1333 bp, Zea mays
  misc_feature: Ceres CLONE 1563964
  misc_feature: SWISSPROT Homolog: EC 5.4.2.1 Phosphoglycerate mutase
  misc_feature (39)..(39): n is a, c, t, g, unknown, or other
  misc_feature (870)..(870): n is a, c, t, g, unknown, or other
  misc_feature (1067)..(1067): n is a, c, t, g, unknown, or other
tctttatttttcgctctttacctacttatatgtctgccnctatttttacctcgtatatgacttttttttaagcggagctccccgcggtggcggccgctctagaactagtggatcccccgggctgcaggaattcgtctcacccctagaaaaaggtggctgttgtcgtgctggacggatggggcgaggccaaccccgaccagtacaactgcatccgtgtcgctcagacttcctgccctggactcggctccagaatggcgccccctgagaaaacggagactaactgaatggccgttggaaacccggggttgggtctccccatctgaataatagacaggggggaacaagtgaaacttgggtccacaaggcaccttgggtgggtgaggcccgaatattttcccccaaggtggtccaaggttttgttgtataatcaccccccctagaccccagggacaaatttttgtttactgtaagaacacgcgggtctaacgttatttttttaaggaaatccctcgttggaaaaagaggggcgcgccccccccccgtgtgttttgtggtggtgttgtagaaacactaaatggggtggtctttctgtctctccgcgccctctgagccgaaacttattagttttctttttttgataaagggtggtttacttttaacttgcgggtggtccccgttttaaatttttgtgccggtgttccccatcccctttgcccttatataggcggtctgaaaatctttcttctagcgtgtggacctatcccgcgcgtgtgacgcttcgcgccgttaaagtctcctcttctatcaaatccgtttctcgttctttagaagtcactgctgcactcggtaatggtgtatattcatacaccncccatccgagttggtgcaccctcccggctgggcgggtagaatacaaagtgcattcatgtctctcatccgctcgatgcccgcgtcttgtagcagcttctcaccccacgggcgtctttgctcgtttgtaacatctcgtagcgtgagggtatcatacggttacgtgacgactggtcggagagaaacagtttctacccctngtacgtgcccctttgtgttgtcgtcacctattccgtggcgtgcgtttaaaccacccacacggctactctctcctacactcgcactggtatcccgatgatctctttgcatgtcgctccgcccacccctttttagctgagaccatgtgctacattacatcttgcaccgcgcgcactgttcgttgttgttgcatctatctatgtttattgcagtgtcatacgcctcacgttggtgagtgcacacacgttttgcaaaaccgtatcttttt

SEQ ID NO: 78964 - DNA, 840 bp, Zea mays
  misc_feature: Ceres CLONE 1563965
  misc_feature: Encodes the peptide sequence at SEQ ID NO. 78965
  misc_feature (641)..(641): n is a, c, t, g, unknown, or other
  misc_feature (665)..(665): n is a, c, t, g, unknown, or other
  misc_feature (668)..(668): n is a, c, t, g, unknown, or other
  misc_feature (669)..(669): n is a, c, t, g, unknown, or other
  misc_feature (776)..(776): n is a, c, t, g, unknown, or other
gagctccccgcggtggcggccgctctagaactagtggatcccccgggctgcaggaattcgtctcacccctagaaaaaaaaccttaaccaaatcccccctcccctcgcttccacaccttccgcctcgtctccctctctctctgtctctctctctctctcacacacacacacgcatcaggtcgggacgggaggggaggtctcgtgcgcgcccggctttcctctcctctcctcgccgcacgacgcgcgcgcggtcccggtcgccgatggccaaggcacgcaggccgccgttcgccgccgccgagcggttcctcggcttcccccgcggcgggccctcgccgggggccgtggcgccggcgcccgccgccctcgacgacctgccggacctcgccgaggccgacgtctggtactcggctgccgacccgggtagcccgtatcccgcggcgtcccgacatgcggcggcggagggcaggagcgcaggccagcgcggcccgcggcgcggcgtgcagggcggcctgagccgggcgttcggggacgggtccgggtccgggtccgggcggcaggcggcggcgtcggcgctcgtcgaggtggccgcgtggccggcctgcttctccgtgccggacgcggagccgacgctgctgttcnagatggagatgggggacgacgacnacnnacagggggaaggggacccccgggtgggtgcttccgcacgtgtaccttgcgcggcgccaggcgcgggcgtcggttggtgaaaggcgcccgcccgacgctcaaaggccnggaacatgtcgcgggtgctccacacctttctggaaccggaacgggcttccacggaatagcaaaa

SEQ ID NO: 78965 - protein, 161 aa, Zea mays
  misc_feature: Ceres CLONE 1563965
  misc_feature (127)..(127): Xaa is any aa, unknown, or other
  misc_feature (135)..(135): Xaa is any aa, unknown, or other
  misc_feature (136)..(136): Xaa is any aa, unknown, or other
MAKARRPPFAAAERFLGFPRGGPSPGAVAPAPAALDDLPDLAEADVWYSAADPGSPYPAASRHAAAEGRSAGQRGPRRGVQGGLSRAFGDGSGSGSGRQAAASALVEVAAWPACFSVPDAEPTLLFXMEMGDDDXXQGEGDPRVGASARVPCAAPGAGVGW

SEQ ID NO: 78966 - DNA, 1319 bp, Zea mays
  misc_feature: Ceres CLONE 1563966
  misc_feature: Encodes the peptide sequence at SEQ ID NO. 78967
  misc_feature (50)..(50): n is a, c, t, g, unknown, or other
  misc_feature (66)..(66): n is a, c, t, g, unknown, or other
  misc_feature (1210)..(1210): n is a, c, t, g, unknown, or other
ctctctaagatccaccaatctaagtttggtccaatgttctcattttttcnctctttttatattttntcaaagctggagctcaccgcggtggcggccgctctagaactagtggatcccccgggctgcaggaattcgtctcacccctagaaaaaacaggacgacccaagcaagcaagcaagcagcgagtacatacatactaggcagcgaggcagccttggcgcccaccgtgatgatggcctcgtcggccaccgccgtcgctccgttcacaggggctaagtccaccgccagcctccccatcgcccgccgctcctccagaagcctcggcaacgtcagcaaaaagcggatggatcccgcgcatgcaggtgtggccggccgatgtcaacaaagaaattacgagacgcttgtcggacccgcccccgctgtatacggaacaactggctgaaacaaagtggactaactggcggcccaacagctggaaaccccccccgtcggttcaccaaagtcccggctcttgggactgtggagaacccctaccccccccgtgctttctacaaagggcgggttccgggaatcatgtgggagactactccctttggggggctgcaagtaatcgccccccacgggggctcacaaggagctaaccagaaagggcattcagaatgccgtgaccgaggaggacccttaccaaccgcgggccatgcccgatttttgaaaaaagtgttgaggatcagaaacaccatgtggaggtgacatctttaactgaataccccttggaaaaccaccctgtgatgggggcccataataatataagagagtatactccctacctggttaacggacgccttcccgcgcgcggagggcaaagcggctaatacgttaagacctacatctccccctggccgagtttgagggtttacactcataacgttgtgtgtgcccccggtccgtagagtgattatagtacagcgaattggtaaatttgtgtgatattttacacggggacctccatcacatggaatgaccctcttctagtggctagcgccctgcgatgcgatgcgaccgttttgtacaatgtatttcgtcctcgcgtagcagatatatcgaagtactgttgtcctctcgtggtcgaaaatagtagacgcgtctagtgtgagttaattatctataagaatcaatctcgcttccatgtgcgcgctcttctaactttccncacgtggagtccacgtttttgcgaggagacctcctacacctctgcatctcactcgctttatggggtggtgacacagtgatagacgatggagtagcgcatcactgatacc

SEQ ID NO: 78967 - protein, 70 aa, Zea mays
  misc_feature: Ceres CLONE 1563966
  misc_feature: SWISSPROT Homolog: EC 4.1.1.39 Ribulose-bisphosphate carboxylase
MMASSATAVAPFTGAKSTASLPIARRSSRSLGNVSKKRMDPAHAGVAGRCQQRNYETLVGPAPAVYGTTG

SEQ ID NO: 78968 - DNA, 948 bp, Zea mays
  misc_feature: Ceres CLONE 1563968
  misc_feature: Encodes the peptide sequence at SEQ ID NO. 78969
ggagctccccgcggtggcggccgctctagaactagtggatcccccgggctgcaggaattcgtctcacccctagaaaaagtgaccgatcgttcgttccttccttctcttctccctcccaattcgcgggccgcgcgcctattttatttactactgtattcgtatcattatactgtttggtttccatccctggcagatctcccactctctcgtcagatcctctcggctagctagctagctaggacagaggagggaggggaaggcgctggctatggcgactgcggcggcggcggcggcggcggccatggaggagccggacgtcgtcaacggccgcgacgtggtgagctgggtggcgtccggggtggtgctgtggtcgaccgccttcttgctggtgcgggcgctgttccccaagcgctcctacgacttctgcaaccgcgccgtctccaccatgcacgccgtcgccgccgtgtgcctcgcctgcctctccgtcgacgactggtcgtgccccgtctgcccgctcgccgccgcatcctcccctcgccagatgaaggcgctggcggttacgctggcgtacatggtgtacgacgcggcgtgctgccacctcaacggcgacacgcggctggacaacgccgtgcaccacctggtcagcatcgtcggcattcgggcggggctcgcctaccaaaagtgcgggaacgaagatggtggccagcatgctcgtgacggagatgtccagcccgctgctgcacctgcgggagaagctaaaggacctgggcgtgcgggaaaacgaactgaacctcctcgtcaaagtgttttttgccgccaccttttcccccgccccggatgggccttcagggccctacctcacctaatttcacggtgagggcccgaaaaccccttcctctataaggggatatggcaaggggcctgtccctcggtaaacgcctccttgtt

SEQ ID NO: 78969 - protein, 202 aa, Zea mays
  misc_feature: Ceres CLONE 1563968
MATAAAAAAAAMEEPDVVNGRDVVSWVASGVVLWSTAFLLVRALFPKRSYDFCNRAVSTMHAVAAVCLACLSVDDWSCPVCPLAAASSPRQMKALAVTLAYMVYDAACCHLNGDTRLDNAVHHLVSIVGIRAGLAYQKCGNEDGGQHARDGDVQPAAAPAGEAKGPGRAGKRTEPPRQSVFCRHLFPRPGWAFRALPHLISR

SEQ ID NO: 78970 - DNA, 810 bp, Zea mays
  misc_feature: Ceres CLONE 1563969
  misc_feature: Encodes the peptide sequence at SEQ ID NO. 78971
  misc_feature (150)..(150): n is a, c, t, g, unknown, or other
  misc_feature (151)..(151): n is a, c, t, g, unknown, or other
  misc_feature (309)..(309): n is a, c, t, g, unknown, or other
  misc_feature (317)..(317): n is a, c, t, g, unknown, or other
  misc_feature (328)..(328): n is a, c, t, g, unknown, or other
  misc_feature (337)..(337): n is a, c, t, g, unknown, or other
  misc_feature (339)..(339): n is a, c, t, g, unknown, or other
  misc_feature (340)..(340): n is a, c, t, g, unknown, or other
ctccccgcggtggcggccgctctagaactagtggatcccccgggctgcaggaattcgtctcacccctagaaaaagactaaaaagggccagggccagggccttcgcttgcttactactcctgcttaccacactctaccttgtctcttcacnngtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcngaagcgcngctacgaacgnccttcactncnnactcacaagaagtactgcgcgcttgcgcaacgcgcggaacccgggcgaggcccccgcgtacctgcaccgcgacgactttcccgcggtacctggacgggtacgccgcgccggtttgccggtcggcccggggccttccccgcgaagttcggttcgggcccggtacaaacccccaaaacccccgtggggaagggggaagccctgggaactttggaacggggcccaggccaaaggggtaacccgggaaaggtttcccgggggggccccccccccggggaaaaaacccccaaaaaattccctccccaaaaggggcctcgggtttgaagaggttttcccccccccccgggtataaccccccccgggggagaaacccccccctccccccaaaggggaaaatccccggaaaaagccccctcctcttctcgggggggggggggggactaccccccgggtgggggagagccccccccccc

SEQ ID NO: 78971 - protein, 162 aa, Zea mays
  misc_feature: Ceres CLONE 1563969
  misc_feature (46)..(46): Xaa is any aa, unknown, or other
  misc_feature (49)..(49): Xaa is any aa, unknown, or other
  misc_feature (56)..(56): Xaa is any aa, unknown, or other
MAAVAEEEVIVVGAGQSGLAVAACLSLRGVRALVLERDDCVGSLWXKRXYERPSLXTHKKYCALAQRAEPGRGPRVPAPRRLSRGTWTGTPRRFAGRPGAFPAKFGSGPVQTPKTPVGKGEALGTLERGPGQRGNPGKVSRGGPPPGEKTPKKFPPQKGPRV

SEQ ID NO: 78972 - DNA, 904 bp, Zea mays
  misc_feature: Ceres CLONE 1563971
  misc_feature: Translation starting site: 182
  misc_feature: SWISSPROT Homolog: EC 1.1.1.42 Isocitrate dehydrogenase (NADP(+))
  misc_feature (707)..(707): n is a, c, t, g, unknown, or other
  misc_feature (717)..(717): n is a, c, t, g, unknown, or other
ctggagctccccgcggtggcggccgctctagaactagtggatcccccgggctgcaggaattcgtctcacccctagaaaaagcctgccgtctctcttccaccttccaccacaagcgccgccgcagccggtgcctgctccttcccgatccccgaggcaaagctgcgactccgcaaccgccgccatggcgttcgagaagatcaaggtctccaacccaatcgtcgagatggacggtgatgagatgaccagggtattctggcagtctatcaaggacaagcttatcctcccatttctggacctggacatcaagtactatgatttggggatactgcaccgtgaagcaactgatgacaaggtcacagtggaggctgcagaggctactctcaagtacaacgtggctattaagtgtgcgaccattactccagatgaaactcgggttaaggagttcaatctgaaacacatgtggaagagcccaaatggcacaattaggaacattataaatggcactgtgttcagagagcctattatatgcaaaaacgttccaagacttgttccaggatggactaagcccatctgcattggaaggcatgccttcggtgatcaataccgagctaccgatgcagttctgaaggggcctgggaagctgaagctagtttttgagggaaaagagaacagattgatctggaggtatcaacttcactggtgctggnaggagtgccntgtctatgtacaacaccgacgagtcaatccgagcttttgctgaggctttctatgacactggctatgagaagaaatgggcactctaccttagcaccaaaaacacatcctgaaaaatatgatggcagggttaggacattttccagaggtctatgagctgactgaagtcaaaattgagctggctggatat

SEQ ID NO: 78973 - DNA, 967 bp, Zea mays
  misc_feature: Ceres CLONE 1563973
  misc_feature: Encodes the peptide sequence at SEQ ID NO. 78974
  misc_feature (703)..(703): n is a, c, t, g, unknown, or other
  misc_feature (704)..(704): n is a, c, t, g, unknown, or other
  misc_feature (738)..(738): n is a, c, t, g, unknown, or other
  misc_feature (835)..(835): n is a, c, t, g, unknown, or other
ccgcggtggcggccgctctagaactagtggatcccccgggctgcaggaattcgtctcacccctagaaaaaacacaccatcgaaacacaaaccagcagcaggcagagcaacgactagctgccaggcaagccggccggggtgctagcaagagtgcaacaatggccaccgcgctctccttcaaggccttggcactggccgcgctcctctccgtggtcgtcacctctggcgctcgcgccgagcaacagctcaagcgcaacgcaaccaccgcctcgcaggacagatccttgttgtcctacagcagtggctggctgccggccaaggccacctggtacggcgcccccaccggcgccggccccgacgacaacggtggtgcgtgcgggttcaagggcaccaaccagtacccgttctcgtccatgacgtcctgtggcaacgagcccatcttcaaggacggcaagggctgcggctcatgctaccagatacggtgcctgaagagcaaccacccggcctgctccggcgtggcgcagacggtgatcatcacggacatgaactactacccggtggccaagtaccacttcgacctgagcggcacggcgttcgggtccatggccagctggggcctcaacgacaagctccggcacgccgggatcatcgacatgcagttcatgctggtgccgtgcaatcttccgggcctgaacatcaccttnncgcgtcagcacggctcctaccccatgtacctggncgtgctcatcgagcacgagaacaaggactgcgtacgtgttgcatgcggacatcatgcagaactactccggccactgggtaacccatgcacgagtccntgggcttcccatctggaggacgaccccataacgcccgctccgttggtccctttctcatgcgcatcaccaacgagtccgggaaggcacctgtttggcaattaatgtcatcccgtcaaaatacatccccgaggt

SEQ ID NO: 78974 - protein, 259 aa, Zea mays
  misc_feature: Ceres CLONE 1563973
  misc_feature (87)..(168): Pfam Name: DPBB_1 Pfam Description: Rare lipoprotein A (RlpA)-like double-psi beta-barrel
  misc_feature (182)..(182): Xaa is any aa, unknown, or other
  misc_feature (183)..(183): Xaa is any aa, unknown, or other
  misc_feature (194)..(194): Xaa is any aa, unknown, or other
MATALSFKALALAALLSVVVTSGARAEQQLKRNATTASQDRSLLSYSSGWLPAKATWYGAPTGAGPDDNGGACGFKGTNQYPFSSMTSCGNEPIFKDGKGCGSCYQIRCLKSNHPACSGVAQTVIITDMNYYPVAKYHFDLSGTAFGSMASWGLNDKLRHAGIIDMQFMLVPCNLPGLNITXXRQHGSYPMYLXVLIEHENKDCVRVACGHHAELLRPLGNPCTSPWASHLEDDPITPAPLVPFSCASPTSPGRHLFGN

SEQ ID NO: 78975 - DNA, 848 bp, Zea mays
  misc_feature: Ceres CLONE 1563976
  misc_feature: Encodes the peptide sequence at SEQ ID NO. 78976
  misc_feature (696)..(696): n is a, c, t, g, unknown, or other
  misc_feature (767)..(767): n is a, c, t, g, unknown, or other
tggagctccccgcggtggcggccgctctagaactagtggatcccccgggctgcaggaattcgtctcacccctagaaaaaaaaaccccaaaccgcaggtaggaagcaaaccgcacgccccgctccagaacggatcctcatctctcacgttgtcaccacagtctgaatccagaatccaactagtagctccataaaagcggcaatgatccagctgctgttcgtcgtgctggtggcggaggcgtccctgacggcggcgctgctcttcaagacgccgctgcggaagctcgccgtgctagtgatcgaccggctcaagcgcggccgccacgcgcccgtcgtcgtcaagacggtcgcgggcgtcatccttgccctgctcgcttcaacgctctacagcatgacacagatcgccggcagcacgagcgactccgactctggcggcgggcccacccccaccgaccaggtgctcttctcgcgtcacctcctggaggcgtgcctcatggggtactccttatttcttgctctagtgattgaccggctccaccaatacatcagagatttgcgccggtttaaaaagacttagaggctgtacgtaagcataataaaatgttggaagaggcaaaacatggaaactcggaggaggcaaagaaataccaggaaagagatgccactctgaaacaggagatgaagaaactgaagctacnagtccaagaaaagacagagaagtccatgtttcagagggacaaggcacttgcttatcaaaaaacatccgaanggctgctgactgaataatgaccgcctgctgggagaatatcagcatcttcggacacagctgcttgtcaattgacggaggctt

SEQ ID NO: 78976 - protein, 124 aa, Zea mays; identical to SEQ ID NO: 44924
  misc_feature: Ceres CLONE 1563976

SEQ ID NO: 78977 - DNA, 944 bp, Zea mays
  misc_feature: Ceres CLONE 1563981
  misc_feature: Encodes the peptide sequence at SEQ ID NO. 78978
  misc_feature (729)..(729): n is a, c, t, g, unknown, or other
ggagctccccgcggtggcggccgctctagaactagtggatcccccgggctgcaggaattcgtctcacccctagaaaaaaaaacgacccccgcaaccaaagacctctccccttctatctatctactatatatcgatccacccatccctcgcagctccaaagcattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgaggccaagctcaaggtcaagttctacctcccgcccttcctccccatcgtccccgtcgtcggcgactactgggtgctctacgtcgacgatgactaccagtacgcgctcgtcggcgagccgcgccgcaagaacctctggatcctgtgcaggaagacgagcatcgacgaagacgtgtacaaccagctggtggagcgggccaagggagaaagctacnacgtgagcaagctgcacaagacgccgcaggacgacccgccgcctgagagcgacgccgcgcccaccgacaccaagggggggggggtgggtcaagtcgctcttcgggaaatgactgcccgtcaccgcacgcgcgcgtggctccggtactggtgctgcagttgcagcaaataaaccaggcctgaatgaagggaagaatgggattttaggctttgagaa

SEQ ID NO: 78978 - protein, 218 aa, Zea mays
  misc_feature: Ceres CLONE 1563981
  misc_feature (24)..(172): Pfam Name: Lipocalin_2 Pfam Description: Lipocalin-like domain
  misc_feature (163)..(163): Xaa is any aa, unknown, or other
MAAEEGEKAKSGGGGQQMTVVRGLDVARYMGRWYEIASFPSFFQPRDGRDTRATYRLLEDGATVHVLNETWSKGKRDYIEGTAYKADPGSDEAKLKVKFYLPPFLPIVPVVGDYWVLYVDDDYQYALVGEPRRKNLWILCRKTSIDEDVYNQLVERAKGESYXVSKLHKTPQDDPPPESDAAPTDTKGGGVGQVALREMTARHRTRAWLRYWCCSCSK

SEQ ID NO: 78979 - DNA, 856 bp, Zea mays
  misc_feature: Ceres CLONE 1563984
  misc_feature: Encodes the peptide sequence at SEQ ID NO. 78980
  misc_feature (661)..(661): n is a, c, t, g, unknown, or other
  misc_feature (698)..(698): n is a, c, t, g, unknown, or other
  misc_feature (699)..(699): n is a, c, t, g, unknown, or other
  misc_feature (785)..(785): n is a, c, t, g, unknown, or other
ctggagctccccgcggtggcggccgctctagaactagtggatcccccgggctgcaggaattcgtctcacccctagaaaaatagaaaaagccctctcgccgggccgtccgattccgccatggcttccgatgagagcaaaaaattcaaaaccagagaagccatcttcagcagctggtgcaggcctccccaatccgtttgatttttcttctatgagcaacttgctcaatgacccatcgataagagagatggctgagcaaattgcaagtgaccctgtgttcaaccagatggctgaacagcttcagaaaagtgctcagggtgctggagaacagggtattcctgcattggatcctcaacagtatatggaaacaatgcaacaagtcatgcaaaaccctcagtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgagatagagaatgggggtccatctgcaatggtgaagtattggaaatgaccctgaggttcttcaaaagattggcagggcaatgggtggtaaccttccctggagaatctagtngtgtccactgtggctctctggacccgaaaagactganngagaaaggagggaatggaccataaagtcattgttctcaccactgcacattgtgttgaaataaaaaagggtttgaagaaagcttttnaaaggtgaggccaccaagatgaaaaaaatgcccagggaagacgggctttaccttttgcagtgggccaaggg

SEQ ID NO: 78980 - protein, 156 aa, Zea mays
  misc_feature: Ceres CLONE 1563984
MRAKNSKPEKPSSAAGAGLPNPFDFSSMSNLLNDPSIREMAEQIASDPVFNQMAEQLQKSAQGAGEQGIPALDPQQYMETMQQVMQNPQFVSMAERLGNALMQDPAMSSMLENLTSPAHKEQLEERMARIKEDPSLKPILDEIENGGPSAMVKYWK

SEQ ID NO: 78981 - DNA, 1333 bp, Zea mays
  misc_feature: Ceres CLONE 1563986
  misc_feature: Pfam Name: MT-A70 Pfam Description: MT-A70
  misc_feature (46)..(46): n is a, c, t, g, unknown, or other
  misc_feature (52)..(52): n is a, c, t, g, unknown, or other
  misc_feature (53)..(53): n is a, c, t, g, unknown, or other
  misc_feature (1155)..(1155): n is a, c, t, g, unknown, or other
ttccgctttttacctcccccgcgttgcgtcagtctacccacacccnaaaaanntgtggcgttttttcaaagctggtactccccgcggtggcggccgctctagaatagtggatcccccgggctgcaggaatacgtctcacccctagaaaaatgtgttcggcagaaagaattgcaacatctcgcccgtccaactggagcgcttcttgttttgtggattacaaatagggagaaactgcgggcatttgttgagaaaaaactgcttccttcttggggagtggaagattccaccgtgttttattggcttaaggtgaaacctgatggctctctaattggtgatttagacttgttccatcacatgccctatgagtgcttcctccttggctacattaatgggtatgcatatgctaagcaagggtcaaattttccaggtgtttgaaaaaaccaagtaatcctgagtgtccccttttcccacccaaggaaaccctcccttggagcattacttttcgaatatattccaaggttctaaaaccttccaagatgcattcgatgcttttttggccaaagaagttgttttcccatatgggacctccttgggggaaaattgagcccgccttcaatttccatagaataaccatggtaccctcttccggaagaatatagtttcgatttggcccaattaccccgggaatattaaggtattggtggggattcccggaattgccaaactgatcccataccttaaggggcaatgttggggtgttttggcacattaacctcattttgtataccacttgtggtgtttcttttgttcggggccatcttctccttatcccgggggtgtagttgtaataaaactgcgccgcccctttttcctcccctgataccacatattttttttgtgccccttcctgtgactatatatttgcgcccggtaaatctgctgtagaaacctcctaccagtgggtgtgggtgtccctctctctcgttcttcttccacagcacccccctttgagattgtgggtgttttcacactatgcccctctgtttttcctccgaggccgcacaaatataccctgtgaaactggtcttttggcgccgcatatacccttttttctttgttatgagtggtggtacccctggcgggggagggccctgnagatgtctcgccatagttacatcggctccgtggaccccaccacacgcttttctactcccatgtgtctttgattcatggtgctcttttgtgccgcgccttcttgtcgagtacttctcatcctcattttttctgttaaatggcgtgcatctcctgtagtatctgctgctaacacatattt

SEQ ID NO: 78982 - DNA, 636 bp, Zea mays
  misc_feature: Ceres CLONE 1563987
  misc_feature: Encodes the peptide sequence at SEQ ID NO. 78983
  misc_feature (202)..(202): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (554)..(554): n is a, c, t, g, unknown, or other
  misc_feature (586)..(586): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
ggagctccccgcggtggcggccgctctgaactagtggatcccccgggctgcaggaattcgtctcacccctagaaaaagtcgtcaaaaaatccccattcgttccccttctcgcctccacgaaccttcacaaattgccctctcagatcttctcctaatctcactcaagccctagccaaatcccagccctagcgacaccaaccangctcgctcagcgaccatgggggaaccccggagaaagcttgatgaaaatcagatcttccggaccctcaaggtttcaccctcccaaagttcgcttggccagcgggcaggggggggccccaaagttgcccaaaaaagggggaggggaaaaaaagggggaccccaaaaaaccccccaaaggggggcccaaaaaaaaggggggggataattcccaaaaaaaaaagggggggcaaaaaaacctttgggggaaaaaagggggggggggccccccccccccccccctttttttttttttttttttttcccccccccccccccccccccaaaaaaaaaaaaaaaaaaaaaaaaaaannncnccccccctcttttttttttttcttttctcccnctnnnnnnnnaaaaaaaaaaaggggagaggggggcgtccccccccccccc

SEQ ID NO: 78983 - protein, 62 aa, Zea mays
  misc_feature: Ceres CLONE 1563987
MGEPRRKLDENQIFRTLKVSPSQSSLGQRAGGGPKVAQKRGRGKKGGPQKTPQRGAQKKGGG

SEQ ID NO: 78984 - DNA, 885 bp, Zea mays
  misc_feature: Ceres CLONE 1563990
  misc_feature: Encodes the peptide sequence at SEQ ID NO. 78985
  misc_feature (726)..(726): n is a, c, t, g, unknown, or other
  misc_feature (844)..(844): n is a, c, t, g, unknown, or other
ctccccgcggtggcggccgctctagaactagtggatcccccgggctgcaggaattcgtctcacccctagaaaaaacaaggagacgtacgctctctgctagcacccatcttgcagcaggcggagtcgcccgacccaatccgtgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgccggcctcgtcgccatcctcagcgtctgcctcaccatgtacggcgtcgcctccttcaacgagggcgacccgtccacggggcccacgctcacgctcaccgggcggtatgaaggaagccgactagctgcagacccgcgacggctggggcaagttcaccggaaggtttcttctcngtgttatctccggcgtgctctggacatacttcctcctctacgtgctcgacctcccctactacttcaaggtgatacaaatccttaagatgcatatttttatatagctccgccctccatnccctcttctggcgtgcaaggttggcatttcgcagggacgac

SEQ ID NO: 78985 - protein, 209 aa, Zea mays
  misc_feature: Ceres CLONE 1563990
  misc_feature (44)..(174): Pfam Name: PsaL Pfam Description: Photosystem I reaction centre subunit XI
  misc_feature (182)..(182): Xaa is any aa, unknown, or other
MASQVMKSSPVHSRPRGLSGAALTRPRPRFSVVKAAIQPEKATYQVVQPINGDPFIGSLETPVTSSPLIAWYLSNLPAYRTAVSPLLRGVEVGLAHGYLLVGPFALTGPLRNTPVHGQAGALGAAGLVAILSVCLTMYGVASFNEGDPSTGPTLTLTGRYEGSRLAADPRRLGQVHRKVSSXCYLRRALDILPPLRARPPLLLQGDTNP

SEQ ID NO: 78986 - DNA, 749 bp, Zea mays
  misc_feature: Ceres CLONE 1563991
  misc_feature: Encodes the peptide sequence at SEQ ID NO. 78987
ctggagctccccgcggtggcggccgctctagaactagtggatcccccgggctgcaggaattcgtctcacccctagaaaaatttgttatgggcgttagatatgagtttagtttgacactcttcgtgcacgtctgcttcagagttctgacactattaccatggctaaggcgttgtctaaattacttgttgaagagactcgccttaagtctttgtcttctactggtgtgagctctcactgtgttggctgctgctcaaaagcataagagttcctctttaccgccctgtgagcattgcaacaagaccagtcatcgctctgagaattgctttgttcaattcccgaagaagttggttgacttccgtgtccgtcgtgcggctcgtggtcgtggtacaggaacacatcctagaggctcaatttgtgttgctgctacttcatctgccgggttctttgattcagggagcctccattttccgggggaaatttgaaccagccccgttggctttcctcccccgtttcccagggatttttggcaaaagcggggggtttttggccccactccaaaggggttcctttgacccccctttcctgggcaaaaattttccgccccagagcaatttgggagcttttttttgggaaaaaaaattgggcccccctttttttttttttggtttaaaaagaccccccttttttttttaaggggaatcccccccccagggggtattttgttggagcggggtccccctcccaaaaaa

SEQ ID NO: 78987 - protein, 34 aa, Zea mays
  misc_feature: Ceres CLONE 1563991
MAKALSKLLVEETRLKSLSSTGVSSHCVGCCSKA

SEQ ID NO: 78988 - DNA, 932 bp, Zea mays
  misc_feature: Ceres CLONE 1563993
  misc_feature: Encodes the peptide sequence at SEQ ID NO. 78989
  misc_feature (781)..(781): n is a, c, t, g, unknown, or other
  misc_feature (932)..(932): n is a, c, t, g, unknown, or other
ctccccgcggtggcggccgctctagaactagtggatcccccgggctgcaggaattcgtctcacccctagaaaaaactgttgttgctacctgccagcctcaacgtgtcgccgcccctctcctcccacatgtggtgctcaagatgccatccccacaaatgaagctatgaagaagcaaatagttgtagcatcgaaggctatgcctttttactgcgctcttccaactttatctgaatatatgattgagagcggatggactcggtgctacttcaatatcagcgaaattggtttttctatgtacctctgttatatggctatgtatctcatctttgtggagtttggaatttactggatgcacagggagttgcatgacataaaaccattatacaaatatctgcatgcaacccaccatatttacaacaaggagaataccttgtctccatttgctggacttgcatttcatccactggatggtattctgcaagcaataccgcatgtgttcgcgctcttcctctttccacacacttcaggacacatattgcactcttgttcctagaggctgtgtggacaacaaacatccacgactgcattcatggcaagatatggccagtcatgggcgctggatatcaaccattcaccatacgacttaccgccacaactatggccactacaccatctggatggactggatgtttggtaccctccatgagccaaaagatatctcaagaaagcttgagtttctcggaactgtggtatccctatggtgctggtgctgaaatgctcnatcggttccagggtttctaattcgttgagctgttcagcctgttctgttatggagggctcagtgggttaattaattggccaggtccaatggcttttggcctattctgaaattaaagaggttggcccctgccccaacgattttcggacaatan

SEQ ID NO: 78989 - protein, 129 aa, Zea mays
  misc_feature: Ceres CLONE 1563993
  misc_feature (49)..(129): Pfam Name: FA_hydroxylase Pfam Description: Fatty acid hydroxylase
  misc_feature: SWISSPROT Homolog: EC 1.14.21.6 Lathosterol oxidase
MKKQIVVASKAMPFYCALPTLSEYMIESGWTRCYFNISEIGFSMYLCYMAMYLIFVEFGIYWMHRELHDIKPLYKYLHATHHIYNKENTLSPFAGLAFHPLDGILQAIPHVFALFLFPHTSGHILHSCS

SEQ ID NO: 78990 - DNA, 943 bp, Zea mays
  misc_feature: Ceres CLONE 1563996
  misc_feature: Encodes the peptide sequence at SEQ ID NO. 78991
  misc_feature (920)..(920): n is a, c, t, g, unknown, or other
ctccccgcggtggcggccgctctagaactagtggatcccccgggctgcaggaattcgtctcacccctagaaaaactttgatgccataagcaaggcccagcatctgatttacatcactggctggtccgtgtacaccgagatcaccttggttcgggacaccagcaggccgaaacctggaggcgatgttactcttggggagttgctcaagaggaaggccagcgaaggtgtccgtgtccttatgctagtgtgggatgataggacttcggtcggcttgcttaagaaggatggcttgatggctacccatgatgaggagactgcaaattacttccatggcacggacgtcaactgtgtcctgtgccctcgcaaccctgatgattctggcagctttgtccaggacctgcagatatcaactatgttcacgcaccatcagaagatagtagtggtagaccatgagttgccaaacgagggctcccagcagaggaggatcgtcagcttcgttggcggaattgacctttgtgatggaagagatacctggaatgttcagctctttagatccattgacggcggtgctgcttttggcttcccagagactcctgatgaagctgcaagagctgggcttgtgagtggaaaggatcaaatcatcgaccggagtatccatgatgcatacataaatgccatacggagggcgaagaaactcatctacattgagaatcagtacttccttggaagctcatatgactgggaagccgaaagcatcaagccagaagatatcgattggtctcacttgatcccgaaagagctctcatttgagaatgtcagcaagattgaggctggggagcgggtcactttttatgtggtggtgccatgttggcctgaggtggtccagtaatgtgctcccgtcaagcaatcttgactggaaangaaaccatggattgatgtcactg

SEQ ID NO: 78991 - protein, 216 aa, Zea mays
  misc_feature: Ceres CLONE 1563996
  misc_feature (58)..(96): Pfam Name: PLDc Pfam Description: Phospholipase D Active site motif
  misc_feature: SWISSPROT Homolog: EC 3.1.4.4 Phospholipase D
MLVWDDRTSVGLLKKDGLMATHDEETANYFHGTDVNCVLCPRNPDDSGSFVQDLQISTMFTHHQKIVVVDHELPNEGSQQRRIVSFVGGIDLCDGRDTWNVQLFRSIDGGAAFGFPETPDEAARAGLVSGKDQIIDRSIHDAYINAIRRAKKLIYIENQYFLGSSYDWEAESIKPEDIDWSHLIPKELSFENVSKIEAGERVTFYVVVPCWPEVVQ

SEQ ID NO: 78992 - DNA, 1161 bp, Zea mays
  misc_feature: Ceres CLONE 1563998
  misc_feature: Encodes the peptide sequence at SEQ ID NO. 78993
ccccgcggtggcggccgctctagaactagtggatcccccgggctgcaggaattcgtctcacccctagaaaaagttgcctctcgcatttgccccgctgcccacgcccgcagcgcctcgcctcggctgctctacctctatcccgcgacccgcgagatcggaatcgcggcgccccgtcgccctcctccaaaatggcgccgtctctgctcggggggttcaccaagtcgttggccatgacggtgctctccgagatcggggacaagaccttcttcgccgccgctattctggctatgcgccatcccaggaaactcgtattggcaggctgttttactgcactaatagtcatgacagctctatcggcttctctagggtgggttgcaccaaatctgattccccctaaatggactcatccttttaaccactctaattgttctttccaattgggcatttgagtcatttgtggggaagggcttccaaggaaagatgggaaattccggaagaaatttggcttgaaagtttgaagcccaaaacctgggatggcctggcctcttaaaaaaggtaataaaaaggtggaatccccaaaaaaattaaaatttttatagggcggaattggattggtatttggaaagaaaaccacggccaataggaacccatttttccccccagtgcgaatagttccttttccccacccccaatatttttttccctgagaagggggaacttttttccccaatcttacacactctcctcttttgtgggaggaagaacgggggggcgtggaacacaaggagagcccacataattgtggctttcaacattttgggagccttggagcctgcgccgtaatatataaaaaccaccctttctcgcgggtgttgtttcccccggggcgtgagaataaccttaggccgcgtaaggaccctccctgcgacaaaataacggtttggcccgtgttatttgggggggagaaaaagaacctctgtggccggcccaatattatttctcaaaaaatagggggtttagaaacgtcttaccggggagtgggttctcctccgcggctctctgaggaagatttgggctccttttccccgcggtggcacaaagaaggagaattttattcccccgcggggaggctcttttttccatgtaaaggaaaaacaggcc

SEQ ID NO: 78993 - protein, 86 aa, Zea mays
  misc_feature: Ceres CLONE 1563998
  misc_feature (9)..(76): Pfam Name: UPF0016 Pfam Description: Uncharacterized protein family UPF0016
MAPSLLGGFTKSLAMTVLSEIGDKTFFAAAILAMRHPRKLVLAGCFTALIVMTALSASLGWVAPNLIPPKWTHPFNHSNCSFQLGI

SEQ ID NO: 78994 - DNA, 855 bp, Zea mays
  misc_feature: Ceres CLONE 1563999
  misc_feature: Encodes the peptide sequence at SEQ ID NO. 78995
ggagctccccgcggtggcggccgctctagaactagtggatcccccgggctgcaggaattcgtctcacccctagaaaaaaccaccacttctcaactttatatgcgattgctctccaccgacgcgggcgccacgcatatcaacaacccggtagcaagagagcaaccagaaagctcagccgcacatccctactgccacgacatcgaacgccatggccaattcggaatagcaccgtccagcggaggaggaggaggccccggtggccggcgagaatgaggacaccggcatcccacttcgcgcccgtcgtgaaggtggaggaggtctccgttaccaccggagaggaggacgagtacgcgctcttggacatgagggcgaagctctaccggatcgacaaggaggggaaccagtggaaagagcacggcacaggcactgtgaagttgctcaagaacaaagacaccggcaaggtccgcctcgtcatgcgtcaggcgaagacgcttaagatctgcggcaaccatctcgtggtggagacgattaagatgcacgagcactgctggagcgacaagtcgtgcgtgtggcacgcactggacttcggcgaccgcgagctcaaagatgatatgtttgctatccgttttggatctgtcgagaattgcaagaacgtcaacgactctgcttgaagagatatgctgacatgcatgaaagagccagcagaaagaatatgatgcagtctccactgccgcttctgatttgccacagaagttaacagtggcagagcccccccacgtagtacaatgtcgagaatgaggaggctcctgcgttcgatgataagatagatgattacgagtgaacggtgacagccat

SEQ ID NO: 78995 - protein, 133 aa, Zea mays
  misc_feature: Ceres CLONE 1563999
  misc_feature (18)..(129): Pfam Name: Ran_BP1 Pfam Description: RanBP1 domain
MRTPASHFAPVVKVEEVSVTTGEEDEYALLDMRAKLYRIDKEGNQWKEHGTGTVKLLKNKDTGKVRLVMRQAKTLKICGNHLVVETIKMHEHCWSDKSCVWHALDFGDRELKDDMFAIRFGSVENCKNVNDSA

SEQ ID NO: 78996 - DNA, 939 bp, Zea mays
  misc_feature: Ceres CLONE 1564001
  misc_feature: Encodes the peptide sequence at SEQ ID NO. 78997
  misc_feature (423)..(423): n is a, c, t, g, unknown, or other
  misc_feature (427)..(427): n is a, c, t, g, unknown, or other
  misc_feature (428)..(428): n is a, c, t, g, unknown, or other
  misc_feature (440)..(440): n is a, c, t, g, unknown, or other
  misc_feature (576)..(576): n is a, c, t, g, unknown, or other
acccgcggtggcggccgctctagaactagtggatcccccgggctgcaggaattcgtctcacccctagaaaaagcagagcccagagtccgcccgtgacaacccgtagcgtctctgatctctctcgtgactcccggtccggaggagcacaggcatggagctggagcagaagccgccgccgccgccggcggggtactggagcggcgtggcgggcgggcgcccctgcgacgcgtgcgccgcgcggccggcgcggctgcactgccgcgcggacggcgcgttcctgtgccccggctgcgacgcgcgggcgcacggcgccgggtcgcggcacgcgcgcgcgtggctgtgcgaggtctgcgagcacgcccccgccgtcgtcacctgccgcgccgacgccgccgcgctctgcgcccgctgcgacgccgacantcannctcgcaactcgntcgcgcgcccgcacgagcgcctccccgtggcgcccttgctcggcgcgctctccgacgcgccggcgccgcaacacttcccctcccgcggcgcggcagcggggggagtagcgtccgcggcggaggaggaagacggganctacaggcctaggcggggtcctggttgccccccgagcccaaaaaagcccgaggaaagggccccccccaattctttttttgggaccggaaccgtaccctggggtttaactggattcgcccgggggcgggaaagggttaaaggcattgggggtgccgggaaccccggccccccttaaaggggaaagggtggcgggggtttttttttccccaaacttcttaaaaacgagggggcccccccctgagagggggggttaaaggggaaaaaacgggggcgccctttattcctcccttaaaaaaaaaaaacgggggttaaaaaaacaccccccctccccccaggggtgccacaaaacaacccccttagggg

SEQ ID NO: 78997 - protein, 199 aa, Zea mays
  misc_feature: Ceres CLONE 1564001
  misc_feature (19)..(63): Pfam Name: zf-B_box Pfam Description: B-box zinc finger
  misc_feature (91)..(91): Xaa is any aa, unknown, or other
  misc_feature (92)..(92): Xaa is any aa, unknown, or other
  misc_feature (93)..(93): Xaa is any aa, unknown, or other
  misc_feature (97)..(97): Xaa is any aa, unknown, or other
  misc_feature (142)..(142): Xaa is any aa, unknown, or other
MELEQKPPPPPAGYWSGVAGGRPCDACAARPARLHCRADGAFLCPGCDARAHGAGSRHARAWLCEVCEHAPAVVTCRADAAALCARCDADXXXRNSXARPHERLPVAPLLGALSDAPAPQHFPSRGAAAGGVASAAEEEDGXYRPRRGPGCPPSPKKPEERAPPNSFFGTGTVPWGLTGFARGRERVKGIGGAGNPGPP

SEQ ID NO: 78998 - DNA, 828 bp, Zea mays
  misc_feature: Ceres CLONE 1564002
  misc_feature (41)..(41): n is a, c, t, g, unknown, or other
  misc_feature (83)..(83): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (326)..(326): n is a, c, t, g, unknown, or other
  misc_feature (327)..(327): n is a, c, t, g, unknown, or other
  misc_feature (361)..(361): n is a, c, t, g, unknown, or other
tccccgcggtggcggccgctctagaactagtggatcccccngggctgggcaggaattcgtctcaccctctagaaaaagtcccntctcctctcgagaagcacccgcaccatacatcttccggcgcccgacgcggacggcgagccgctgctgctgctgccgccggaggaggaagggcaccagggcctagcgggtgcaggnnnaggaggaggagcagcagcaggccgccggccgcttggggctgtgccacatgccgctctgggggggcccgcgcgtcgcggcgccggcagccgacggcgacgccgcccgcgcgccgtcgggatccggcnngcgcgtcagggtgatcccggtcgctggctccccnacccgggggccccccctccgccctagaatcgcccgcccaagttctaacttcccaattgaaccccgggcaagcaaatccgggaaccggggtccgggttcgaaaacttcgccagggtcccccgggggccctttcaggtttccaaacgcgttggccccaaaaagagtttcttcttttgggccccccccggggggggggggtttttttctccccgggggaaaaactcttttccacccccgttttttttaaatttttttgggggccccccccgggaaaaaaccccaaaaaaaccccctggggaaacaagtgcgggggggggaaatttataaaaaaatttcccccccccaaaaaaaaaaaagggggggggggggggggaggaccccccccccccacatcttttttttttaaaaaaaaaagaacaaaaacccccccgcggccccccaacaaaaaaaaaaggggggggggagggt

SEQ ID NO: 78999 - DNA, 923 bp, Zea mays
  misc_feature: Ceres CLONE 1564003
  misc_feature: Encodes the peptide sequence at SEQ ID NO. 79000
ccgcggtggcggccgctctagaactagtggatcccccgggctgcaggaattcgtctcacccctagaaaaagtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggctacgggaccgtgggcgggcccaacggccacgccatcgctcccgccacagacaccaagtccaccgccgtcgagaccaccgtcgagagggtgatcttcgacttccggttcctggcactcctcgccgtcgccgggtcactcgccggctccgtcctgtgcttcctcaatggctgtgtcttcatcaaagaggcgtaccaggtttactggtcgagctgtgtcaagggggttcatacggggcagatggtcctcaaggtcgtcgaggccatcgatgtgtatcttgctggaacagtcatgctgatatttgggatggggtctctacggcctcttcatcagcaacgctcccgccggtgttcctcctgaatccgacccgtgcctcagcggctcgtcgtttgttcgggatgttcgctttgaaggaacgcccgaagtggatgaacatcacctcgcttgacgagcctcaagacaaaagtggggcacgtcatcgtgatgaatctaactgttgagatgttcgaaaagagcagaatggtgacgatagccacggggctggacctcctcagctactcgatctggattcttctgtgtcgcagcgtctctctaaatcctgaacaatctta

SEQ ID NO: 79000 - protein, 176 aa, Zea mays
  misc_feature: Ceres CLONE 1564003
  misc_feature (88)..(175): Pfam Name: UPF0114 Pfam Description: Uncharacterized protein family, UPF0114
MALLLLRGCAAPPAVHAAPAGSRLLPPALPRRRLVAVASSASSAPSGEVASSSQDGRGYGTVGGPNGHAIAPATDTKSTAVETTVERVIFDFRFLALLAVAGSLAGSVLCFLNGCVFIKEAYQVYWSSCVKGVHTGQMVLKVVEAIDVYLAGTVMLIFGMGSLRPLHQQRSRRCSS

SEQ ID NO: 79001 - DNA, 945 bp, Zea mays
  misc_feature: Ceres CLONE 1564005
  misc_feature: Encodes the peptide sequence at SEQ ID NO. 79002
  misc_feature (574)..(574): n is a, c, t, g, unknown, or other
  misc_feature (721)..(721): n is a, c, t, g, unknown, or other
  misc_feature (727)..(727): n is a, c, t, g, unknown, or other
  misc_feature (738)..(738): n is a, c, t, g, unknown, or other
  misc_feature (739)..(739): n is a, c, t, g, unknown, or other
  misc_feature (848)..(848): n is a, c, t, g, unknown, or other
  misc_feature (849)..(849): n is a, c, t, g, unknown, or other
  misc_feature (872)..(872): n is a, c, t, g, unknown, or other
ctccccgcggtggcggccgctctagaactagtggatcccccgggctgcaggaattcgtctcacccctagaaaaactcccccgtgcctcacggtcgacagctacctggccgagccaccatcaaagcgccagtacaccagtacctatgcattgctagcagctagctcgagtccgctcccaccgtacccactgccagtgccacaccacgcgtacgccatggcgccgtcgccggcggcggtcgcgcacggcgagggcgcgagcgccggcggcgccgtgtgctgcatgtgcggcgaccgcggcctgccgggcgagctgttccggtgcaggtgctgccgctcccggctacagcacaggtactgcagcgacctgtacccgagggcggccgcgtaccggcggtgcaactggtgcctgcgggagccggggccgggggtcggccaagcgggcctgggccatgcccatgccgcggcggtatttgcggctaacaacaagcagcccgaggatgataaacggaagaccacggcggcagcgacggacgaggagcggcggcagcgccacgaccacgatgggtgctccccngaagatgttgtcgccgccgcggccgcctgcggagctcggaacaccggtgaagaagagcacagggccgaagaagagacgccgccgccgcccgctgctgtggcggctaaacacagggccgaggatggtaaacggaagaaacacgcggcngcgtcngactaagagcnngcgcggcagcgccacgaagggtgctcccgaaccctgaagaagtcgtcgccgccgcctgcggagctcgtacacccggtgaagaagatcacaggggcgaagagataccccnncggctgtctaaggggaaggtgcnggtgaacaaggtctgcagggtgcggcggtacaagcctctcgctgaagtcatcagctgctgaatagctactgcc

SEQ ID NO: 79002 - protein, 172 aa, Zea mays
  misc_feature: Ceres CLONE 1564005
MAPSPAAVAHGEGASAGGAVCCMCGDRGLPGELFRCRCCRSRLQHRYCSDLYPRAAAYRRCNWCLREPGPGVGQAGLGHAHAAAVFAANNKQPEDDKRKTTAAATDEERRQRHDHDGCSPEDVVAAAAACGARNTGEEEHRAEEETPPPPAAVAAKHRAEDGKRKKHAAASD

SEQ ID NO: 79003 - DNA, 962 bp, Zea mays
  misc_feature: Ceres CLONE 1564007
  misc_feature: Encodes the peptide sequence at SEQ ID NO. 79004
  misc_feature (962)..(962): n is a, c, t, g, unknown, or other
gcggtggcggccgctctagaactagtggatcccccgggctgcaggaattcgtctcacccctagaaaaaacttcctatcgccatctctccccctttcgtcatccttctctctcctctgccatcgcgtccgccgccccaccgccatccgcgccgaagctgaagtgcggcctccgctacctgtctccgcggcggagtcagagccccctgacgccggcgctgtggaagccgaaggtcagggacccgtggagctccgcgctccgacgctcttctcgactgatgacaatcccaccccgctccagactgccaccagtctcctcctcaccggcgccatctcggtcttcctcttccgcgccctccgccgccgcgcccgccgcgccaaggagctcacactgcggtcgagcgggttgaagaagcccaacaatctcaccgaggaggccctggagaggctgagattgatgagcgcctcaccgatcgagaccgagaaggcaacttcgcccatccaggctctgctcggcgggattgcggcgggggtcatcgcactcatcctctacaagttcagcaccacagtcgaggctgcgctcaaccgtcagaccatctccgacggcttctcggttcgtccgattacaatcccaataagaacaattgtcactgggctgtgctacctagcaacttctgtcttttggaaccatgccggggggattagtttttgttttccccccaacctcactttacaatccattctgggacgatgaccccccgctcttccccgggggaagattagtgaaccatctaaaaccccgggcatctcctggttggcccccccagttgcagggaaaccgaacagtgttggcatggcaattccctgaccaaaagtaaaaccccccctaaaaaccgaacctgaacttgtatccctaaccgcccaaacccgaaaatccggagggaactatgcgggagaaaaccccn

SEQ ID NO: 79004 - protein, 98 aa, Zea mays
  misc_feature: Ceres CLONE 1564007
MSASPIETEKATSPIQALLGGIAAGVIALILYKFSTTVEAALNRQTISDGFSVRPITIPIRTIVTGLCYLATSVFWNHAGGISFCFPPNLTLQSILGR

SEQ ID NO: 79005 - DNA, 902 bp, Zea mays
  misc_feature: Ceres CLONE 1564008
  misc_feature: Translation starting site: 169
  misc_feature (551)..(551): n is a, c, t, g, unknown, or other
  misc_feature (562)..(562): n is a, c, t, g, unknown, or other
  misc_feature (563)..(563): n is a, c, t, g, unknown, or other
ctggagctcaccgcggtggcggccgctctagaactagtggatcccccgggctgcaggaattcgtctcacccctagaaaaaacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggnctgtcctggcnngacatggcaggctgaaatatattgaacgcatttgcgagagatttgttgatttgactatgggaacataaggggaagatgaaggttgtggtcagggacagttatttccctcccccagggaagaggagaaagaactcaggaaacctttgcaggaatccctgggggaaaacaaacttattttggttaaaccaaaattgactacggcttcgggggaggatttgggattaatccggggcaaaaggtcttttattcctaatcggaaaggggcgaaacaaaggggggggttttttggggcaaccctttatttttaaaacccttttgggaaaaaaaaaactttccgga

SEQ ID NO: 79006 - DNA, 872 bp, Zea mays
  misc_feature: Ceres CLONE 1564009
  misc_feature: Encodes the peptide sequence at SEQ ID NO. 79007
  misc_feature (353)..(353): n is a, c, t, g, unknown, or other
  misc_feature (354)..(354): n is a, c, t, g, unknown, or other
  misc_feature (375)..(375): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (815)..(815): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
ggagctccccgcggtggcggccgctctagaactagtggatcccccgggctgcaggaattcgtctcacccctagaaaaagcgtgcacaggatttcctcctaaagatcgatcgcagactttacttaggccgtcacaaggagaccctcctcagccgctagtaccagtagtcgtcgcgttagcaggcagatctgagttagccggcggatccgatccgtgcgcgtgcagtgtacgtgtgtcggtggagatggccacagcttacgctcccatggcgagccaggtgatgaagagcagcctcgtcgtgcactcgaggccgaggggcctgtcaggcgctgctgcgctcacgaggcggccgcnnggttcaccgtcaagggcccanttccagccccgagaaagggaccttaacccggtggtgcaaacccattaaagggggaaccccttttttttggaaacccttggaaaaaaaccccggggttaaacctctaaaccccccctttttttttggggggggggggggatttttttttaaaaaaaccccggggggggaaaaaaaaaaaaaaaccccttgtgggaagaacccccccctctttttggggggggggggggaaaaaaaaaaagaaatttcttcccccccccaagggaagaaaacaatcctctccctttggggggggggggggggttttttttttttttagaggggggggggggggcccctcccccaaaaaaaaaaaaaaccctttttttttttttaaaaaaaaaaaaagggggggggggggggggttttttttttttttttnnnnnccccccctcccccccccncnnnnacaccccccccccacaaaaaaaaaaattggggcttgtcccccaccaaaaaac

SEQ ID NO: 79007 - protein, 59 aa, Zea mays
  misc_feature: Ceres CLONE 1564009
  misc_feature (37)..(37): Xaa is any aa, unknown, or other
  misc_feature (44)..(44): Xaa is any aa, unknown, or other
MATAYAPMASQVMKSSLVVHSRPRGLSGAAALTRRPXGSPSRAXFQPRERDLNPVVQTH

SEQ ID NO: 79008 - DNA, 1013 bp, Zea mays
  misc_feature: Ceres CLONE 1564012
  misc_feature: Encodes the peptide sequence at SEQ ID NO. 79009
  misc_feature (356)..(356): n is a, c, t, g, unknown, or other
ctccccgcggtggcggccgctctagaactagtggatcccccgggctgcaggaattcgtctcacccctagaaaaagtttgaagctagaggtgtcgacccttcgtcccgcatcgtttcctcctcctttttccccgttcgtcccctggattggcgtctacccggcgcgacccggaccgaatcctaagtccgcctgccgccgccgccgccggctcccgttggaaacgagtttggagtaaagaaaccaaccttgcatctgtgttctgtctgtctatgctgctttgctttggattcacaaaaaaataagccttgcatctcactgacttgagataactatgcctaaggacaggagctcccgcngttcctctcacgagagccgccaggctcgtgcctccccatacttgtcagcgtctcatggacagagcagttcttcacgcccgtcacaagagtcctctggcggccgcgcagcgaaccaagctgcaaagggggaagatgttcgggggcccgtcctgcatgggacacccgcaacaacccggcccggcgggtcggcccctcccacagaaaaggcctgcccgcccctttttttgggaaaccggttccgggggaccccatttttgtttaacccgtacccggaaggggcccccaggagcctccccccagggtttcggggaaaaaaagggcgccggggggcccccccgagggtgccccctcctttggcccccttgttgcggggggggccctccccggccgtctcttttaggtacccccccccccggggtgttttaaaaaacccgggggggccgcgccccacaaaaaagccccgataattggggggggccccccacaaaagaagaaaaaactgtggggggagcacccccccgggcggccggggagggtaccacccctccaccgggttgtgccgcggggaatacacacccgcccccaaaaaataaaagaagggcggggggggcccccccctgtaagaaacacccctcttctccccacaagagagaaaaa

SEQ ID NO: 79009 - protein, 163 aa, Zea mays
  misc_feature: Ceres CLONE 1564012
  misc_feature (9)..(9): Xaa is any aa, unknown, or other
MPKDRSSRXSSHESRQARASPYLSASHGQSSSSRPSQESSGGRAANQAAKGEDVRGPVLHGTPATTRPGGSAPPTEKACPPLFLGNRFRGTPFLFNPYPEGAPRSLPPGFRGKKGRRGAPPRVPPPLAPLLRGGPSPAVSFRYPPPRGVLKNPGGPRPTKKPR

SEQ ID NO: 79010 - DNA, 853 bp, Zea mays
  misc_feature: Ceres CLONE 1564013
  misc_feature: Encodes the peptide sequence at SEQ ID NO. 79011
ctccccgcggtggcggccgctctagaactagtggatcccccgggctgcaggaattcgtctcacccctagaaaaaatctccggcctcacaccgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctggtcgacgcggaggagctcacccagtggtccctgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcgtgggccttcggcggaatgatcttcatcctcgtctactgcaccgccggcatctcaggtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttccagagcgcctattacgtgcgctacggcggcggcgccaacgagctcagcgacggctactcccagggcacccggctccgccgccgagatcatcggcacgtttcgtgcttcgtctaccacgtatttctcgcccacgaccccaaagcgcagtgcccgtgactccccaccgtccggggctagctcctccttccaattggggtccccccgggttcatggtggccacctggccacccc

SEQ ID NO: 79011 - protein, 201 aa, Zea mays
  misc_feature: Ceres CLONE 1564013
  misc_feature (33)..(194): Pfam Name: MIP Pfam Description: Major intrinsic protein
MAKDIEASGPEAGEFSAKDYTDPPPAPLVDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIVAQCLGAICGVGLVKGFQSAYYVRYGGGANELSDGYSQGTRLRRRDHRHVSCFVYHVFLAHDPKAQCP

SEQ ID NO: 79012 - DNA, 927 bp, Zea mays
  misc_feature: Ceres CLONE 1564015
  misc_feature: Encodes the peptide sequence at SEQ ID NO. 79013
  misc_feature (702)..(702): n is a, c, t, g, unknown, or other
  misc_feature (750)..(750): n is a, c, t, g, unknown, or other
ctccccgcggtggcggccgctctagaactagtggatcccccgggctgcaggaattcgtctcacccctagaaaaaatcagcctcatcaacctcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacatcaccgcgggcgaccccgacctagcgacgacggccgaggcgctgcggctgctggacggctgtggcgccgacgtcatcgagctgggcgtgccctgctcggacccctacatcgacgggcccatcatccaggcgtcggtggcgcgggctctggccagcggcaccaccatggacgccgtgctggagatgctcagggaggtgacgccggagctgtcgtggcccgtggtgctcctctcctacacaagnccatcatgtctcgcagcttggccgagatgaaagaggcgggggtccacngtcttatagtgcctgatctcccgtacgtggcgcgcactcgctgtggagtgaagccagaacacaacctggagcggtgctgctgacacaccagcatacagaagacggatgaaggagatcacagcttcaaaggctctcctactgggagcgtgacggatgacagtctcgcgcaactgaacc

SEQ ID NO: 79013 - protein, 105 aa, Zea mays
  misc_feature: Ceres CLONE 1564015
  misc_feature (1)..(104): Pfam Name: Trp_syntA Pfam Description: Tryptophan synthase alpha chain
  misc_feature: SWISSPROT Homolog: EC 4.2.1.20 Tryptophan synthase
  misc_feature (96)..(96): Xaa is any aa, unknown, or other
MAALMAKGKTAFIPYITAGDPDLATTAEALRLLDGCGADVIELGVPCSDPYIDGPIIQASVARALASGTTMDAVLEMLREVTPELSWPVVLLSYTXPSCLAAWPR

SEQ ID NO: 79014 - DNA, 863 bp, Zea mays
  misc_feature: Ceres CLONE 1564016
  misc_feature: Encodes the peptide sequence at SEQ ID NO. 79015
  misc_feature (769)..(769): n is a, c, t, g, unknown, or other
  misc_feature (770)..(770): n is a, c, t, g, unknown, or other
  misc_feature (780)..(780): n is a, c, t, g, unknown, or other
  misc_feature (801)..(801): n is a, c, t, g, unknown, or other
ctggagctccccgcggtggcggccgctctagaactagtggatcccccgggctgcaggaattcgtctcacccctagaaaaaaaaaccgcgtctcgcgcgaagaatccgcatttccccttccccgcaccgcaccgcacccaacccccgtcggagagagagatggcatcggtggcggagatgcagcccctcgcgccggcggggtaccgccgcgcgccggagatgaaggagaaggtggaggcgtcggtggtggacctggaggccgggaccggggagacgctgtacccggggatctcgcgcggggagagcgccctccgatggggcttcgtccgcaaggtctacggcatcctcgctgcgcagctgctcctcaccaccgccgtctccgccctcaccgttctccaccccaccctcaacgccacgctctccgactccccgggcctcgcgctcgtgctcgccgtcctgcccttcatcctgatgatcccattgtatcattatcagcacaagcacccacacaattccgttttcctgggtctgttcacgttgtgcttgagcttcagcatcggcgtggcttgtgctaacacccaagggaaaatcgttctggaggctttagtgctgacggctggcgtggtggtttcgctgactgcgtatgctttctgggcgtcaaagaagggcaaggaattcgggtacctggggcctatcctgtcttccgcgcttactatcctcgtcctaactagcttttcttcaggtttttctcccactggggacccgtgtcnngtgggcttgnttcgggtgggctagggggctnctggtcttctcaggctttcatcctgtacgaaccccgaggacctgatttaggcgcaccccctc

SEQ ID NO: 79015 - protein, 211 aa, Zea mays
  misc_feature: Ceres CLONE 1564016
  misc_feature (204)..(204): Xaa is any aa, unknown, or other
  misc_feature (208)..(208): Xaa is any aa, unknown, or other
MASVAEMQPLAPAGYRRAPEMKEKVEASVVDLEAGTGETLYPGISRGESALRWGFVRKVYGILAAQLLLTTAVSALTVLHPTLNATLSDSPGLALVLAVLPFILMIPLYHYQHKHPHNSVFLGLFTLCLSFSIGVACANTQGKIVLEALVLTAGVVVSLTAYAFWASKKGKEFGYLGPILSSALTILVLTSFSSGFSPTGDPCXVGLXRVG

SEQ ID NO: 79016 - DNA, 898 bp, Zea mays
  misc_feature: Ceres CLONE 1564017
  misc_feature: Translation starting site: 379
  misc_feature: SWISSPROT Homolog: EC 2.1.1.128 (RS)-norcoclaurine 6-O-methyltransferase
  misc_feature (820)..(820): n is a, c, t, g, unknown, or other
gcggtggcggccgctctagaactagtggatcccccgggctgcaggaattcgtctcacccctagaaaaacgtcgtcgagcaaccaccagcaggtggtggtgatgattcaaccgtccacacgtcggacgacgaagctgtcgtcgtctacaggttgacggcagcctcccgcttcctcgtcagcgacgacgtgagcacggcgaccttggctccctttgtgagtctggcgctccagcctatcgctgcctgtccgcacgccctgggtatctccgcgtggttccggcaggagcagcacgagccgtccccgtatggcctggcgttccgccagaccccaacgatctgggaacatgctgacgacgtaaacgccttgctgaacaaaggcatggccgcggacagccgcttcctcatgccaattgtgctgagggagtgcggcgagacgtttcgtgggatcgactcgttggttgacgtcggtggtggccatggtggcgccgccgccaccatcgccgccgccttcccccacctcaagtgcagcgtgcttgacctcccgcacgttgtcgccggtgctccgtctgatggcaacgtgcagttcgtcgcaggcaatatgtttgagagtattcacctgcaaccgctgttttcctcaagataactctacatgactggggtgacgatgagtgtgtcaagatattgaaagaattgcagcaagccatatctccacgggatgcaggtgggaaggaataatcctgggatgtggtagttgggatattaacagtcaaacattaagcatcaagagacaccagttatgttttgatttggatatgaatggngggttaaccgagttgagcgtgacgagcaagagttggaagaagaatctccctggagcctggatcaaaaactacaaaatc

SEQ ID NO: 79017 - DNA, 1030 bp, Zea mays
  misc_feature: Ceres CLONE 1564019
  misc_feature: Encodes the peptide sequence at SEQ ID NO. 79018
ggagctcaccgcggtggcggccgctctagaactagtggatcccccgggctgcaggaattcgtctcacccctagaaaaagtcggagaccccaaacctctgtcgaaagtttcacctccggtcgctggtttcctccaatctccgtggtagttcagcgcgagcgggcggcggggtttgagctcgatggtcacttccggcgaacaatcggctggcggcgggtctgcggcgagggcgtcgaagctgcggtacccgctgcggtcggcgagcaaggggaaggcggcggtcgtttccccggcggctgatgctcctcccaccatctctgctccgcgacgggcaaaaccatcttcagatgtcagcaagagcatgtgtttagacctttctgtgaaggataattctgcccaacccccacggaggcactcaatacaaaacaagccaggagctagcccaagggccaacacccttctggaactggtgactccgggtgtctgggggttcggttcaaagaggtcgggaaagcccaggggaggttttgatacccccgacatcagaaagtgtcccttgtcccatcctcaagggcgcaagtttcagcacggctttccttcaatcctcgtactggatggacacagatccaggctgggcagaagcctgctttccaaagcacctccggttttctctggggccttctttaaagccttgctccttggaatcaaaaatggtgagccctttgggaccgggattgaggggaaaaacctcaagtccctaccttagcacgggcttgggcctggtcaacaagaattgggaggaacccagtttaaggaacattccccacaggtttaatgaaatttttggaaagatttttgagaaaaccgaaaaaatccctggcgaaagccctccccacgcacccaaaaaattctgaaaaaggggtgcccttactggcccaaattgggttccccaaagggttacccgtaaaccaaggggcccggtaaccctgagtccaccgtaaagcaaggaaaccgttaaaaaaagaaacctt

SEQ ID NO: 79018 - protein, 194 aa, Zea mays
  misc_feature: Ceres CLONE 1564019
MVTSGEQSAGGGSAARASKLRYPLRSASKGKAAVVSPAADAPPTISAPRRAKPSSDVSKSMCLDLSVKDNSAQPPRRHSIQNKPGASPRANTLLELVTPGVWGFGSKRSGKPRGGFDTPDIRKCPLSHPQGRKFQHGFPSILVLDGHRSRLGRSLLSKAPPVFSGAFFKALLLGIKNGEPFGTGIEGKNLKSLP

SEQ ID NO: 79019 - DNA, 1016 bp, Zea mays
  misc_feature: Ceres CLONE 1564023
  misc_feature (368)..(368): n is a, c, t, g, unknown, or other
  misc_feature (369)..(369): n is a, c, t, g, unknown, or other
  misc_feature (373)..(373): n is a, c, t, g, unknown, or other
ctccccgcggtggcggccgctctagaactagtggatcccccgggctgcaggaattcgtctcacccctagaaaaaggaacggaacctccctcagtctcaggcgagcgagcaagcgcggctcacgtccacagggccagcgacagtaggctgtaggccccgcccgctccagatccataggcagccgtgcgcgatcgcggcgtggtggataaaagcgtgcgcgcgcgcgctgccgcgagggaagagaggcgggacgagcgtcagtgcagtgcgcgtgtggtcgggtagcgatccgaggagcgcgcagcgatggcggcggcggccgtggcgactgtgggcaccccatcccccgcttcaggcggctggttcccnntcgncgggccgtctctttctcgggctccaaggccgaacacgcggctcaagcgcgcccctgcgggtccgccgcggcggggggatgaaacggaattgcttccctggcccggggggccaagggggaagcccttggttccccgggaagtttggaggacacacgggagaaaaaaacttgggcggaaacccacccccaaatccgaaggggccccccttcccgggggaaatggggggggggggtttccccgggggggggaaagggtccccgggggtctccggggggggggggggggaacaaatatggggggaccggggggatttaaaaagggccctttggtgggggggggccaaccccaaacgcgcccccaaagggtttttcaccgtaaaaaaaaaaatggggggggggggagggaatttttagaaccccgcccctttttgggggagaaaacagggtgggcccctcagagagaggccccaacaaaccaccgggtgttacaaaaaataagaaaagaggggcgcctccccccccggggtgggggtgttgccccccccaaaaagaaaaaaatatttttttctcccccctttttctttccccgccgcgtttttgttcccctcgtggggctctttctcacaccaaaagagggggggcgc

SEQ ID NO: 79020 - DNA, 666 bp, Zea mays
  misc_feature: Ceres CLONE 1564025
  misc_feature: Encodes the peptide sequence at SEQ ID NO. 79021
  misc_feature (384)..(384): n is a, c, t, g, unknown, or other
  misc_feature (432)..(432): n is a, c, t, g, unknown, or other
ctccccgcggtggcggccgctctagaactagtggatcccccgggctgcaggaattcgtctcacccctagaaaaagcctcacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttnccgcggccgagcagcaggcagcccgcgaggcggagggccgccgctccntgctgggtgccgaagaagcccgttcgcgggccgaaacccggtcgcccaaagcggaggctgctggctcctggtggggcccgaaggaaacttccttcggttcaacaaggaagggaacccccccaaagaaagaaggctggcctgcctgctccctccccggggggggggcccaaagggaaaccccgcccccgggggcccaaaaacccctggtttccccccaaagaggccaaaaagggg

SEQ ID NO: 79021 - protein, 146 aa, Zea mays
  misc_feature: Ceres CLONE 1564025
  misc_feature (53)..(53): Xaa is any aa, unknown, or other
  misc_feature (69)..(69): Xaa is any aa, unknown, or other
MATAEVQTPTVVAAEEAPVVETPPPAVVPEESAPAEAEAEAEAAAPADPEELXAAEQQAAREAEGRRSXLGAEEARSRAETRSPKAEAAGSWWGPKETSFGSTRKGTPPKKEGWPACSLPGGGAQRETPPPGAQKPLVSPQRGQKG

SEQ ID NO: 79022 - DNA, 964 bp, Zea mays
  misc_feature: Ceres CLONE 1564026
  misc_feature: Translation starting site: 153
acccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccgggagcgttcgcgcggaacagggcgctgggaggtgatccacgggcggtggggcgatgctggggtgcgctggcctgcatcacccccggagggtgctgaaaaagtggggtgccccgtggacttcaagggagcccgtggtggttcaaggcccggcgccgcagatcttcctcgaaggggcggggctggactacctggggcacccccaacctggggtgaccccccagaagaatcccggggccgggctcgggcttcccaggtcatccccatggggccctcggcaaggggtttcccgaataaaaaggcccttaaaggggttgggggagaggaaaaaaacctttacccggggggggagttattttaaccccgggggggctccccaaaaaaccccgtaacctttgcgaaggttagggtaagggagaaaaaaaacggccccccccccggggtcccaggttggggttttttagccagggctctttcccggggagggggccccctaaaaaatgtgtttaacccttgaaaacccccggcaaaaaagg

SEQ ID NO: 79023 - DNA, 875 bp, Zea mays
  misc_feature: Ceres CLONE 1564027
  misc_feature: Encodes the peptide sequence at SEQ ID NO. 79024
  misc_feature (624)..(624): n is a, c, t, g, unknown, or other
agctccccgcggtggcggccgctctagaactagtggatcccccgggctgcaggaattcgtctcacccctagaaaaagtcgtcgtcgcatcgcacgcaccatcgtcctgccgatcgatcgcagccagccagtcttgctgagagacgaactgaagcctgaagtgaaccgatcgatcgatcgatcgagcgagcgagctcccatgaaggcgttgattctggcggcggtgctgctgctgcagcacgggggagccgcgagcgccggcggcaacttctaccaggacgtggacatcacctggggcgacggccgcggcaagatcctcgacaacggccagctcctgacgctgtccatggacaggtcctccggctcgggcttccagtccaaggcccagtacctctacggccgcttcgacatgcagctcaagctcgtcccgggggactccgccggcaccgtcgccaccttctatctttcgtcgcagggttcgcagcacgacgagatcgacttcgagttcctggggaacgcgagcggggagccgtacacggtgcacacgaacgtgtacagccaggggaagggcgggcgggaacaacaattcccggatggggttcggaccccaggggggcctccacgnctaattcggggtggggaaaccggcccacgttgttctttaaggggaaggggttcccactccgggaattcgggcccccgggaaagggaccctgttcttttcccaattccaacccaagagggggtacccccccggtgggaccccgaaagagggcccccccagggggggggggtccccgaacacaatgttcaaaggcccttttttgcgttttaaacggggggtccccccccccgggggacccccgcgggaaaccc

SEQ ID NO: 79024 - protein, 211 aa, Zea mays
  misc_feature: Ceres CLONE 1564027
  misc_feature (24)..(161): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MKALILAAVLLLQHGGAASAGGNFYQDVDITWGDGRGKILDNGQLLTLSMDRSSGSGFQSKAQYLYGRFDMQLKLVPGDSAGTVATFYLSSQGSQHDEIDFEFLGNASGEPYTVHTNVYSQGKGGREQQFPDGVRTPGGPPRLIRGGETGPRCSLRGRGSHSGNSGPRERDPVLFPIPTQEGVPPRWDPERGPPQGGGVPEHNVQRPFFAF

SEQ ID NO: 79025 - DNA, 887 bp, Zea mays
  misc_feature: Ceres CLONE 1564030
  misc_feature: Encodes the peptide sequence at SEQ ID NO. 79026
  misc_feature (795)..(795): n is a, c, t, g, unknown, or other
  misc_feature (796)..(796): n is a, c, t, g, unknown, or other
  misc_feature (854)..(854): n is a, c, t, g, unknown, or other
  misc_feature (855)..(855): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (862)..(862): n is a, c, t, g, unknown, or other
  misc_feature (863)..(863): n is a, c, t, g, unknown, or other
ctgaagctccccgcggtggcggccgctctagaactagtggatcccccgggctgcaggaattcgtctcacccctagaaaaaagcagccagctcccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccgacgtgggcggagttcgagctcgggcgggcgccggtctactggaagaccagcagcggcctcccgccctcgccgggcgaggggctgaccctgttctacaacccggcggcgacgaagatggccccgaacgaggtgttcggcgtggcgttcaacggcggcttcaacctgcccatcatgtgcggcggagagccgaggcagatgacgctgcaggagcgggtcaaagccgacccgcccatctacaccatcaagatacgcgtgccgcagcacgccgtaagcttgatcttctccttcaccaacggggccgagtgggacggggcgtacacgctcaagttcaggggtccccaagcatggcagaacaagccgctgagctttctcacgagggcctggcggagannctcacagggaggcgcctgcggactggcatctacccgacgagacatcgcacacactcgnngnnnggnnccccctcccgaggggggggggggg

SEQ ID NO: 79026 - protein, 227 aa, Zea mays
  misc_feature: Ceres CLONE 1564030
  misc_feature (197)..(197): Xaa is any aa, unknown, or other
  misc_feature (217)..(217): Xaa is any aa, unknown, or other
  misc_feature (218)..(218): Xaa is any aa, unknown, or other
  misc_feature (219)..(219): Xaa is any aa, unknown, or other
MATLSSCSRLSSGTGAAAIHRQPARAGAVLVVTCRRSSSATVRAAAAATAAAPAAVELQNKGVSLPTWAEFELGRAPVYWKTSSGLPPSPGEGLTLFYNPAATKMAPNEVFGVAFNGGFNLPIMCGGEPRQMTLQERVKADPPIYTIKIRVPQHAVSLIFSFTNGAEWDGAYTLKFRGPQAWQNKPLSFLTRAWRRXSQGGACGLASTRRDIAHTRXXXPPPEGGGG

SEQ ID NO: 79027 - DNA, 890 bp, Zea mays
  misc_feature: Ceres CLONE 1564031
  misc_feature: Translation starting site: 133
  misc_feature (746)..(746): n is a, c, t, g, unknown, or other
  misc_feature (756)..(756): n is a, c, t, g, unknown, or other
  misc_feature (758)..(758): n is a, c, t, g, unknown, or other
  misc_feature (787)..(787): n is a, c, t, g, unknown, or other
ctggagctccccgcggtggcggccgctctagaactagtggatcccccgggctgcaggaattcgtctcacccctagaaaaaagccgtccccttcctccaccctctgccatcctcgcagtcacagcccctcaccatggctgccacactctcctccgtggctgccccttccctccccaagcacatccccgttaccagagctcagcagcaggcgcctccttccatcatctcggcatcaactaagactgccttccatggggtgtcgctggtggtggacaggaggtgggcggccggccaccggagaggcggcggccggcggaggctgctgcaggtgaacgcgaggaccgccgccaagaacatcgaggtggaggtcgagaagccgcttggcttagccttgggccagaagcccggtggtggcgtcgtcatcacttctgtggagtctggagggaatgcagccagagccggtctgaaaaccggggaccaggtcctgtacacaagcagcttcttcggagacgagctgtggcctgcggataagcttgggttcaccaagacagccatccaagcgaagtcagactccgtctacttcgtcgtgagcaggggtgccgaaagtgacgtgaagcgcctacctaagaggccggcgcccacccggtttggacggaagctgactgattcacaaaaggagagagcaacgcacgtctgccttgattgtgggtacatatacttcctaccccaagcttttgacgacagccngacgactacngntgcccacagtgcaacgcgccgaagaagcngttttgcgagtacgacgctgccaccggaaagggcatcgcggcgctctgccgcctatcgccctgatcgtaagtttggtgatcggcatcgctggggtagggagct

SEQ ID NO: 79028 - DNA, 904 bp, Zea mays
  misc_feature: Ceres CLONE 1564033
  misc_feature: Encodes the peptide sequence at SEQ ID NO. 79029
  misc_feature (491)..(491): n is a, c, t, g, unknown, or other
ctggagctccccgcggtggcggccgctctagaactagtggatcccccgggctgcaggaattcgtctcacccctagaaaaagagggatacatcatcagtacatggcccggcccggcccagagaggagcgcgcccatatcgcttccctgaggccgagagcgaagcggagcgagcaccggacgagaggcatggccatggcgcgggcggagctccgcaccgtgaccgtgcgctcttccccgcttccgcgctgcgtcctctcccggctgctgccgttgctcctctcagtctcagccatcggcgctgcgtctgcggcgccactaaagttcgggatcaactacgggcagattgcgaacaacctcccgcagccgacgcaggtgtcgggcctcctgcagtcgctgaacgtgaaccgcgtgaagctctacgacgccgaccccatcgtgctgacggccttcgccggcacgggcgtcgagttcatcatcggcaacgatgaccntctacacctgaccgacgcacgcaaggcccgggccctggtggcgcagcacgtcccagcggttcctccccagcaggcgcatcacctgcatcaccgggggcaacgaggtggctcttccggcaaggacccgaccgcctgcagagcctccttccggccattgcaaaccgggtaccaaggcctgggtcccccttgggcttggggggcagggtaaactttttcacggggccatcggggtaaaatctgtggcaagaataacccccccccttttggggcctttccggggagggctgggggggaaattccggcgaatttaaattttcccccgaggggggggtcccccttcttaaaaaaaggggaaccctttttttcccaaaaaggggaccccccggggggggggctcctccccaactcttttt

SEQ ID NO: 79029 - protein, 170 aa, Zea mays
  misc_feature: Ceres CLONE 1564033
  misc_feature: SWISSPROT Homolog: EC 3.2.1.39 Glucan endo-1,3-beta-D-glucosidase
  misc_feature (102)..(102): Xaa is any aa, unknown, or other
MAMARAELRTVTVRSSPLPRCVLSRLLPLLLSVSAIGAASAAPLKFGINYGQIANNLPQPTQVSGLLQSLNVNRVKLYDADPIVLTAFAGTGVEFIIGNDDXLHLTDARKARALVAQHVPAVPPQQAHHLHHRGQRGGSSGKDPTACRASFRPLQTGYQGLGPPWAWGAG

SEQ ID NO: 79030 - DNA, 893 bp, Zea mays
  misc_feature: Ceres CLONE 1564036
  misc_feature (223)..(223): n is a, c, t, g, unknown, or other
  misc_feature (226)..(226): n is a, c, t, g, unknown, or other
  misc_feature (240)..(240): n is a, c, t, g, unknown, or other
agctccccgcggtggcggccgctctagactagtggatcccccgggctgcaggaattcgtctcacccctagaaaaaattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtggtggatgtgccngcngtactggtggcgcnggcatgcggacgcctcccccagactaaggttccaacttcgtgggggcttcgtggcccctccaaaccgcctgttcctttattttggaaaaagggacctttttttttcccaaaaaaaaggggtcccccccccctgttttttccccaaaaaaaaggtgttcccttttaagggggggggggaaacaggggggggggggaacaccacaccgtgttttttttaaggagaacaaaaagttcctctcctataaaaaaaaaaaaaagggggcgcgccccccccccccccgggttttttttgttaaaacaaccattacccccttcttttttttttttaaaaaaaaaaaacacccctcttttttctaaaaaaaaagaagagggggttggttttttttttaaaaaaactcacaccccccctcttcactaaaaaaaataaatatatttagtgggggggccgctgtgcggccctccctcttttttctttttcggtggtggtgggggggggggaaaaacccacccttcacccccctaacaaaaataaacaaaattttggtgggtggctggtttgggtttcctttctccccccttttcccgtgtaagagtagtaggtggggcggttgttactttgtggggttggtattatttttcgccttccctccctc

SEQ ID NO: 79031 - DNA, 894 bp, Zea mays
  misc_feature: Ceres CLONE 1564037
  misc_feature: Encodes the peptide sequence at SEQ ID NO. 79032
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (653)..(653): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (690)..(690): n is a, c, t, g, unknown, or other
ctggagctccccgcggtggcggccgctctagaactagtggatcccccgggctgcaggaattcgtctcacccctagaaaaatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagaccaggtgttttttttttnnnnntntttttttttttttnnnnnttttttttttttttttttnggggaagggggttttggtggggggaaccctttgcggggggggtttgacccctccgcctctgggagaaacctatttcagtgaaccaaggacagggtgctgggatgcctaaggtcatcttaccacaggggataccggcagggtcaaggggggttttggttttcgtccccctatgggctctgcccgaggaaggtcaaccaatgccaa

SEQ ID NO: 79032 - protein, 199 aa, Zea mays
  misc_feature: Ceres CLONE 1564037
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (170)..(170): Xaa is any aa, unknown, or other
  misc_feature (171)..(171): Xaa is any aa, unknown, or other
  misc_feature (172)..(172): Xaa is any aa, unknown, or other
  misc_feature (177)..(177): Xaa is any aa, unknown, or other
  misc_feature (178)..(178): Xaa is any aa, unknown, or other
  misc_feature (185)..(185): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPRPGVFFXXXFFFFXXFFFFFFXGRGFWWGEPFAGGV

SEQ ID NO: 79033 - DNA, 926 bp, Zea mays
  misc_feature: Ceres CLONE 1564038
  misc_feature: Encodes the peptide sequence at SEQ ID NO. 79034
ctcaccgcggtggcggccgctctagaactagtggatcccccgggctgcaggaattcgtctcacccctagaaaaagcagctcattcgccgaggaaacgagatcctctagaggtttgtgctgtttagcgtgagtttttttggggccgatttgctttgctcgcatgggggatcatgtcgcggtggatgttggggagctcgtagcgtcccgagtcggtgaggcagcggggctagtgtccggcgccaaggaggaaacagaggcgctgattgggatggtggagtgccgcatttgccaggaggaggacctcaggaagaacctcgagagcccctgcgcttgcaacggcagcctcaagtatgctcacagagaatgtgtgcaacgatggtgcaatgagaaaggggatacaatctgtgaaatctgccatgagttgtacaagcctggttacactgccccaacccaggtgcatcatgatgaaactaccatagagataagtgggtggagattggaccatctctggcaaccgtttggatttacatgatccctagatattggcaatggctgctgctcaacaccgtctacttgaagacgactatgatggatatactgcaacaaacaacaacgctgctgcattttgccgctctatatttctgattttgatggcccctttgctcctggagcataccctgaccattactaacagcgatgatgaagatgatgcatctgctattttctcgctatttcttttgagagccgctggatttttgctgccctgctatattatggcttggggcattagtttctggcccgtcaaaaccaagacaggagtaagattgctttttccacgggaggggcgatcattctgcatcggaacggaaaacatgcatttgccgggccaccaccgaaacccctttctacctctccccaggcttacc

SEQ ID NO: 79034 - protein, 123 aa, Zea mays
  misc_feature: Ceres CLONE 1564038
  misc_feature (40)..(85): Pfam Name: zf-C3HC4 Pfam Description: Zinc finger, C3HC4 type (RING finger)
  misc_feature: SWISSPROT Homolog: EC 2.7.7.14 Ethanolamine-phosphate cytidylyltransferase
MGDHVAVDVGELVASRVGEAAGLVSGAKEETEALIGMVECRICQEEDLRKNLESPCACNGSLKYAHRECVQRWCNEKGDTICEICHELYKPGYTAPTQVHHDETTIEISGWRLDHLWQPFGFT

SEQ ID NO: 79035 - DNA, 884 bp, Zea mays
  misc_feature: Ceres CLONE 1564042
  misc_feature: Encodes the peptide sequence at SEQ ID NO. 79036
ctggagctccccgcggtggcggccgctctagaactagtggatcccccgggctgcaggaattcgtctcacccctagaaaaaagaactcgtggggaaggcgaagcgggacgatgcagcccaagatcagcgcgttcttcgagcggcaggagacggacccagatccgattagtggcgacggtgaggggaacgggcagggaaacgtcggcgcggcgacggaggcgaagcggaaggccaatggctgcaggctcgatgggctcgtcagcaagaagaggaactacgcgcagctccatctggagctagggcagcctgatttcgtcctccacacgtgctccgtgtgcggcatgatgtacgcccgagggaacgacgaagacgaaaaggttcacagggcgtaccacaagagctactccgagggagtccctttcaagggttggaaaaaagagacagtgatagcgaggtccgagggcggtgatcgggttgttcttgcaactgacgagaactcttgtatgtcgaaaagtaaggtcagagaggtgatcacagtggtggagaaggagctgggatttggtgaagggaaactcctgcataagctttgcaaggtgtatctatacatatctgcacaaaggatcgtggggtgccttgtcactgaaccgataaaacaggacatagagttatccccagctccacggaagggagccctaatgatttgccagttagtagtacctgagcgaggaagaaatgtcatacattagagttcggcagtattagtttcaggaggaaaatcatagggcggcacagttcgttcggtcaaaaaccaagaagaatgccaggaaccctggttccataccttgggaaacggaagctggttcctggcctttgtggattcccagc

SEQ ID NO: 79036 - protein, 211 aa, Zea mays
  misc_feature: Ceres CLONE 1564042
MQPKISAFFERQETDPDPISGDGEGNGQGNVGAATEAKRKANGCRLDGLVSKKRNYAQLHLELGQPDFVLHTCSVCGMMYARGNDEDEKVHRAYHKSYSEGVPFKGWKKETVIARSEGGDRVVLATDENSCMSKSKVREVITVVEKELGFGEGKLLHKLCKVYLYISAQRIVGCLVTEPIKQDIELSPAPRKGALMICQLVVPERGRNVIH

SEQ ID NO: 79037 - DNA, 902 bp, Zea mays
  misc_feature: Ceres CLONE 1564043
  misc_feature: Encodes the peptide sequence at SEQ ID NO. 79038
ctccccgcggtggcggccgctctagaactagtggatcccccgggctgcaggaattcgtctcacccctagaaaaagcggccacacgcgtttggattttgctccttgctcccttgatccatccacttctgaaagggtcaccatgtctgcctttgtggggaagtacacagatgagctgatcaagaccgccaagtgcctcgcaacgccgggcaagggcatcctggcctccgacgagtcgacgggcaccatcggcaagcgcctatccagcatcaacctcgagaacgtggagtcgaaccggcaggcgctccgcgagttgctcttcacggcgcccggcgtgttcgactacctctccggggtcatcctcttcgaggagacgctgtaccagaagacctccgacgggaagccgttcgtggacgtgctcatcgcgggcggagtggtccctgggatcaaggtcgacaagggcaccgtggagatcgcgggcaccgacggcgagaccaccacgcagggcctcgactccctgggcgcgcgctgcgccaagtactacgaggccggcgcgcgcttcgccaagtggcgcgccgtgctcaaggtcggccccgcggggcaggggcagccctccgagctcgccgtcaggcagaacgccgagggcctcgcgcggtacgcgctcatctgccaggagtacgggctggtgcccatcgtggagcccgagatactcaccgtacggcggcacgacatcgggacctgcgccgccgccacggagcgcgtcctcgccgccctctacagtcgctcagcgaccacaagtcctgctcgaggcacgctccctcagaccacatggtcacccccggttcccgatagcccaggtctccgcgaaggtgaagcggaatacacgtgggcgcgctgcgcgcacc

SEQ ID NO: 79038 - protein, 254 aa, Zea mays
  misc_feature: Ceres CLONE 1564043
  misc_feature (11)..(254): Pfam Name: Glycolytic Pfam Description: Fructose-bisphosphate aldolase class-I
  misc_feature: SWISSPROT Homolog: EC 4.1.2.13 Fructose-bisphosphate aldolase
MSAFVGKYTDELIKTAKCLATPGKGILASDESTGTIGKRLSSINLENVESNRQALRELLFTAPGVFDYLSGVILFEETLYQKTSDGKPFVDVLIAGGVVPGIKVDKGTVEIAGTDGETTTQGLDSLGARCAKYYEAGARFAKWRAVLKVGPAGQGQPSELAVRQNAEGLARYALICQEYGLVPIVEPEILTVRRHDIGTCAAATERVLAALYSRSATTSPARGTLPQTTWSPPVPDSPGLREGEAEYTWARCAH

SEQ ID NO: 79039 - DNA, 875 bp, Zea mays
  misc_feature: Ceres CLONE 1564045
  misc_feature: Encodes the peptide sequence at SEQ ID NO. 79040
  misc_feature (833)..(833): n is a, c, t, g, unknown, or other
  misc_feature (869)..(869): n is a, c, t, g, unknown, or other
ctccccgcggtggcggccgctctagaactagtggatcccccgggctgcaggaattcgtctcacccctagaaaaaacatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacacatccagaaggagagcaccctccacttggtgctgcgtcttaagggtggtatgcagatctttgtgaaaacccttactggcaagacatcactcttgaggtggagtcttcagataccattgacaatgtcaagggctagatccaggacaaggagggcatcccgccgggacagcagcgtcttatctttgccgggcagcagctggatgatggacgcacccttgcggatttacacatcagaagagagcaccntcactggtgctgcgcctcaggggaggatgcagatcntcgtga

SEQ ID NO: 79040 - protein, 156 aa, Zea mays
  misc_feature: Ceres CLONE 1564045
  misc_feature (6)..(74): Pfam Name: ubiquitin Pfam Description: Ubiquitin family
  misc_feature (82)..(152): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYTSRRRAPSTWCCVLRVVCRSL

SEQ ID NO: 79041 - DNA, 841 bp, Zea mays
  misc_feature: Ceres CLONE 1564050
  misc_feature: Encodes the peptide sequence at SEQ ID NO. 79042
tccccgcggtggcggccgctctagaactagtggatcccccgggctgcaggaattcgtctcacccctagaaaaaaagggcagcagagaaagcagctgagcgctgactgtggatctcatccgtatcgcgtatatacgtcgtcctgtttggatccaccgcgttttgctaattcccttcgaaccggccggtggccttcgttctcccaccaggcctgtctgtctgctgtatccgccagagcttccatggattccaccctcttcatcatcggcgtcataggcaacatcatctcagttctcgtcttcatatcgcctatcaagacgttctggaggatcgtgcggggcgggacgacggaggagttcgagccggcgccgtacgtgttgacgctgctcaacgcgctgctgtggctctactacgggctcaccaaggccgacggcttcctcgtcgccaccgtcaatggctttggggctgtcatggaaggcatctacgtcgtcctcttcaacgtctacgccggccaacatgccacaagggtttaagaacgcaaagcttggaacaacgttggacatccgtggctttcggaatcctgttttccggcaccacattccccctctgtggaatttaaattagaatatgggggaaagaaaaaaaatggccctgccccaagggctcatgtacgggggacccccttcgtctttgaaaaaacggggatacccacaaaaaacggggaaaataaggccaattttccgggggctttttccccttcccccaaaggagggggttggggcaaataaaaccggggcttttaccccaaatcttttctcggagaccccaaggggaaaaggcttc

SEQ ID NO: 79042 - protein, 96 aa, Zea mays
  misc_feature: Ceres CLONE 1564050
  misc_feature (6)..(93): Pfam Name: MtN3_slv Pfam Description: MtN3/saliva family
MDSTLFIIGVIGNIISVLVFISPIKTFWRIVRGGTTEEFEPAPYVLTLLNALLWLYYGLTKADGFLVATVNGFGAVMEGIYVVLFNVYAGQHATRV

SEQ ID NO: 79043 - DNA, 941 bp, Zea mays
  misc_feature: Ceres CLONE 1564051
  misc_feature: Translation starting site: 131
  misc_feature: SWISSPROT Homolog: EC 3.4.25.1 Proteasome endopeptidase complex
  misc_feature (526)..(526): n is a, c, t, g, unknown, or other
  misc_feature (659)..(659): n is a, c, t, g, unknown, or other
  misc_feature (692)..(692): n is a, c, t, g, unknown, or other
  misc_feature (693)..(693): n is a, c, t, g, unknown, or other
  misc_feature (895)..(895): n is a, c, t, g, unknown, or other
ctccccgcggtggcggccgctctagaactagtggatcccccgggctgcaggaattcgtctcacccctagaaaaaagcgcacacaaacacacaccagcccagctccgagagatcatccggcggccggcgagatgagccgcggcacgggcgcgggttatgaccgccacatcaccattttctcccctgagggacgcctgtaccaagtcgagtacgcgttcaaggcggtgaagtcggcgggtgtcacgtcgatcggcgtccgcggcgcggactccgtctgcgtcgtcacccagaagaaagtcccggacaagttgctggatcagacgagcgtgacacacttgttcccgatcaccaagtacgtcggattgcttgccactggcctcacagctgatgcaaggtcattggtttcccaagcaaggaacgaagcagctgagtttcgtttcaaatggggctatgagatgccagttgatgtgttagcaaaatggattgctgacaaagctcaagtttacacgcaacatgcatacatgagnaccccttggagtagttgctatggtcttgggctacgacgaagagaaaaatgcacaactattcaaatgcgaccctgcgggtcacttctttggacataaagcaactagtgccgggctcaaggagcaggaagcaatnaattttttggagaagaaaatgaaggatgacccnngaatcacctatgatgaaactgttcagattgcaatatctgcattgcaatcagttctccagggagatttcagggccactgagatcgaagttgggtgttgtgagaaaagagaacgtcttttcagagtctcacaacagaagagattgaccagcactgaccgcaattagtgaacgggacggagctgccatatgttgggaatttgatncctccacactgggccgggcattgggctcagcactgccatttagttg

SEQ ID NO: 79044 - DNA, 935 bp, Zea mays
  misc_feature: Ceres CLONE 1564053
  misc_feature: Encodes the peptide sequence at SEQ ID NO. 79045
  misc_feature (792)..(792): n is a, c, t, g, unknown, or other
ctccccgcggtggcggccgctctagaactagtggatcccccgggctgcaggaattcgtctcacccctagaaaaaattaaagtcccatccgcggctccgccctcctctgtgtcttccttccacctgaaaacccaacccacacgctcgcgcctccgcgaagaaaaacaccgaggcccatggcgccgagaacgtcagagagagcgatgacatcggcggccgcggggctcgcgcgtggcgccggcccgcactacagaggcgtcaggaagcggccgtggggccggtacgccgcggagatccgcgacccggccaagaagagccgcgtgtggctcggcacgttcgacacgcccgaggacgccgcgcgggcctacgacgccgccgcgcgcgagtaccgcggcgccaaggccaagaccaacttctccttcccttcgtgcctgccgctcgccgccgcggacgtggccggcggctgccggagcggcaacagcagcagcaccacaccaccaccaccgtcgactccttcggcggcgacgtgcaggcgccgcccatgcaggccatgccgctcccaccgtccttcagcgccagcgccgccgtacgcttcccttttagcggctaccccgtgacgcacccgtactacttcttccggcaggcggcagcaaggtgccatatgctgaagctggccccgacaaacgtgactggggctcagagcgactctgactcctcgtcccgtcgaggaactgtccgcgtccccgcccggccgccgtgtcagcaacaagagcccccgccgtttgatctcaantaaactgccacccccggcgcgaggggaagcattatcccccgaatttgcgcgaatgactgcctgaagtttcttccgccttttacccgtagaaagaaatcggtaggtttaggcccctttggttttccccggggtcccggccaccc

SEQ ID NO: 79045 - protein, 146 aa, Zea mays
  misc_feature: Ceres CLONE 1564053
  misc_feature (23)..(74): Pfam Name: AP2 Pfam Description: AP2 domain
MAPRTSERAMTSAAAGLARGAGPHYRGVRKRPWGRYAAEIRDPAKKSRVWLGTFDTPEDAARAYDAAAREYRGAKAKTNFSFPSCLPLAAADVAGGCRSGNSSSTTPPPPSTPSAATCRRRPCRPCRSHRPSAPAPPYASLLAATP

SEQ ID NO: 79046 - DNA, 944 bp, Zea mays
  misc_feature: Ceres CLONE 1564054
  misc_feature: Encodes the peptide sequence at SEQ ID NO. 79047
ctccccgcggtggcggccgctctagaactagtggatcccccgggctgcaggaattcgtctcacccctagaaaaaacgccatctgcacctccctcctatcggtcgccctctcgccgacgccacccatggaggccgccgcgatcgccaccacctcccggtctctcccgctccccttctcatctacccagctccagctccagcgccggcgccgtgccgccttcctacacatcgccgcctccaagcgtcacgaagacgacaaggagaccgctaaaggttccggctcggaaccccggcgcgagcccactagcctggcgccgtacggcatctccatctcgccgctctccaaggacgcggctatggggctggtggtgagcgccgccacggggagcggctggaccacgggatcgggaatggagggcccgccgacggcgagcaaagccggtggggcgggcaggccggaggtgtcgacgctgccttggtccctcttcacgaaatcaccacggcggcgcatgcgggtggccttcacctgcaacgtgtgcggggcagcgtacgaccaggggccatcaatcctcatgcctacactgaatggaactgtgtttgttcagtgctgcggttgcaatgggttccataattgggcgaaaacctaaaacctgtttcatgaaaatgaaatgctacgtcggcccaaacttccgctaacaaaggggaagctccattcaactaccctggaccccaacgaggaaaaaagaacactcccttcccttctccagaaacctaaaagcccccttttagttggccagtgacaaaatatgggccgggggcccaccaatatttgccccggatgagaaggacctacaaaagccggggtggtggtccccttcaggaacacggaaaaaattgttcccaattgaataaatattcctctcggagtgcccaaccgcgggggga

SEQ ID NO: 79047 - protein, 173 aa, Zea mays
  misc_feature: Ceres CLONE 1564054
MEAAAIATTSRSLPLPFSSTQLQLQRRRRAAFLHIAASKRHEDDKETAKGSGSEPRREPTSLAPYGISISPLSKDAAMGLVVSAATGSGWTTGSGMEGPPTASKAGGAGRPEVSTLPWSLFTKSPRRRMRVAFTCNVCGAAYDQGPSILMPTLNGTVFVQCCGCNGFHNWAKT

SEQ ID NO: 79048 - DNA, 893 bp, Zea mays
  misc_feature: Ceres CLONE 1564055
  misc_feature: Encodes the peptide sequence at SEQ ID NO. 79049
  misc_feature (608)..(608): n is a, c, t, g, unknown, or other
  misc_feature (609)..(609): n is a, c, t, g, unknown, or other
  misc_feature (685)..(685): n is a, c, t, g, unknown, or other
ggagctccccgcggtggcggccgctctagaactagtggatcccccgggctgcaggaattcgtctcacccctagaaaaactctcctctccctccctccctccttccccgccgccgtctaccagtacagctcgagcgaacgacgtctcgacagtcccgggccgctgagaacttgccgcgggagggagagcagcagcggcagcatcagacatgtcgtcggggcggtacatggcctactcgccctcgccgtcgaccaccccccactccccccgcatcgccggcctccgcgccccgtctgccgccatggccgaacaggagaagtaccttgccgaactgctcgcggagaggcagaagcttggcccgttcgtcccagtgatcccgcatagtgtacgcttgctgaatcaagaaattttacgtgtttccacactattggagaacgcatcccttttaaatcaaagtggccttgaacatggtagtccactaacaacaggaggattatattcaaatggagcagctactgacatgaatgtgtggacatcagcatttcaacccagaaagtcaccagcttatagctgggcttggaggatccagggcagctcctctgggactanntgtcagaaaaacatgaaggtcgatatcccagtagacaaatatccccacattcattttcgttggccgcatccttggntcaagaggaaaaatcttgaagcgggtggagggcaattacggactgccgtgggctaaataagaagtcgtggcagcctcaaaaatcccgccccgggagggaaatgatgccagggaaagcccggtattggaacccctgaaggaccccctcccctatatttggtttgaggaaaaccttccgtgttaaaacctttgatgcccgcctggatcca

SEQ ID NO: 79049 - protein, 146 aa, Zea mays
  misc_feature: Ceres CLONE 1564055
  misc_feature (103)..(103): Xaa is any aa, unknown, or other
  misc_feature (129)..(129): Xaa is any aa, unknown, or other
MAEQEKYLAELLAERQKLGPFVPVIPHSVRLLNQEILRVSTLLENASLLNQSGLEHGSPLTTGGLYSNGAATDMNVWTSAFQPRKSPAYSWAWRIQGSSSGTXCQKNMKVDIPVDKYPHIHFRWPHPWXKRKNLEAGGGQLRTAVG

SEQ ID NO: 79050 - DNA, 970 bp, Zea mays
  misc_feature: Ceres CLONE 1564057
  misc_feature: Encodes the peptide sequence at SEQ ID NO. 79051
  misc_feature (751)..(751): n is a, c, t, g, unknown, or other
  misc_feature (833)..(833): n is a, c, t, g, unknown, or other
ctccccgcggtggcggccgctctagaactagtggatcccccgggctgcaggaattcgtctcacccctagaaaaacttctagtttcgtctagtcttcaaggaagaccggaaccgaggcgccctggccgagaactggagccaccggacgcacggctgctgccgaaatccacgggagaatgacgatggtcgaggccgaggctggtagggcggcgatccggcgcgccctgcggtcgctgaaacggaggcatctcgccgaggaaggggcgcacagcccggccatcgaggcgctaacccgtcccttcgccgcccacgctttggagtggaaggagaaggctgagaagcatgagttagagctgcagcaatgctacaaggcgcaatcccggctctctgagcagcttgtgactgagatagaagaaggtaaagtatcaaaagcactgctcaaagagaaggaagcgatggttacaagtttgcaggctgaacttgagaagacaagcgaagagaatgtacaactaaagcagtcgcttgacgaaaaaataaaagccttagatcttttcattcaagagcatcagacagtgaaatccgagcttgaacaagcattgacgaaactaaaagctgcagaggatgagaaccaaaatctggttgatcgatggatgctagagaagatgaaggatgccgagaggctcaatgaggccaatgcgatgtatgaaggagatggttctaaagctaagacagctgggagttggtggtatacnacttaatgcacagcaagaactgatggcatcatacggcgttctgaagctgggtacatagaaacgcaatcccatcacatgcacnatactatcgtgcccatgatggtgggggtgggagctttgatgtttgacatactcagacagcctaattggtgggggcagatccactggtttagaatgggggcatctactgcgcttgaccgcaactaagtgttgcttggg

SEQ ID NO: 79051 - protein, 193 aa, Zea mays
  misc_feature: Ceres CLONE 1564057
  misc_feature (14)..(171): Pfam Name: ATG16 Pfam Description: Autophagy protein 16 (ATG16)
  misc_feature: SWISSPROT Homolog: EC 2.7.11.1 Non-specific serine/threonine protein kinase
MTMVEAEAGRAAIRRALRSLKRRHLAEEGAHSPAIEALTRPFAAHALEWKEKAEKHELELQQCYKAQSRLSEQLVTEIEEGKVSKALLKEKEAMVTSLQAELEKTSEENVQLKQSLDEKIKALDLFIQEHQTVKSELEQALTKLKAAEDENQNLVDRWMLEKMKDAERLNEANAMYEGDGSKAKTAGSWWYTT

SEQ ID NO: 79052 - DNA, 661 bp, Zea mays
  misc_feature: Ceres CLONE 1564058
  misc_feature (598)..(598): n is a, c, t, g, unknown, or other
  misc_feature (600)..(600): n is a, c, t, g, unknown, or other
  misc_feature (607)..(607): n is a, c, t, g, unknown, or other
tccccgcggtggcggccgctctagaactagtggatcccccgggctgcaggaattcgtctcacccctagaaaaaagccatcacacgcatactgcatacacaacgcagagcatcagaagcagctgcgatctgatcgacatggctgccgccaccatggctatcacctcccgcgcgctcgtcggcaagccggcgggctggcacgaagggaccgtcttcgggcgagggccgcatcaaccatgtgcgcaagaaccgccgcccaagccccaaagcccgggcgggcgttccgggcaagccccatgggttaaaggggggccccaaacccggggttcccggggtaccccgggggggcccccccctttttttcccgggggttcccccccccccccagaagactcaccccctgtaaaacccggggggagattattcttccccccggggggaaaaaaaagggggggggggggggggaaaacccccccccgggggggggggttttttttctgcggggggggacccccccccggggaaaaaacctttccccccccccaaaaaaaaaaacccccccacaacgggggggggggggagggtaaaaaaccacaaaancnccccccngtgggggggggggagaatatattttttcttgggggggggcgccccccccctttg

SEQ ID NO: 79053 - DNA, 871 bp, Zea mays
  misc_feature: Ceres CLONE 1564059
  misc_feature: Translation starting site: 167
  misc_feature: SWISSPROT Homolog: EC 1.14.13.68 4-hydroxyphenylacetaldehyde oxime monooxygenase
  misc_feature (527)..(527): n is a, c, t, g, unknown, or other
  misc_feature (544)..(544): n is a, c, t, g, unknown, or other
  misc_feature (547)..(547): n is a, c, t, g, unknown, or other
  misc_feature (554)..(554): n is a, c, t, g, unknown, or other
  misc_feature (555)..(555): n is a, c, t, g, unknown, or other
ggagctccccgcggtggcggccgctctagaactagtggatcccccgggctgcaggaattcgtctcacccctagaaaaagcaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacngtgctggcgtcccgccngcngaaaccnncgtcgcgacatcatccgctacaactccacggacgtggccttcgcgccgtacggcgagtactgggcgcacgcgcgaaagggtgtcaacacgcacctgctcagcgccaagatggtctcctccaaccgcggaaccggaaaggagaggtcccccttggtggtgggccggaatcccgaacccttccaaggggtcccggggacggccttcaaattaacgaattgttgggggttaacccagagaatttggtgggccccccgggccggggagtcccccggaaaagggccggaaaaagtttttcggggcttaaggaaccaagccc

SEQ ID NO: 79054 - DNA, 1306 bp, Zea mays
  misc_feature: Ceres CLONE 1564060
  misc_feature: Encodes the peptide sequence at SEQ ID NO. 79055
  misc_feature (68)..(68): n is a, c, t, g, unknown, or other
  misc_feature (821)..(821): n is a, c, t, g, unknown, or other
  misc_feature (1306)..(1306): n is a, c, t, g, unknown, or other
ttttactgtgtgcgcgtggggtccctttgggggccgagccaaacttataccacattttatgtgctttnggtcaaagctggagctccccgcggtggcggccgtctctagaactagtggatcccccgggctgtttgaattcgtctcacccctagaaaaagagcggcacaagacgccaccgagcctttaatttgcatcctcatcctgcggctgtcagtgtcaagcagccaggctcaggggtaaggtttcagcaattcagctccctcgcctccgccgcggcaccggcactacgagtgcttcgctaccagccagccagcacactctacgagtcgccatcttccactccaccgaggcagctccaagccatggccatggagaaggccgcctccttcctctcctccctcttaggcggcggccgcggggagccggctgcgactgtgaaatctatcttcatataccccatcaagtcctgcaggcccccccccgtgtcacaggagcccatcacctccactgggttccaggggggatccggcattggggtgggggtggaaagccaaaagggctgaggtataccccccaaaaggttgggagccccaagccttcgcttccgggcccaaggttggaagttagccccaccaggtaaggccttttgcctataataacctgtgtgaggccccatttgcctccgagaggaaccccccccggggttttataaatgaagtcacccccgtgagattgggagaaccatacttgaaaaaaataacccctctcttgtgtttatagcgggagatacttatgctccctctaaagacgagaatgcgaanaggcgtatctctgagaccctgcgggaacagagaggggaccctcagaggcgcctactcaccgcgctatatatacatgcaaacagaggggcagcctgataatagcatcgggctcgaacacacgagagggtggcaccccgcagctcctatatgcttctgggggaagaagccccccgaaatgtatatcatactattggtgcgtcttcttaatagataaagtagacgcccagaaacacatgagggtcccgaaaccgcatcctcatctaattattggtcccactaccggcggactatgataacactcggtccacgcacaataatcgtggttacgccaagtttatggatatatgcgtgcttccaacggcggtcacacgtagacaggtccgcgaatatatatagtacctttataagaaaccacttcgcgacatgtacaaccctgttctcaataccacaaaattttgtatcgggaagtgtgcgcccgctccctn

SEQ ID NO: 79055 - protein, 64 aa, Zea mays
  misc_feature: Ceres CLONE 1564060
MEKAASFLSSLLGGGRGEPAATVKSIFIYPIKSCRPPPVSQEPITSTGFQGGSGIGVGVESQKG

SEQ ID NO: 79056 - DNA, 893 bp, Zea mays
  misc_feature: Ceres CLONE 1564062
  misc_feature: Encodes the peptide sequence at SEQ ID NO. 79057
  misc_feature (494)..(494): n is a, c, t, g, unknown, or other
  misc_feature (735)..(735): n is a, c, t, g, unknown, or other
  misc_feature (736)..(736): n is a, c, t, g, unknown, or other
  misc_feature (761)..(761): n is a, c, t, g, unknown, or other
  misc_feature (786)..(786): n is a, c, t, g, unknown, or other
  misc_feature (809)..(809): n is a, c, t, g, unknown, or other
  misc_feature (836)..(836): n is a, c, t, g, unknown, or other
  misc_feature (852)..(852): n is a, c, t, g, unknown, or other
  misc_feature (863)..(863): n is a, c, t, g, unknown, or other
tggagctccccgcggtggcggccgctctagaactagtggatcccccgggctgcaggaattcgtctcacccctagaaaaactcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcnggtggaggatcccatgttgatccatttgacatcttctcatcattttttggaccctcttttggaggaggtggtggaagcagcaggggaagaaggcaaaggaggggagaagatgtagttcacccacttaaagtttctctggaagatctttacaatggcacctcaaagaagctctctctttcgcgcaatgtcatctgctccaagtgcaagggcaaggggctcgaagtctggtgccctcaatganngtgccccctggtgccaggggctcangcatgaaaaagtcactattcgtcangctggggctcttccatgatacangcagatgcagcagcccttgcaatgagntgcaagggggactggnagagagcatcnattgagaagaccccctgtcccagggggcaa

SEQ ID NO: 79057 - protein, 89 aa, Zea mays
  misc_feature: Ceres CLONE 1564062
  misc_feature (13)..(71): Pfam Name: DnaJ Pfam Description: DnaJ domain
  misc_feature (84)..(84): Xaa is any aa, unknown, or other
MFGRAPKKSDNTKYYEILGVPKSASQDDLKKAYRKAAIKNHPDKGGDPEKFKELAQAYEVLSDPEKREIYDQYGEDALKEGMGXWRIPC

SEQ ID NO: 79058 - DNA, 900 bp, Zea mays
  misc_feature: Ceres CLONE 1564064
  misc_feature: Encodes the peptide sequence at SEQ ID NO. 79059
  misc_feature (785)..(785): n is a, c, t, g, unknown, or other
  misc_feature (795)..(795): n is a, c, t, g, unknown, or other
acccgcggtggcggccgctctagaactagtggatcccccgggctgcaggaattcgtctcacccctagaaaaacttcccgtctccccagtccccactctcgtccccgctccctccaaagtccaaaccctaccaccccacttccccaccaccactacatggcggcggcgctcgcctcctcccgctactgctggagccgcccgtcgctgccgccccaaccgacccgcggccgccgctccgtcactagctgcgcgctctccggacgagagaaaagaaactcctttagctggagagagtgtgcaatttctgttgcattgtcagttggactaatcactggtgcaccaacgtttggaccaccggcctatgcttcttctcttgaacctgttcttccagatgtgtctgttcttatctctggacctcccattaaagatccaggtgctttattgagatatgctttaccaatagataataaagctattcgtgaagttcaaaagccgctggaggatatcactgacagcctcaaggttgctggtgttagagccttggattcagttgaaagaaatgtcagacaagcatcgaaagcactgaacaatgggagaagcttaatttctgctggccttgctgaacaaaaagagcaaatggagaagaagtgttgaataagttggctgttggatttgaagaagctcaaagaattgtggaagacagaaatagggatgcagtagctccaagcagaaagagcttctcagtattgtggaactgtagaagagaactggtcgatggcttccccnttgaatacangagaagtacagcactgccctctctcaaagaagactactgtgaatatgaaggtaagattaggacatccaaaatggaagactgtgtatttaggaaagtccgggatga

SEQ ID NO: 79059 - protein, 165 aa, Zea mays
  misc_feature: Ceres CLONE 1564064
  misc_feature: SWISSPROT Homolog: EC 5.2.1.8 Peptidylprolyl isomerase
MAAALASSRYCWSRPSLPPQPTRGRRSVTSCALSGREKRNSFSWRECAISVALSVGLITGAPTFGPPAYASSLEPVLPDVSVLISGPPIKDPGALLRYALPIDNKAIREVQKPLEDITDSLKVAGVRALDSVERNVRQASKALNNGRSLISAGLAEQKEQMEKKC

SEQ ID NO: 79060 - DNA, 960 bp, Zea mays
  misc_feature: Ceres CLONE 1564067
  misc_feature: Encodes the peptide sequence at SEQ ID NO. 79061
acccgcggtggcggccgctctagaactagtggatcccccgggctgcaggaattcgtctcacccctagaaaaagccaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcggcggcagcgggcggcgccgacgtgctgatcgtcgtcccgaggagggcgggcgctgggcgcgtctggttccccgcggcggcgcgccgcggcggcggcagcgggcggttggtcgccgtgcggtccagcgggccggccacgccgccggagatctccgacaaggtgtcggagagcatcaagcaggcggaggagacgtgcgcggacgaccagaagggcgacgcctagtgcgcggcggcgtgggacgaggtggaggagctcagcgccacggccagccacgcccgcgacagcctcaaggagaccaacgccaacgacccgctcgagaagtactgcaaggacagctgccattgctcgtccgcatcctccttggatttccctcccaggtacgcctactccatgcgcacgcattcctattccgattcctgcacattccgtggaccgatttggaaaagctgaacgggtacatagcgtatctttctctcacagtctgctgacggtgatgtttataagcgaatctgtactcatatagatttcttggtcctcttacatcgtcaactgtccagctagagatttctgtgttcttagaaatcctctgtcttcctaaggggagacgaggaaggcgcataaaatcccaggaactgtttttgataaatcacatttggcgtctgacatgctaagctgagtgacctggccagaaaggtt

SEQ ID NO: 79061 - protein, 94 aa, Zea mays
  misc_feature: Ceres CLONE 1564067
MAASTVASLSVPVTTTTFAAAAAAGGADVLIVVPRRAGAGRVWFPAAARRGGGSGRLVAVRSSGPATPPEISDKVSESIKQAEETCADDQKGDA

SEQ ID NO: 79062 - DNA, 943 bp, Zea mays
  misc_feature: Ceres CLONE 1564068
  misc_feature: Encodes the peptide sequence at SEQ ID NO. 79063
ctccccgcggtggcggccgctctagaactagtggatcccccgggctgcaggaattcgtctcacccctagaaaaaaccagggaaaaaaagttaagagataaacggatagaacaggcgtggagcgcgcgaccccgtgcgtctccaccgctgcacgaactccctcccccctccccggcggcccgcgcgcccaccaaccatggcagtcgcagccgccgcccaccacctgcccgttgtgccgcaccgccttgtcccggtccggcacaccagtagcagcccgccgccgcatccgaccgcccgctgctccgccgcggggaagccgcccgtccagctccacgcggcgcaagcgagggcgtctgggttcgccgcgcgcgtcgcgttaaacccttccgggaactacgacctgtccctctccatgggcgaagacgagaccccgcaggtccagcctccgccgccgcctacccaagggcgcttcgaaatcgttatcaacaacgacaacatccgaacgctcgacctatcgccagtcgaagcagcactcggcgacttgagctccttgacaccagctgcttcaagaaccctgctggaccagaccgtcgggttcaccatcagctacgagagggaggacgagtacgacacgcgggagctgtcggagttccccgacatacggctgtggttcgtgaggctcgacgccgcgttaccctgggtcccggtcgtgctcgactggagagccgcgagcttgtcagatacgccgcgatgctcgtccctcaacagagagcatgcggatgggcgtcctcttcaacccggaagcgctggaactgttctgaataagaaagggttcgccgccaaccttggctgagcaacaaagcatcccaagccgagcttgagacagcggaactggcaagatgcccggcttcggcgtcgaaaaaacctgttccaactgaactaaa

SEQ ID NO: 79063 - protein, 146 aa, Zea mays
  misc_feature: Ceres CLONE 1564068
  misc_feature (23)..(146): Pfam Name: DUF1817 Pfam Description: Domain of unknown function (DUF1817)
MGEDETPQVQPPPPPTQGRFEIVINNDNIRTLDLSPVEAALGDLSSLTPAASRTLLDQTVGFTISYEREDEYDTRELSEFPDIRLWFVRLDAALPWVPVVLDWRAASLSDTPRCSSLNREHADGRPLQPGSAGTVLNKKGFAANLG

SEQ ID NO: 79064 - DNA, 870 bp, Zea mays
  misc_feature: Ceres CLONE 1564071
  misc_feature: Encodes the peptide sequence at SEQ ID NO. 79065
  misc_feature (461)..(461): n is a, c, t, g, unknown, or other
ctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctggggccatgctgggcgcngttgggctgcgtgttcccggagctgctcgcccgcaacgggcgtcaagttcggcgaggccgtgtgattcaaggccgggtcgcagatcttcagcgagggtgggctggactaccctcggcaacccgagcctgatcacgcgcagagcatcctccgcatctgggcttgccaggtcgtgctcatgggcgccatcgaggggtaccgcgtcgccgggcgcccgctcggagaagtcgtcgacccgctctaccccgggcggagcttcgacccgcttcggctcgccgacgaacctgaaggctttcgcggaacctcagggggaaggagctcaagaaacgcccccctcgccctggttccccaaggttcggggttctttggtccagggccattgttcaccgggaaggggcccccctccagaaa

SEQ ID NO: 79065 - protein, 130 aa, Zea mays
  misc_feature: Ceres CLONE 1564071
  misc_feature (110)..(110): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWGHAGRXWAACSRSCSPATGVKFGEAV

SEQ ID NO: 79066 - DNA, 872 bp, Zea mays
  misc_feature: Ceres CLONE 1564072
  misc_feature: Encodes the peptide sequence at SEQ ID NO. 79067
  misc_feature (650)..(650): n is a, c, t, g, unknown, or other
  misc_feature (658)..(658): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (673)..(673): n is a, c, t, g, unknown, or other
  misc_feature (763)..(763): n is a, c, t, g, unknown, or other
ctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagnacgcgccngcnnnggcgcccccngcggctagctatagctcctgcgtgagctagaagctagctagtgccatgccgtcgtctcggtcgttcggtttttgctttcgggggcaccgnaccccttggcttgggcttgggtccccccttccccttttccctttttttttcttttccccgggccaggtccctttggtttcagttttcctgggggggggggaaggaaccc

SEQ ID NO: 79067 - protein, 170 aa, Zea mays; identical to SEQ ID NO: 73340
  misc_feature: Ceres CLONE 1564072
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase

SEQ ID NO: 79068 - DNA, 906 bp, Zea mays
  misc_feature: Ceres CLONE 1564073
  misc_feature: Encodes the peptide sequence at SEQ ID NO. 79069
  misc_feature (684)..(684): n is a, c, t, g, unknown, or other
  misc_feature (768)..(768): n is a, c, t, g, unknown, or other
  misc_feature (827)..(827): n is a, c, t, g, unknown, or other
ctggagctccccgcggtggcggccgctctagaactagtggatcccccgggctgcaggaattcgtctcacccctagaaaaagagtcgtcgccccctcgctttcaccccacgcggaagcaagaattcgtcgtcaaattcccagcttgcgcgtgtttctgtggatttcttcccgcttccctgctcctgcctcctatgggcctttgatccggggcttcgtggatcttgggaagaggaggtgcggtgggcgcctcggcggcgatctggcggggaggatatggccagcgggaaggagccgatcgaggtcaggtttcgtctcttcgacggcacggatatcgggcctacgaagtacgatccctccaccacggtctcctcgctcaaggagttcatcctcgctcggtggccgcaagataaggatatagctccaaaaactgttaatgacttgaagcttatcaatggtggaaggatattggagaataaccggacacttgcagagtcccgtgttccagtaggagagatcccaggtggtgtaattacaatgcatgtggtagtgcggcctccacaagctgacaaaaacaagaagcagcttgccaattcccccaagcagaacagatgtggatgcaccattctctgataaggcgtctgcttggtgctgtacaatctgtgtgtacacataagattttgtatngtgctttgctgtgttcacacaagcatggattcgttttgatatccaattctgaaagcatacaaattccagaaagtagaaccacgnaatacgaagatttctggatcgttttggtctagagtgtaggattggatgctccctgctgnaataattgggttgtcaaactgaaaaaaagtctctttctttctgctatatgacttatatcgattcttctagctcgttgct

SEQ ID NO: 79069 - protein, 118 aa, Zea mays
  misc_feature: Ceres CLONE 1564073
MASGKEPIEVRFRLFDGTDIGPTKYDPSTTVSSLKEFILARWPQDKDIAPKTVNDLKLINGGRILENNRTLAESRVPVGEIPGGVITMHVVVRPPQADKNKKQLANSPKQNRCGCTIL

SEQ ID NO: 79070 - DNA, 932 bp, Zea mays
  misc_feature: Ceres CLONE 1564074
  misc_feature: Translation starting site: 257
  misc_feature (721)..(721): n is a, c, t, g, unknown, or other
ctccccgcggtggcggccgctctagaactagtggatcccccgggctgcaggaattcgtctcacccctagaaaaatccgtccaatcaaccgggctgctctgctgcctctccggcgccattgacgagcaagagagtgctccgacacctggtccgtcgcgtgccgtgcccacccgctaaggccagggcgccccgactcgagctcaccgcgtcgaactcgaaccgctgctgttcctcggcagggggcagggtcgtcgaggatgccggagcactcagagaacgcggcggcggacctgatgggcaacatcatggagaccatcgcggagaacctcccgaggcagaagtccgtgcggttcgacgacggcgacggctcctccatctccgagcaggccaagaagctgttcagcggcggcgagagcaggaagaagtctgtccaccacgtgctgggcggcggcaaatccgccgacgtgctgctgtggcggaacaagaagatctcgtccagcgtgctgggcgtggcgacgcttggtgtgggtgttcttcgagtggctggactaccacttcctcaccatccctctgcttcgtgctcgcgctcggcatggccgtccagttcgcctggtccatcttctcgtccagcgtgcctcgcgtgcagctgccggaagagctgttcgcgagcgccgggcgcgtcgcccggcgcccagtgatacagggcgctgggcttcctccangacgtggcctgccgacgcgacctcagcgggtggtcatcgggatcgccgggttcttccctgcgggggcgtcggagcttctgcaactcctgacgtcattcacatcgggtcctggcgcgcaccccgtgcgggctgtcgagagtaccagaccaggggacgattttgtcaaaatgctaggcggggcaagcatacccagctggacgcaggctcccca

SEQ ID NO: 79071 - DNA, 854 bp, Zea mays
  misc_feature: Ceres CLONE 1564075
  misc_feature: Encodes the peptide sequence at SEQ ID NO. 79072
  misc_feature (611)..(611): n is a, c, t, g, unknown, or other
  misc_feature (612)..(612): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
ggagctccccgcggtggcggccgctctagaactagtggatcccccgggctgcaggaattcgtctcacccctagaaaaaacccccctttccctgctctctccttccaactcttgtttctgcaacggcagggcgcaaccatggatcagcagcagcaagggccggcggccaggcagatggccacgctcgcctcccacctgcgccatcactacgtctctcaccctcagatggaagatgttcccctcttgaggggatccaattgccgtgcaaaatgtgcagcgccaggcttcaaagtctcgatcttgggtgcagcacgtgggatcgggcagccacttgcgctattgatgaagatgaaccctcttgtttcagtgctccatctatacgatgtcatcaacgcacctggtgtcacagctgacatcagtcacatgaacacaggtgctgtgagacatggcttcttgcgcagccacagatagtaaatgcgtgactggaatggatcatgaaataatgctgctgatgtcactcggaaacgtaggatgacaagggatgatttgtcaacataatgctggaataatcggtaccatgtgtgaagaattgcaaaggtgcctatgatttgnnaaaannntataaaaaaaacccgggcaacttaccctcccattggctgctaaattttcaagaaactggaattttgaccctaaacggttttagggggaccccccttgacaatggaaaaaaaactttttggggaagggttttggaattaccccaaagggaaaattccccccttgggggggggggggaaataaaaaaaccccccctttcagggaaaacttccctcgttttcccccaaaggagaaaac

SEQ ID NO: 79072 - protein, 110 aa, Zea mays
  misc_feature: Ceres CLONE 1564075
  misc_feature: SWISSPROT Homolog: EC 1.1.1.37 Malate dehydrogenase
MDQQQQGPAARQMATLASHLRHHYVSHPQMEDVPLLRGSNCRAKCAAPGFKVSILGAARGIGQPLALLMKMNPLVSVLHLYDVINAPGVTADISHMNTGAVRHGFLRSHR

SEQ ID NO: 79073 - DNA, 969 bp, Zea mays
  misc_feature: Ceres CLONE 1564078
  misc_feature: Encodes the peptide sequence at SEQ ID NO. 79074
  misc_feature (560)..(560): n is a, c, t, g, unknown, or other
  misc_feature (948)..(948): n is a, c, t, g, unknown, or other
ctccccgcggtggcggccgctctagaactagtggatcccccgggctgcaggaattcgtctcacccctagaaaaactcggttcctcccctttcgccctacttgcttcccacgccagggcccgagctccgagctagggtttcctctctcgccgccgccgccgccgccgccgccgacggagaagaggagtaggtgaagccgagttattagcgccaggggaggaacatggggacgccggagacgtcgcgggagccatgcccggaccggatcctggacgacgtcggcggcgcgttcgggatgggcgccgtcggcggctcggccttccacttcatcaggggcatctacaactccccctacgggatgcgcatgtccgggggcgcgcatggcgtgcgcatgaacgcgccgcgcgtggggggcagctttcgcgtctggggcgggcctctttcaactttcgactgcgccatggtctatgcgccgccaaaggagaatccctgggactccattttcgcggcgcccgcccccgggtggttttcctccttatgccccgggcattgggggggggngggccggtccccgcctttgggggggggtcccccggggcccctctcgaaggggcccggggttttttttaaaccgggtttttcccaaaaccgcccggggggccgccaggagtaccccacccttttccggggggggggggggaaaaacccttttccgggggcgccaaaaggggcccccggggggggggcacccccggaaggggagccgcccccccccccgtgggggggttttttgggggctttttttgcgagaaaaataaaaaaaaaataaccccggggcgcccggggaaatttttgtggtttcccccccccccgcggaaaaaaacctttttaaaaaaaagaaaaagaggggggggcgcctcgtcgcccccccgcaaaaaaatgtggggtnggggtgttattttttccccct

SEQ ID NO: 79074 - protein, 201 aa, Zea mays
  misc_feature: Ceres CLONE 1564078
  misc_feature (4)..(134): Pfam Name: Tim17 Pfam Description: Tim17/Tim22/Tim23 family
  misc_feature (113)..(113): Xaa is any aa, unknown, or other
MGTPETSREPCPDRILDDVGGAFGMGAVGGSAFHFIRGIYNSPYGMRMSGGAHGVRMNAPRVGGSFRVWGGPLSTFDCAMVYAPPKENPWDSIFAAPAPGWFSSLCPGHWGGXGRSPPLGGGPPGPLSKGPGVFFKPGFSQNRPGGRQEYPTLFRGGGGKNPFPGAPKGAPGGGAPPEGEPPPPPWGGFLGAFFARKIKKK

SEQ ID NO: 79075 - DNA, 863 bp, Zea mays
  misc_feature: Ceres CLONE 1564079
  misc_feature: Translation starting site: 163
  misc_feature: SWISSPROT Homolog: EC 2.3.1.110 Tyramine N-feruloyltransferase
  misc_feature (396)..(396): n is a, c, t, g, unknown, or other
  misc_feature (397)..(397): n is a, c, t, g, unknown, or other
  misc_feature (696)..(696): n is a, c, t, g, unknown, or other
  misc_feature (702)..(702): n is a, c, t, g, unknown, or other
ggagctccccgcggtggcggccgctctagaactagtggatcccccgggctgcaggaattcgtctcacccctagaaaaaaccatatcccgcatccataatactctgttccactccccacatcccactcccatctctcccgtttctctacacttcctgacccagatggcggcggcaccctgctctaccaccttctccggcgacgtgtgggcggagctgcgcctggcctccgccagcgatgtgccgcacatccaccgcctgatacaccagatggccgagttcgagctcctcaccgacctcttcgccgccaccgaagagctgctcacctccacgctcttcccctcgccgacgccgcctcccttcacctccttcacagccctcatcctcgacctatcctcnntcccccgtcacccccgacccctcgtccaccatcgcctcccgccgcctcgacctctccgcgtccccgctcgcggaccccgaggccgccgccttcgcctccccgcgcggaggcgggcgcgtcacggccgggttcgtgatctgcttccccaactactccaccttcctctccaagcccgggctgtacgtggaggacatcttcgtgcgcgcgccctggcgccgccgcgggctcggccggatgatgctgtccgccgtcgccggcagggcggccgagctcgggatggccccgggtggagtggtgcntgctcnactggaaacagaacgcatcgacttctacgagggcatgggcgctgacgtgctcccgcagtggcgcatctgccggctcgcccggcaagcgctggacaagtacaaggggtccccccggcgggaaggctgcggctgcgggaataagagggccctggaaattgctt

SEQ ID NO: 79076 - DNA, 882 bp, Zea mays
  misc_feature: Ceres CLONE 1564082
  misc_feature: Encodes the peptide sequence at SEQ ID NO. 79077
  misc_feature (452)..(452): n is a, c, t, g, unknown, or other
  misc_feature (485)..(485): n is a, c, t, g, unknown, or other
  misc_feature (487)..(487): n is a, c, t, g, unknown, or other
  misc_feature (488)..(488): n is a, c, t, g, unknown, or other
  misc_feature (528)..(528): n is a, c, t, g, unknown, or other
ctccccgcggtggcggccgctctagaactagtggatcccccgggctgcaggaattcgtctcacccctagaaaaaacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctcctacccgcggcgctgctcccttcgttgcagcccgccaggaggcacacgctgcagccgcccgccgcagccgccgagtccgcaggggaggccaagtctgtgggttccntggagaagtacccggccctggtcaccggcttcntnnctctcatgtggtacttcctcaacgtcatattcaacatccntcacaagaggatctacaactacttccccaataccatactttgtgtccctgatccatcaaggagggggggtcgtatactggctcatcagctggaatggtcggtcttccccaagcgaggcccctatcattggaacgcttcctaagcttttcttttccaagtccccctggggccaggggaattgggcacaatcctagcaaggggtcccttccggggggtttgcaggctcaatttgccccaccaataaagagtttggggaactctttttttaggggaggggggtatttattttttactcttggaacacaagagccccccttccccgggggggtttttcctggccccgggggggggtag

SEQ ID NO: 79077 - protein, 171 aa, Zea mays
  misc_feature: Ceres CLONE 1564082
  misc_feature (100)..(100): Xaa is any aa, unknown, or other
  misc_feature (111)..(111): Xaa is any aa, unknown, or other
  misc_feature (112)..(112): Xaa is any aa, unknown, or other
  misc_feature (125)..(125): Xaa is any aa, unknown, or other
MSALGTLSGGAAGVSGLLRLRRRAAPAPAIAAPSHLPAGTVKCAAAVPDAAPIVWGRQLRPALLLPAALLPSLQPARRHTLQPPAAAAESAGEAKSVGSXEKYPALVTGFXXLMWYFLNVIFNIXHKRIYNYFPNTILCVPDPSRRGGRILAHQLEWSVFPKRGPYHWNAS

SEQ ID NO: 79078 - DNA, 934 bp, Zea mays
  misc_feature: Ceres CLONE 1564084
  misc_feature: Encodes the peptide sequence at SEQ ID NO. 79079
  misc_feature (506)..(506): n is a, c, t, g, unknown, or other
  misc_feature (648)..(648): n is a, c, t, g, unknown, or other
ctcctcggtggcggccgctctagaactagtggatcccccgggctgcaggaattcgtctcacccctagaaaaagagcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgataccagcgaggctgctgctgttatcgcgaaggccaatgaaggcccaaaccggtgcgcaacctgtaggaagcgtgttgggttgacngggtttttactgccgatgcgggaacacgtactgttcgatgcaccgctactccgacaacacgactgccagttcgactatcgaactgcagctagggacgctatcgcaatggcaatcccagtgttgaatggccgagaagcttgancaaatctgaggcggggggcatgggtaacgaaaaagggttgcgatctggaggaattcaccaagtcccctttggccgctttacatgaacttcccaattcttgtcttggggtccagtccccgggggttaaaacttagtagcaacaaaaccggggaggggaaaaatcctcccccgccagacccaaaaaggtttggggttggcatttccggaaacttaacaaattcccggggggtgggggggcccggccccccccgtggggcccgaaacccaattccctgtggggccccaa

SEQ ID NO: 79079 - protein, 168 aa, Zea mays
  misc_feature: Ceres CLONE 1564084
  misc_feature (14)..(38): Pfam Name: zf-A20 Pfam Description: A20-like zinc finger
MEHKEAGCQQPEGPILCINNCGFFGSAATMNMCSKCHKEMIMKQEQAQLAASSIDSIVNGGDNGKGPAIAATVGVAVPQVEEKTIAVQPMHVADTSEAAAVIAKANEGPNRCATCRKRVGLTGFLLPMREHVLFDAPLLRQHDCQFDYRTAARDAIAMAIPVLNGREA

SEQ ID NO: 79080 - DNA, 855 bp, Zea mays
  misc_feature: Ceres CLONE 1564087
  misc_feature: Encodes the peptide sequence at SEQ ID NO. 79081
ctggagctccccgcggtggcggccgctctagaactagtggatcccccgggctgcaggaattcgtctcacccctagaaaaaaacccaacaaccccctcctcccctccccttctgtcttattgccacctctccacgtctccaccaaacaaggcaacaagggagaagtagatctgcatctgcgagaggaggcagcgggggtggtgatgatggagagccagccgctgcaggccccgacggccacggctccggcccccggatctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccctccaagacaatcccctatgtatggaccgtctttaccgctggttacatcgagcaagtcctcccaggggccattggcagttctcttggtcttctcttttgtggaaaggacattgaaccagcatggggccgcaaggaattcttgaagttcattattttgatcaactccatctgtggcatttctgcattttgctttgctattggactctactacgtcactggaaaggagagcttccttgtcacaccactttctggtttccacggttgccttgctggctttcttgtggccctgaaagcactcttaccaaacctggagcttcctatgtgctttttctgggaaataaagggcaagtggatgccaatctttggttgatgtttctcaagtatcagggccttcatcggtgctgaatccttaaactcctgcccactttggggttccggaatgtaccttaactg

SEQ ID NO: 79081 - protein, 189 aa, Zea mays
  misc_feature: Ceres CLONE 1564087
  misc_feature (67)..(165): Pfam Name: DUF1751 Pfam Description: Eukaryotic integral membrane protein (DUF1751)
MMESQPLQAPTATAPAPGSAEPAGAPPAVTPGKEFTRTCKGLVVVLIGGYVLLQLLPSSLNYLAIIPSKTIPYVWTVFTAGYIEQVLPGAIGSSLGLLFCGKDIEPAWGRKEFLKFIILINSICGISAFCFAIGLYYVTGKESFLVTPLSGFHGCLAGFLVALKALLPNLELPMCFFWEIKGKWMPIFG

SEQ ID NO: 79082 - DNA, 956 bp, Zea mays
  misc_feature: Ceres CLONE 1564088
  misc_feature: Encodes the peptide sequence at SEQ ID NO. 79083
  misc_feature (742)..(742): n is a, c, t, g, unknown, or other
tccccgcggtggcggccgctctagaactagtggatcccccgggctgcaggaattcgtctcacccctagaaaaaattaaagtcccatccgcggctccgccctcctctgtgtcttccttccacctgaaaacccaacccacacgctcgcgcctccgcgaagaaaaacaccgaggcccatggcgccgagaacgtcagagagagcgatgacatcggcggccgcggggctcgcgcgtggcgccggcccgcactacagaggcgtcaggaagcggccgtggggccggtacgccgcggagatccgcgacccggccaagatgagccgcgtgtggctcggcacgttcgacacgcccgatgacgccgcgcggccctacgacgccgccgcgcgcgagtaccgcggccccaggccaagaccaacttccctttcctttgtgcctggccgtcgccccccgggacttggcggtggtttgccgaaaggaaaatgaacagcaccccccccccccccccgggaacccttggggggggaaattggaggggccccccagggggggaaggccgtcccccccgtcttttaagccaaagccccccaaaacctttcccttttgagggtgccccccggggacccccccgttaattttttttggggggggggaaaaggggggggccttttgtgaaaagcccccccccaaaaggggagggggggggtaaaaaaaacttttcccccctcccccgaggagaaatatccccccnccccccgcgcccccggttgataaaaaaaaaaacccccttttttattttataataaatccccccccgccggggggggaagaaaacccccgcggtttttataaaacacccgttttttttcttttttccccaaaaaaaaaaaaggggggggggccctcttttatgggggggggggccccccccccctcaggttttgtttttatagaaaaaaaagtgg

SEQ ID NO: 79083 - protein, 100 aa, Zea mays
  misc_feature: Ceres CLONE 1564088
  misc_feature (23)..(74): Pfam Name: AP2 Pfam Description: AP2 domain
MAPRTSERAMTSAAAGLARGAGPHYRGVRKRPWGRYAAEIRDPAKMSRVWLGTFDTPDDAARPYDAAAREYRGPRPRPTSLSFVPGRRPPGLGGGLPKGK

SEQ ID NO: 79084 - DNA, 1243 bp, Zea mays
  misc_feature: Ceres CLONE 1564090
  misc_feature: Encodes the peptide sequence at SEQ ID NO. 79085
  misc_feature (63)..(63): n is a, c, t, g, unknown, or other
  misc_feature (831)..(831): n is a, c, t, g, unknown, or other
ttccgtttgtgcggcgcgttaccacgaccgagggcgatgtttccatataactctttctttccnaaaaactggagctccccgcggtggcggccgctctagaactagtggatcccccgggctgcaggaattcgtctcacccctagaaaaaaactcacacagccatctctcccagtgtcccagctcagctgagcaatccgtctcactatctacaggcgggggaattaatagatggagggcaaggaggaggacgttcgcctgggcgccaaccgctactccgaacgccagccaatccgtacggcggcgcagggcacggaggagaaggactacaaggagcctccggcggggccgctgttcgagggggaggaactgaccgtctgggccttccaccgggccggggatctccgaatttcggggcccctcccggtcccgggggggtagtatcctgactgtgaaggggggagcccccccccgtcaacaaagggggccactggggggattctaggggaatccggggggtctttttctgcgggatggattattccagcccggttgtaattaacagaccgggaatttatcggaggggcaataattaaacccgggggggtacatctctcggggggttattttggcggggccgaagaaaatagtctcttgtcaagggggggggtctcccttttaatatgtttatctttatcactgggggcccccgggggtatccctttattgtctgaggcacggcgctgggtcaccgctcacgagaagagctcgacagacgaagaggggcaccctattactaatgggggaggaacccccgcgagctgtaagcataanccatacaaagatcatgcgtttaataatgctgcgcgggtgggaacccctacacaggggccaaaatgtgaggcctcccgtgtgggtgggaatgaaacaatgtcttgtggtaccctttgatgggtggggagtgttagataatatgaggggtggattttatcttcgcatgagggcgcgtgagaaactatgtggaggtcctcacagagttacctctcacgacggtgaacattatatctgatagcggagatagtgtccacaacaaatgatgtttgcgcgcgattttttttctggggttaccagggtggggatatatgtgtccacgttaatggggggaggcagagtgtataaccacccttcgcgttacatctagacgtgcgctccgctctacttgtatataagagtaggctcgcccgag

SEQ ID NO: 79085 - protein, 69 aa, Zea mays
  misc_feature: Ceres CLONE 1564090
MEGKEEDVRLGANRYSERQPIRTAAQGTEEKDYKEPPAGPLFEGEELTVWAFHRAGDLRISGPLPVPGG

SEQ ID NO: 79086 - DNA, 835 bp, Zea mays
  misc_feature: Ceres CLONE 1564092
  misc_feature: Encodes the peptide sequence at SEQ ID NO. 79087
  misc_feature (581)..(581): n is a, c, t, g, unknown, or other
  misc_feature (612)..(612): n is a, c, t, g, unknown, or other
  misc_feature (613)..(613): n is a, c, t, g, unknown, or other
  misc_feature (667)..(667): n is a, c, t, g, unknown, or other
ctccccgcggtggcggccgctctagaactagtggatcccccgggctgcaggaattcgtctcacccctagaaaaaaggaccaccagagagccacagcaccagcggcaggcacccaaagcccaggaccgccaatggccgaccgcgtgtaccccgccgccaagccgaacccgcctccaggcgcggcgggcaacagcaacggcgcgcaggcgtcgtcgttccctgcgcccaagtcgcagatgtaccagcggcccatctaccgtccgcaggcccccgcgaagcggcagcgcgggcggtcgtgccggtgcagcttgtgctgctgcttctgctgggcgctggtggtggtgatcctgctggcgttcgtggccgcggtgtgcggcggcgtcttctacctgctgtaccggccgcagcggccgtcgttcagcgtgtcgtcagtgcggctggcgtcgctgaacctgacgtcgtcggcgacggcgcccgtgctgagcgacgccatcacgctgaccgtgacggcgcggaaccgaacaagaagatggtgtacctgtacgacgacctgaccctgctgggtggcactgccgccaacgncgtgccgctggggagcgccaccgtgactggnntcgcgcacgcggccggcacaccactgtgcttgacggccaccgtctccgccagcnccggtgggcgtggaccccagcggcagccagctcgaacatcaagcggtcccggcggcggtcgtttctccggggggggtgaacccggaccccaacgcccggcgttccggggtggccggcctttaacaacaaaaaaattcggcttcccagttgcacctgccaagggcctaa

SEQ ID NO: 79087 - protein, 140 aa, Zea mays
  misc_feature: Ceres CLONE 1564092
MADRVYPAAKPNPPPGAAGNSNGAQASSFPAPKSQMYQRPIYRPQAPAKRQRGRSCRCSLCCCFCWALVVVILLAFVAAVCGGVFYLLYRPQRPSFSVSSVRLASLNLTSSATAPVLSDAITLTVTARNRTRRWCTCTTT

SEQ ID NO: 79088 - DNA, 906 bp, Zea mays
  misc_feature: Ceres CLONE 1564094
  misc_feature: Encodes the peptide sequence at SEQ ID NO. 79089
  misc_feature (567)..(567): n is a, c, t, g, unknown, or other
  misc_feature (638)..(638): n is a, c, t, g, unknown, or other
  misc_feature (665)..(665): n is a, c, t, g, unknown, or other
  misc_feature (683)..(683): n is a, c, t, g, unknown, or other
  misc_feature (843)..(843): n is a, c, t, g, unknown, or other
ctccccgcggtggcggccgctctagaactagtggatcccccgggctgcaggaattcgtctcacccctagaaaaaatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgcttgggaactctctctttgggtggaactgnccttgcccatggttctctcatcccactcgtactgctattcgacacgctacaatcttgagggtagctttgangctttcccaggcaatgtgggtgctgcngcgatctggtcgaagacnatgagaggcgtgagcacctatgagcccgctgtgaccttgcaaccactacctctgccacccctgcgcccctctgcaagaaggtcgcgagcttcgccgcagggtccccaccttggattcacaatgggcactccgtctttgtcatgatgcggcccatggacantacaatggggcgtggcatgtgagctattccaccaccttccctgccctagtttaatctgggctt

SEQ ID NO: 79089 - protein, 171 aa, Zea mays
  misc_feature: Ceres CLONE 1564094
  misc_feature (64)..(162): Pfam Name: PLAC8 Pfam Description: PLAC8 family
  misc_feature (133)..(133): Xaa is any aa, unknown, or other
  misc_feature (157)..(157): Xaa is any aa, unknown, or other
  misc_feature (166)..(166): Xaa is any aa, unknown, or other
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGLYLLGNSLFGWNXPCPWFSHPTRTAIRHATILRVALXLSQAMWVLXRSGRR

SEQ ID NO: 79090 - DNA, 966 bp, Zea mays
  misc_feature: Ceres CLONE 1564095
  misc_feature: SWISSPROT Homolog: EC 2.3.1.16 Acetyl-CoA C-acyltransferase
  misc_feature (711)..(711): n is a, c, t, g, unknown, or other
ccgcggtggcggccgctctagaactagtggatcccccgggctgcaggaattgcgtctcacccctagaaaaatctctctcgcctctgtttgttccttggagccgcccccgccgcccacgccaccggtcgcccctgccccgaccccttccgccgcggtcgcgaccgcccccgaccccagccctgcccgacgcttccgtttccttggatgaccacaacgctcgcccgcccgccggcaagcgaaagcaaagcgagccaacctagccatggagaaggcgatctatcggtagcgggtcctcctggcgcaccttctcccctcctcctctaccatctcctcgcagcctcagcttgcggcgtcgacgtgcgcggccggggatagcgccgcctaccagaggtcctcctccttcggggacgatgtcgtcgctgcctacaggacgccaatatgcaaggccaagcgaggaggcttcaaggacacctacccagaggacctcctcactgttgttctcatggttcccttcccttcaaggtcaaccaccagtgttcatctgggctacaggcagtagccgatgtcgcagctgctataaaggctggttactatgacatagggattggtgctggtttggaatccatgtccataaattccatttgctagggaaggacaagttaaccccaaaattagcgcattccagaaagcacaggattggcctctggccanggggatttacctccggaaaatgttgcccatcgatttgggggtgactagacaagaagcagatccggccgccccctgagtctcataagaaagctgcttgcaccctgggcccccagaaaacccagggagaaatccgccccgtgccaacaaagacgttgatcctaaactggaaaggaaaagaaattgtgatatcattttaaattgggattgggcagggcccccacctctgggttggggaaacccaaccaggttttaaag

SEQ ID NO: 79091 - DNA, 1017 bp, Zea mays
  misc_feature: Ceres CLONE 1564098
  misc_feature: Encodes the peptide sequence at SEQ ID NO. 79092
  misc_feature (295)..(295): n is a, c, t, g, unknown, or other
  misc_feature (314)..(314): n is a, c, t, g, unknown, or other
  misc_feature (888)..(888): n is a, c, t, g, unknown, or other
  misc_feature (958)..(958): n is a, c, t, g, unknown, or other
acccgcggtggcggccgctctagaactagtggatcccccgggctgcaggaattcgtctcacccctagaaaaaatccatccccaaataatccccacctcccgctcatcctccgcctccgccgcccgccatggcctccctcacctcggcctccacctcactcctcttcccgcaggcctcctcatccaggagccgcgtccggctctccacctccctgggcttctccgcgcagccggcgcggctgcggagccgggcggcggcaggagggcagcggcgcgtgagcctgctggtggtgcgncgcgctaggggaaagttcnagcgcaccagcccgcacgtaacatcggcaccatcgtcacgtcgaccacggaaaagacaccctcacggcgcgctcaccatggtgctccgcttcgtccggggaagcccgccaagaagttcaacgaagttctatccccccccccagggaagggggccgggggtttacccttaaaaaacccccccccgttgaaataaaaaaaccaaaaacccccccattaaccccaattttttaatgcccccgggccccccccaaatttttgcaaaaaaaatggacccccccggccccccccacaaaaagagaggggggcccctccttttttttttttcttttggggcgccaaaaagaggtcccctcctgcgacaaaaaaaaaaaaaagaaaaaattttttctctccccccaaaaaaaagagggggcggggccccccaaaaaaagagtgttttctcccccaaaaaaaaaaaaagaaaggggggggcaaaacaaaaaaagagagggcccgcctcctccccaaaggaggaaaaaaaccgcgccgcccgccccaccatttatttaaaaaaacagaggggaggaagagggtntttttttgtggggggctcccccccccggagagggggcgctcgccgtgtgtacccccccctccccaataanagaaaaaaagaaaggggggggcggcaccccccccgcggggtggtgggttgtgccccccc

SEQ ID NO: 79092 - protein, 30 aa, Zea mays
  misc_feature: Ceres CLONE 1564098
MVLRFVRGSPPRSSTKFYPPPQGRGPGVYP

SEQ ID NO: 79093 - DNA, 829 bp, Zea mays
  misc_feature: Ceres CLONE 1564099
  misc_feature: Encodes the peptide sequence at SEQ ID NO. 79094
  misc_feature (790)..(790): n is a, c, t, g, unknown, or other
agctccccgcggtggcggccgctctagaactagtggatcccccgggctgcaggaattcgtctcacccctagaaaaaccccctagaaaaagcacaatccatccatccatctattctccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgagaagctgccaaccctgcatggtgtggcaancaggtgcaatgatcctcagctgacagactccatcgagag

SEQ ID NO: 79094 - protein, 212 aa, Zea mays
  misc_feature: Ceres CLONE 1564099
  misc_feature (91)..(212): Pfam Name: Ferritin Pfam Description: Ferritin-like domain
  misc_feature: SWISSPROT Homolog: EC 1.16.3.1 Ferroxidase
  misc_feature (200)..(200): Xaa is any aa, unknown, or other
MMLRVSPSPAAAVPTQLSGAPATPAPVVRVAAPRGVASPAAGAACRAAGKGKEVLSGVVFQPFEEIKGELALVPQSPDKSLARHKFVDDCEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLPTLHGVAXRCNDPQLTDSIE

SEQ ID NO: 79095 - DNA, 893 bp, Zea mays
  misc_feature: Ceres CLONE 1564102
  misc_feature: Encodes the peptide sequence at SEQ ID NO. 79096
  misc_feature (516)..(516): n is a, c, t, g, unknown, or other
ctccccgcggtggcggccgctctagaactagtggatcccccgggctgcaggaattcgtctcacccctagaaaaaacgccgctgctccaagaaaccaccgccgagcccaaccgcacaagcgcgcgaggcaggagagagagagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggtatccagggcatcgcctggtccttcggaagaatgatcttcgcgctcgtctactgcaccgccggcatctccggaggacacatcancccagctgtgactttcgggctgttcttagcccagaaagctgtccctgactaggggccctcttctacatatcatgcaatgccttgggtgccatctgtggaacctgggattgggtaaggggcttcccacagggacctttccttgggcaacgggggggggccccaaaggttggccccccccgggcaccccccaagggggaagggcccttggcccttaaaattttgggccccttttatcctagtttaaaaccgggttttctcccccccccggtcccaagagggaagccgggggactccccgtggttccttattcttgccccccctaggaaaatggggggtttcgggggtgtttctgtgggcccactttgcgaccccccccc

SEQ ID NO: 79096 - protein, 133 aa, Zea mays
  misc_feature: Ceres CLONE 1564102
  misc_feature (47)..(133): Pfam Name: MIP Pfam Description: Major intrinsic protein
  misc_feature (117)..(117): Xaa is any aa, unknown, or other
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGRMIFALVYCTAGISGGHIXPAVTFGLFLAQKAVPD

SEQ ID NO: 79097 - DNA, 1029 bp, Zea mays
  misc_feature: Ceres CLONE 1564107
  misc_feature (1029)..(1029): n is a, c, t, g, unknown, or other
acccgcggtggcggccgctctagaactagtggatcccccgggctgcaggaattcgtctcacccctagaaaaaaccaccacccaatcactcccgtctcgctctgcaccactcaaacctcttcttcctttccggataccacaccagcagtccccgcaagctgcagcttccccggccgccgcgcccaagccccagctgcctcgatcgctcgagagccacaacaccactcccacagcaggtcaaagctggaagaatgccgcagtcgcagcgatgaaggctctcccggtccgcgcttcgccggtgcggcaactgcaaccccgtcggaacttcccaggggcccctacccgggggctggattcgcctttccacgggggtgtcgggcatggcccctggggaacccggggggggaaacccccgggcgggggggaaaggggcctgttttgtccccccccttccccccccgtaaatcccttttttccggggggagggaaaaaaaaaaaaaaccccggggggggggggtgaaaaaaaaccccgggggaggcaaaaaaaggggggggcccctctcccttttaaaaaaacccacgggggggtgttccccacttcgcgggggagagcggggggaaaaaacaaggcgctctttataatttataataacaaaaaaaaggggggggggtgtgccccccgggagggggaagaaagacccaccttttctttatatacaaaaacaaccttacgccaaagaaaataagaaagaaataatattctattcccacccccccccgcggggggggaggaaccactctttctcctttcacggggaggggggccatttttgcccgaacccaccccccttatttctgttaatacaaaaaaaaacccgactgtttatataaataacattgttcgccctgatctccaaccccgaagtgatgagaaggtggagaatttttttttttgttttttttttcacacccctctcttcacacaccccctgggatgatgtttattatagagcccataccgagaattttn

SEQ ID NO: 79098 - DNA, 841 bp, Zea mays
  misc_feature: Ceres CLONE 1564108
  misc_feature: Encodes the peptide sequence at SEQ ID NO. 79099
  misc_feature (467)..(467): n is a, c, t, g, unknown, or other
  misc_feature (483)..(483): n is a, c, t, g, unknown, or other
  misc_feature (497)..(497): n is a, c, t, g, unknown, or other
  misc_feature (570)..(570): n is a, c, t, g, unknown, or other
  misc_feature (651)..(651): n is a, c, t, g, unknown, or other
  misc_feature (763)..(763): n is a, c, t, g, unknown, or other
  misc_feature (771)..(771): n is a, c, t, g, unknown, or other
agctccccgcggtggcggccgctctagaactagtggatcccccgggctgcaggaattcgtctcacccctagaaaaaagctttctggcatcgctactaccagacagagaggacaggggaggtcagactcagaaacgctcgctcacgacggcagcagccatggcagcatcgtgcggcggccgcgtggtggtcttccctttcccgttccagggccacttcaacccggtgatgcgcctggcccgcgcgctgcacgcccggggcgtcgggatcaccgtgttccacaccgccggcgcgcgggcgccggacccggccgactaccccgccgactaccgcttcgtgcccgtgcccgtggaggtggccccggagctgatggcgtccgaggacatcgccgccatcgtcacggcgctcaacgccgcctgcgaggcgcccttccgggaccgcctctcggcgctgctctccgccgccgacngcgaggcggggaaggncgggggggccgcgntccgctgcgtcctcaccgacgtcagctgggacgccgtgctgtcggcggcccgcgggcctcggcgtgcccgcgnctcggcgtcatgacggccagcgccgcaacgttccgcgtctacatggcgtaccgcaccttggtcgacaagggatacctgctngtgagagagagcgcagggacaacgcggtcgccgagctacccccgtaccgcgtgaaggacctgctgcggcacgagactgcgaacctggaagagtcgcgaacctgctggggccncgtggtcncgggcggcccggctgtcctcggggctcatcttccacacgttccccttcatcgaggccgcacccttgggca

SEQ ID NO: 79099 - protein, 141 aa, Zea mays
  misc_feature: Ceres CLONE 1564108
  misc_feature: SWISSPROT Homolog: EC 2.4.1.195 N-hydroxythioamide S-beta-glucosyltransferase
  misc_feature (104)..(104): Xaa is any aa, unknown, or other
  misc_feature (109)..(109): Xaa is any aa, unknown, or other
  misc_feature (114)..(114): Xaa is any aa, unknown, or other
  misc_feature (138)..(138): Xaa is any aa, unknown, or other
MAASCGGRVVVFPFPFQGHFNPVMRLARALHARGVGITVFHTAGARAPDPADYPADYRFVPVPVEVAPELMASEDIAAIVTALNAACEAPFRDRLSALLSAADXEAGKXGGAAXRCVLTDVSWDAVLSAARGPRRARXSAS

SEQ ID NO: 79100 - DNA, 972 bp, Zea mays
  misc_feature: Ceres CLONE 1564111
  misc_feature: Encodes the peptide sequence at SEQ ID NO. 79101
  misc_feature (329)..(329): n is a, c, t, g, unknown, or other
  misc_feature (358)..(358): n is a, c, t, g, unknown, or other
ctccccgcggtggcggccgctctagaactagtggatcccccgggctgcaggaattcgtctcacccctagaaaaaaaaaaggaaaaaaaaacatcaataataatccactgcggtcgctcgtcctcctcccaacctcctcccaagttgcctcgtgctctgcttcttcggttttcaggagcgtcggccattgctgctggaaaagcagaccattgggactccctcgtgcgttttccaaatcagtcaggttgatggcgatggagggaccagttttatgccgccctgcaatgcaagccaaatcgcctgctgctgcgctggtcaacaactccctgnacagattcgggcagcttgagaccatttcnaaatacaggaacgttttcagattcatttctcccatctctcagccatctacgaagaacataggtccatgctgtagcttcagctcgtcttctgatggcaatggatacatggctggaaactttagcgacagtgatgaagattatgttaattctactgtgctagaggcagttgaggggagaagtggattcggaaggatatgtgataaagatgcgagatgggaaaaacttgcgttggggtcctaaccattctcaagggagaaatattccgaagagggcacccccaacctgcttattgtttgaagaattgaaaatgggagccaaaactttactcccaatcattgttttggaaatgccaaggggtccttctgatgggggcgcttttcgtaaaggcccaatttgcccgaacaacccttttttccaatttgtccaggaaattattggtaaaagggggcctttaggggaaaacttggtccggggaaaaaaaagaatttaagaaaacgttccgggggggaaactttgtcaaacaaattttggttgtttctaagaaaggggttcccctttttattttgggctttgaagaaccacaaaaactttcttgttctttgaaaggggctcca

SEQ ID NO: 79101 - protein, 116 aa, Zea mays
  misc_feature: Ceres CLONE 1564111
  misc_feature (28)..(28): Xaa is any aa, unknown, or other
MAMEGPVLCRPAMQAKSPAAALVNNSLXRFGQLETISKYRNVFRFISPISQPSTKNIGPCCSFSSSSDGNGYMAGNFSDSDEDYVNSTVLEAVEGRSGFGRICDKDARWEKLALGS

SEQ ID NO: 79102 - DNA, 1780 bp, Zea mays
  misc_feature: Ceres CLONE 1564112
  misc_feature: Encodes the peptide sequence at SEQ ID NO. 79103
aagctagcagcgtccctgctgctccgcgccacacctctccgcttcattcctatccgtctcccctgctctatcgtcgtcctcctccgtcgggccggaggagcgtctctttgtcggcgcagcgtgcagagcaccgcagattcagagacacgatgatgtcgcgacagtgtgcaaaccgcatctttcttaccggaggttccagcttcctccatggcctcaaatctagagttgcatccagtaggagtcacggcaccgtcagactcaactggcgctgcgtgagaactaatctctggagggccgagcgccttggtgtcaaggctactccgtctgagcatatcattgcagtactgcaagcgtcagatattttcagtggcatcaggaaatggagcaagttgcaattggtcgccatgacaggggtgatggcatgtgtagttctggtagtcccttcttctgatgcagtcgatgctctcaagacatgcacttgcctgctaaaggaatgcagaatagagctggctaaatgcatagcgaacccatcctgtgcagcaaacgtagcatgcttgaacacgtgcaacaatcgacctgatgaaactgaatgtcagataaaatgcggagacctgtttgagaacagtgtagtcgatgaattcaatgattgtgctgtttcacgcaagaaatgtgttccaaaaaaatccgacgtcggcgagttccccgtccccgatccatcttcgctggttaagagcttcaacatggcagattttaatggcaaatggtacatttcaagtggcttaaacccgacgtttgacacattcgattgtcagcttcacgagtttcatgtcgagggagacaaattgatcgcgaacatcacatggagagtccgcaccccagactctggcttctttaccaggtcaaccgtgcagcgttttgtgcaggacccatcgcagcccggcatactctacaaccatgacaatgagttcctgcactatcaagatgactggtacattatctcatccaaggttgagaacaaggatgacgactacatatttgtgtactatcgtgggcgaaatgacgcatgggatggttatggtggttctgtattgtacacaagaagtaaaactgtacctgaaacaataataccggagctggaaagagctgcaaagagcgtaggtcgggacttctcgacgttcatcatgaccgacaacacctgtggtcctgagcctcctcttgtggagagaatcgagaaaactgtggtggaaggagagaagaccatcgtcagggaggtgaaggagatcgaggaggaggttgaggagctggagaaggaggaggcgtcactgtttcagaagctggcagaaggtctcatggaggtgaaacaggatttcatgaacttcttgcaggggctgagcaaggaggagatggagctgttggatcagctcaacatggaagcgactgaagttgagcaagtcttcagccgtgcactaccgttgaggaagctaaggtagctgcagagcaaaggacttggagaaaacaagccatcaagtactggccgaaacggattctatttgccacagcagtacccacagtagagattgttgaacagatacaacaaacatttttaattttcttttctttttcttttcttttcttttcttttctttgtttacccttttctgtggtcaaaacacatgcctacgttagccctatttgtaaagcatcaagagacaacgtaactttttcttgccaaacagagaaaaaaaacaagtgtacttaagaccaaaaaaaaaaaaaaaaa

SEQ ID NO: 79103 - protein, 446 aa, Zea mays
  misc_feature: Ceres CLONE 1564112
  misc_feature (163)..(360): Pfam Name: VDE Pfam Description: Violaxanthin de-epoxidase (VDE)
  misc_feature: SWISSPROT Homolog: EC 1.10.99.3 Violaxanthin de-epoxidase
MMSRQCANRIFLTGGSSFLHGLKSRVASSRSHGTVRLNWRCVRTNLWRAERLGVKATPSEHIIAVLQASDIFSGIRKWSKLQLVAMTGVMACVVLVVPSSDAVDALKTCTCLLKECRIELAKCIANPSCAANVACLNTCNNRPDETECQIKCGDLFENSVVDEFNDCAVSRKKCVPKKSDVGEFPVPDPSSLVKSFNMADFNGKWYISSGLNPTFDTFDCQLHEFHVEGDKLIANITWRVRTPDSGFFTRSTVQRFVQDPSQPGILYNHDNEFLHYQDDWYIISSKVENKDDDYIFVYYRGRNDAWDGYGGSVLYTRSKTVPETIIPELERAAKSVGRDFSTFIMTDNTCGPEPPLVERIEKTVVEGEKTIVREVKEIEEEVEELEKEEASLFQKLAEGLMEVKQDFMNFLQGLSKEEMELLDQLNMEATEVEQVFSRALPLRKLR

SEQ ID NO: 79104 - DNA, 922 bp, Zea mays
  misc_feature: Ceres CLONE 1564114
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (73)..(73): n is a, c, t, g, unknown, or other
  misc_feature (75)..(75): n is a, c, t, g, unknown, or other
  misc_feature (76)..(76): n is a, c, t, g, unknown, or other
  misc_feature (347)..(347): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
nnnttttnnnnnnnnnnnnnnnnnnnnnggggnnnnnnnnnnnnnnnnnnnnnnnnnnnnnccccannnnggngnnaaaaactgggactcacgcggtggcggccgctctagaatagtggatcccccgggctgcaggaattcgtctcacccctagaaaaagtgcaccacgcaccagcagcagcgaggagctagagcagcggcagagcgcgcagcgcacaccacgcatcgtacgtcctagctcacgatggcggccgcctggtccttgctcgcgctcgccctatcgctctgctccgtcgcggcccgtcgccggttgcagcagggtggaacaccgtggcccgcggccgcancaagggcgcggaccgggtggcggggctcccgggggcaccccccccttggggttccgcccaaataaccccgggttaccttaaacccgtgaaaaaaaaaaacccccgggccccgccccgcccttttttaaccgggggttctttcaagggccacccccggttttcccccaaaaaaaaaaaaacccccccccggggccctgggggcctcaacaaggcgggggggccccccgggggggtcctctcccccaaaaaatggggggaacacccggggggaaaaacccccaaaaaaaaaaaaattgtgggggccccccccctttttttggggggggggccaaaaaaaagggggagaaaccccccgggaaaattctttttaggtgggagaaaaaatatttttttcctcttggtggaaaaaacaaaaagagaggggcccccacccccttttttttttttttttcctgagagaaaaccccccccccgggggggggggggggnnnnnntttttttttttcccctaaacaaaaaaaaaacccggggggaatctcctcccccccggtttggtgtgaaaacaccctttgggg

SEQ ID NO: 79105 - DNA, 924 bp, Zea mays
  misc_feature: Ceres CLONE 1564115
  misc_feature: Encodes the peptide sequence at SEQ ID NO. 79106
  misc_feature (761)..(761): n is a, c, t, g, unknown, or other
  misc_feature (808)..(808): n is a, c, t, g, unknown, or other
  misc_feature (810)..(810): n is a, c, t, g, unknown, or other
ctggagctccccgcggtggcggccgctctagaactagtggatcccccgggctgcaggaattcgtctcacccctagaaaaaacttccgttcccctggcctggccccgtcctctgttccagcgtttgccgccgctctgcacaagccctgcctaccgatgtccgtcgcgtccgtggccgccctccggacggccggctccggccgccgccgcggcgcgggttcccagcagaccggccttaacgggggcaggttcctgatgatgcagaggagggagctggtgaccaaggccgggatcccgctcgccgtctcctgctcgatggctacctcaccggcttcagccaacggcgctgctcaagggctggagattttgccgttcaaagctgacgggtacaacttctggacgtggcggggtcgccggatacactacgtcgagcaaggcgcggggcggcccgtcgtgctcatccacggcttcggcgcttccgccttccactggaggtacaacatccctgagctggccaagaagtacaaggtgtacgccatagacctgctggggttcggctggagcgagaaggcgctggtggactacgaggccaccatctggatggagcaggtctccgacttcctccgtgagatcgtcaaggagccagccgtccttgtaggcaacagcttgggaggcttcacgacgctgttcacggccaccgatgtgccggatctgggtccggggcgtcgtgctcctcaactcccgcgtgcagttcgccgacccntacagcggcgcccccccccggcaagaaaagaaagaatgggggcatcncnctgtccatgtacatcgtgcagccgctcaagagcctttccagcggttggtgctggggctcctcttctggcagtccagcagcccgccagggtcgagaaggtctgaaagcttgtaca

SEQ ID NO: 79106 - protein, 252 aa, Zea mays
  misc_feature: Ceres CLONE 1564115
  misc_feature: SWISSPROT Homolog: EC 3.3.2.10 Soluble epoxide hydrolase
  misc_feature (203)..(203): Xaa is any aa, unknown, or other
  misc_feature (219)..(219): Xaa is any aa, unknown, or other
MSVASVAALRTAGSGRRRGAGSQQTGLNGGRFLMMQRRELVTKAGIPLAVSCSMATSPASANGAAQGLEILPFKADGYNFWTWRGRRIHYVEQGAGRPVVLIHGFGASAFHWRYNIPELAKKYKVYAIDLLGFGWSEKALVDYEATIWMEQVSDFLREIVKEPAVLVGNSLGGFTTLFTATDVPDLGPGRRAPQLPRAVRRPXQRRPPPARKERMGASXCPCTSCSRSRAFPAVGAGAPLLAVQQPARVEKV

SEQ ID NO: 79107 - DNA, 880 bp, Zea mays
  misc_feature: Ceres CLONE 1564116
  misc_feature: Translation starting site: 233
  misc_feature: SWISSPROT Homolog: EC 3.2.2.22 rRNA N-glycosylase
  misc_feature (790)..(790): n is a, c, t, g, unknown, or other
  misc_feature (828)..(828): n is a, c, t, g, unknown, or other
ctggagctccccgcggtggcggccgctctagaactagtggatcccccgggctgcaggaattcgtctcacccctagaaaaatgctctgcccacgtcccagtccccggtcgcgttctcttccgaggcgacatgggggccggcagcggatagaggaacaccccaaccaacgagcaactgctggggtacgctgagctgcccaaacgtggccgcgacatggctggaggtgttcgccgatgggcatgcccgagcggcggctgaggaaacctgccgcccggtggcagtatcgttttctacggcggccactgctgcagcgatttcgtttagcagctggagtcgcactggaagaggaagaagacaccactaagcacatctgcgacagtcagggaaacctcgtgctaacagggccatcattggccacctcagcatacaggccaattgctttcttcctcgtacctccatgatggcagcccgcaagccggagaagccaccgaggacgacaaggacgtcgggaggatactctgcgactgcatcggcgacgacttctccagctacaacaagggcatagacgagactgtccaagcgggcatatggccccgctgaaacgatctatgccgtcctgagcaacggcggccaatgacgggtcgccatacaacttgctcgcccgccggtgtccgaagcaggagaagaacacgccgccaccgtgctaggtcaggatccgtgctcgcaccaggctgttagacctcggctacgagctcttctacaaagagcgtgacaatgatactgaacgtgcnacggggggggctgcatcagttggcgagggcagcgctcngcctacctgctgcacatcctgctgacgaatggagcttgaactgcatcgctat

SEQ ID NO: 79108 - DNA, 885 bp, Zea mays
  misc_feature: Ceres CLONE 1564117
  misc_feature: Encodes the peptide sequence at SEQ ID NO. 79109
tggagctccccgcggtggcggccgctctagaactagtggatcccccgggctgcaggaattcgtctcacccctagaaaaaattaaagtcccatccgcggctccgccctcctctgtgtcttccttccacctgaaaacccaacccacacgctcgcgcctccgcgaagaaaaacaccgaggcccatggcgccgagaacgtcagagagagcgatgacatcggcggccgcggggctcgcgcgtggcgccggcccgcactacagaggcgtcaggaagcggccgtggggccggtacgccgcggagatccgcgacccggccaagaagagccgcgtgtggctcggcacgttcgacacgcccgaggacgccgcgcgggcctacgacgccgccgcgcgcgagtaccgcggcgccaaggccaagaccaacttctccttcccttcgtgcctgccgctcgccgccgcggacgtggccggcggctgccggagcggcaacagcagcagcaccaccaccaccaccaccgtcgactccttcggcggcgacgtgcaggcgccgcccatgcatgccatgccgctcccaccgtccttcagcgccagcgccgccgtacgcttccctttcagcggctaccccgtgacgcacccgtactacttcttcgggcaggcggcagcagggtgccatatgctgaagctgccaccgacgacggtgactgtggctcagagcgactctgactcctcgtccgtcgaggaactgtcgccgtcgccgcctggcgccgtgtcagcgactagagccgccgcgtttgatctcgacctaaactgcccaccgccggccgaggcggtagcatagtccgccggagttttgctgaaggactgccgtgtagtttcttttcgtcttttaccc

SEQ ID NO: 79109 - protein, 216 aa, Zea mays
  misc_feature: Ceres CLONE 1564117
  misc_feature (23)..(74): Pfam Name: AP2 Pfam Description: AP2 domain
MAPRTSERAMTSAAAGLARGAGPHYRGVRKRPWGRYAAEIRDPAKKSRVWLGTFDTPEDAARAYDAAAREYRGAKAKTNFSFPSCLPLAAADVAGGCRSGNSSSTTTTTTVDSFGGDVQAPPMHAMPLPPSFSASAAVRFPFSGYPVTHPYYFFGQAAAGCHMLKLPPTTVTVAQSDSDSSSVEELSPSPPGAVSATRAAAFDLDLNCPPPAEAVA

SEQ ID NO: 79110 - DNA, 858 bp, Zea mays
  misc_feature: Ceres CLONE 1564118
  misc_feature: Translation starting site: 113
  misc_feature: SWISSPROT Homolog: EC 2.1.1.146 (Iso)eugenol O-methyltransferase
  misc_feature (520)..(520): n is a, c, t, g, unknown, or other
  misc_feature (697)..(697): n is a, c, t, g, unknown, or other
  misc_feature (699)..(699): n is a, c, t, g, unknown, or other
  misc_feature (810)..(810): n is a, c, t, g, unknown, or other
ctccccgcggtggcggccgctctagaactagtggatcccccgggctgcaggaattcgtctcacccctagaaaaaagcgcacacacatacacaagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagcacggaggaggagcggtaccgcatcagccccgtgtcctacctcctggtggacggcatccctcacgaggaccacatgaaccacaccgctctggtgctcacctgcacctcgacgcgctacatcgaggcggggatagggctnggcggagtggttcaagagggacgtggtcacgtcaccgttcgaggagctgcacggggcgactctgttccacgagagcatggggagcctcgacgcagatttccacgacatggcgagcgaggccttggacgcccacgacaacttcggcatcgagatagctatgcgggagttcagggactngnttcgagggggatccagtccatgacctactgctgcgggtacttcggtggatgacaagggtgccagggccattgtcaaaaccttccacacataaaatgcactgtgctggcccntcccaagatcattgccaccaacccggcgaatgagcgaagataaccttg

SEQ ID NO: 79111 - DNA, 1221 bp, Zea mays
  misc_feature: Ceres CLONE 1564119
  misc_feature: Encodes the peptide sequence at SEQ ID NO. 79112
tttcatgttttacgacgcagcgtggtaaatataattacaaatgtagggggtatataaatctttttcaatagctggtactccccgcggtggcggccgctctagaatagtggatcccccgggctgcaggaattcgtctcacccctagaaaaatacaatccagtcgaccgttttctcagtctttagcctagcatgagagcagccttcaagtgaacacgcccgcgtccgtcttcgtcggacccttctccggcgacgagcaccccccacgccagttgcagatatctggtcatcagtacagaacttgaagtgtagattgtgatgtcggtgccgatgtataacaaacagaactcattggggaccccccctccccacaagacaaaccccttttctgattctgaagggccatcaagggcacagtctgtcccagtacgacacaccaatcaatctgtgcaagagttggaagattacgccctaaccaatgcaggagataaccacacaccaaggaaatgaatggtgtcagggctggttgaaacccatctggggaagaatgcttacccaaacccaggcttaactttttcacccgtccaagggtgaagcagaatcctgggcggttctccctttcaaggtaggccaagcggaacacattggagccaggggaaccttttacaggggggagttggaaaaaaacttttcctcgggggaaaatgtctgtggggtgggggggcttatatttttccccaaaggtctcttgggggaggaaacccaccaaagatgagaaaatatgtcccctttccggggattccataaaagaggggaccccccgctgttccttccccgcgggaaaaaaatatttaacacgtatttttctcgggggggagaacaaaacgagggcctttatactggaacacccgggataacaccaataaggggggggggaaaaccctattgggttaatatgtggccccccctgccaccattgcatgagaataattctccccacgttccattgtgttaaataatcacaacacccccgggtaatgttggcaaatgaggaagaaaaggttccggggcggtgagaagaaaaaaagacgggggggttgtgccccttttctcaccctggggtgtacactttggggacaaactccagtgaaaataggccgggatacttgggcccacaaatattccagggtgaaaaaaagtccggtgtttctcttcccaaacaca

SEQ ID NO: 79112 - protein, 63 aa, Zea mays
  misc_feature: Ceres CLONE 1564119
MSVPMYNKQNSLGTPPPHKTNPFSDSEGPSRAQSVPVRHTNQSVQELEDYALTNAGDNHTPRK

SEQ ID NO: 79113 - DNA, 854 bp, Zea mays
  misc_feature: Ceres CLONE 1564120
  misc_feature: Encodes the peptide sequence at SEQ ID NO. 79114
  misc_feature (628)..(628): n is a, c, t, g, unknown, or other
  misc_feature (739)..(739): n is a, c, t, g, unknown, or other
  misc_feature (749)..(749): n is a, c, t, g, unknown, or other
  misc_feature (766)..(766): n is a, c, t, g, unknown, or other
  misc_feature (788)..(788): n is a, c, t, g, unknown, or other
tggagctccccgcggtggcggccgctctagaactagtggatcccccgggctgcaggaattcgtctcacccctagaaaaaagccctaaactcacaagcccgtcacagaccgacaacgcctaggcaagcagcaagcgtacacgtaaacgtacacctacctcggcgagcaaaaggcaaaacgctgatcggagcaaccaacgaagcccgcagccatgccgacggccacggccacggcggctcctcgccacgccgcgctcttcctgctgctgctgctcggcctccacgccacgttcgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcgccggcgggtggggcggcggctacggcgggcccgccggcgggtacgcccgcggcggcgtggtggcgcccaccgtgacgtgctccgagaaggggccctgctacaggaagaaggtcacctgccccaagaagtgcttctcctcgtacagcggcgcccgcaagggatacngcggcggcggcggcggcggcagctgcaccgtcgactgcaaggtcaagtgcacggcctactggtgattcgactcgtccgctcttagcggtttgacagctagtgggctgggcngtgcggcctngctaactgctgttggtntgaatggcccgtgtgcttgccngtgagctgaagtacgccgggtgggttaactggtgttatcatccccaaaagaatactagcggaactt

SEQ ID NO: 79114 - protein, 160 aa, Zea mays
  misc_feature: Ceres CLONE 1564120
  misc_feature (13)..(148): Pfam Name: GRP Pfam Description: Glycine rich protein family
  misc_feature (140)..(140): Xaa is any aa, unknown, or other
MPTATATAAPRHAALFLLLLLGLHATFAAAARAGVAVDAELTSTKPSPVPKKPSVKPPGPGAASPTFPGFGIPGMGGFGIPGMGAGGWGGGYGGPAGGYARGGVVAPTVTCSEKGPCYRKKVTCPKKCFSSYSGARKGYXGGGGGGSCTVDCKVKCTAYW

SEQ ID NO: 79115 - DNA, 942 bp, Zea mays
  misc_feature: Ceres CLONE 1564122
  misc_feature: Encodes the peptide sequence at SEQ ID NO. 79116
  misc_feature (655)..(655): n is a, c, t, g, unknown, or other
ctggagctccccgcggtggcggccgctctagaactagtggatcccccgggctgcaggaattcgtctcacccctagaaaaactgctgcgtacggtgctacctctgacgatgaggatgccgcggaccgacccttctccatgccggttgccaccaggtccgcctccttctctccacctcccatgaagccgccgcggtgggaatctcacccatacctccctccaacccactgcttcccgcaaccacctctgcccgacgcagcgctgccactggcatctccatccagcggcagatacatttccaagagggagcgcgctctcctggcctcatcaggggcacatattgaatccggatcatccctgcctctgacgagagtggattttgaatctgcagttggctctatcacctatccaaatctacgagctgacattttgcattctttgcgatgccaaccgaaacctggaccaagcacaagtttccctttgaggctctcagtttgtttgaagggtcacactaaagcaatcaattgtgtagattggtcaccgactcatgggcatcttcttgcttctgctggaatggatcacacggttcatgtatggaatgtatgggacaaagggaataccactgctcgtgttttgaaacatcacactgctgctgtnaaggatgtaaggtggtcacttcataggccctttttactttctggagggcttgattgttccttacagctagttgatgttgttgagggaaagtaatggaagtattcaaggaggatcaagctgtggaagttatcaagtcaatcaagcaacccgatctcttcctatctggtgggtccaagggtcccctaaactccgggatattcgatgtggctgggtacaaaagaattcagagaagcctggaaccatcttgaacttgacctccgtgctgatggaggaaatttatctcctca

SEQ ID NO: 79116 - protein, 189 aa, Zea mays
  misc_feature: Ceres CLONE 1564122
  misc_feature (101)..(140): Pfam Name: WD40 Pfam Description: WD domain, G-beta repeat
  misc_feature (146)..(184): Pfam Name: WD40 Pfam Description: WD domain, G-beta repeat
  misc_feature: SWISSPROT Homolog: EC 2.3.1.48 Histone acetyltransferase
MKPPRWESHPYLPPTHCFPQPPLPDAALPLASPSSGRYISKRERALLASSGAHIESGSSLPLTRVDFESAVGSITYPNLRADILHSLRCQPKPGPSTSFPLRLSVCLKGHTKAINCVDWSPTHGHLLASAGMDHTVHVWNVWDKGNTTARVLKHHTAAVKDVRWSLHRPFLLSGGLDCSLQLVDVVEGK

SEQ ID NO: 79117 - DNA, 787 bp, Zea mays
  misc_feature: Ceres CLONE 1564123
  misc_feature: Encodes the peptide sequence at SEQ ID NO. 79118
ctccccgcggtggcggccgctctagaactagtggatcccccgggctgcaggaattcgtctcacccctagaaaaaatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctccaccggcctcaccacccgccgcttcgtcggccacgagaaggacgtcatctccgtcgccttctccgtcgacaaccgccagatcgtctccgcgtcccgcgacaagaccatcaagctctggaacactctcggcgagtgcaagtacaccatcggcggcgacctcggcggcggcgagggccacaacggggtggggtctcctgccgttaggttctcccccaaacacctttcccagcccacccttggctcttccggatcctggggaaccccacccgttcaggggtttgggaaacttttccaattggaaggttgggcttgacctttggaaagggccccgggggggct

SEQ ID NO: 79118 - protein, 208 aa, Zea mays
  misc_feature: Ceres CLONE 1564123
  misc_feature (107)..(145): Pfam Name: WD40 Pfam Description: WD domain, G-beta repeat
  misc_feature (65)..(103): Pfam Name: WD40 Pfam Description: WD domain, G-beta repeat
  misc_feature (8)..(47): Pfam Name: WD40 Pfam Description: WD domain, G-beta repeat
  misc_feature: SWISSPROT Homolog: EC 2.7.11.7 [Myosin heavy-chain] kinase
MAGAQESLSLVGTMRGHNGEVTAIATPIDNSPFIVSSSRDKSVLVWDLTNPVHSTPESGVTADYGVPFRRLTGHSHFVQDVVLSSDGQFALSGSWDGELRLWDLSTGLTTRRFVGHEKDVISVAFSVDNRQIVSASRDKTIKLWNTLGECKYTIGGDLGGGEGHNGVGSPAVRFSPKHLSQPTLGSSGSWGTPPVQGFGKLFQLEGWA

SEQ ID NO: 79119 - DNA, 925 bp, Zea mays
  misc_feature: Ceres CLONE 1564124
  misc_feature: Encodes the peptide sequence at SEQ ID NO. 79120
  misc_feature (399)..(399): n is a, c, t, g, unknown, or other
tggagctccccgcggtggcggccgctctagaactagtggatcccccgggctgcaggaattcgtctcacccctagaaaaaatcgtctgcaactgcatcgctcgctctctcctttcactgggaacatctatcagctcgcgctcattggccatctttggcttccatggagaggctcattgccggcctacttggcttcctattggttgcatcggtaggaagccatgcagctcgtgctccggatcagtactggaagtctgctcttcccaacactcccatgccgacctccctctcccaactcctcgacgccgctccagccggcggcggcacgaccgtcaacgtcggctggggcggtgttcacgtcgatgctgggcacggtaagcccgggggtacgacggttgacntacgcaagggcggcgtcggcgtcaacgttaaccctggcaggagcggcaagcccggcggcacgacggttggcgtcgggaagggcggagtcggcgttaacgtcaacccgggatacggaaagcccggcggcaccaccgttggcgtcggaaagggtggcgttggcgttaacgtcaaccccggcaagcccggtggcacaacggtcggcgtcggcaagggcggagtgggcgtcaacgtcaatcccggcaaaccggccggtggtgccggtacaaccgttggcgttggcaaaagcggccttgggcgtgggcgtcaattccgggcacggtaagccgggcggcaccccggccggcgtttgcaaaggcggggtttggcgttcacgtgaaacccgggaaagaaaaccgtccacttcaacgtcctccccttttcttctacacttaccccgcggtccgaagacccaagctgcacaaacaaccccaaggtggggctccttctttcaaggagaacggaccttccgggccccggtaaaaagaa

SEQ ID NO: 79120 - protein, 186 aa, Zea mays
  misc_feature: Ceres CLONE 1564124
  misc_feature (80)..(80): Xaa is any aa, unknown, or other
MERLIAGLLGFLLVASVGSHAARAPDQYWKSALPNTPMPTSLSQLLDAAPAGGGTTVNVGWGGVHVDAGHGKPGGTTVDXRKGGVGVNVNPGRSGKPGGTTVGVGKGGVGVNVNPGYGKPGGTTVGVGKGGVGVNVNPGKPGGTTVGVGKGGVGVNVNPGKPAGGAGTTVGVGKSGLGRGRQFRAR

SEQ ID NO: 79121 - DNA, 889 bp, Zea mays
  misc_feature: Ceres CLONE 1564125
  misc_feature: Encodes the peptide sequence at SEQ ID NO. 79122
  misc_feature (400)..(400): n is a, c, t, g, unknown, or other
  misc_feature (671)..(671): n is a, c, t, g, unknown, or other
  misc_feature (712)..(712): n is a, c, t, g, unknown, or other
  misc_feature (720)..(720): n is a, c, t, g, unknown, or other
  misc_feature (722)..(722): n is a, c, t, g, unknown, or other
ccccgcggtggcggccgctctagaactagtggatcccccgggctgcaggaattcgtctcacccctagaaaaaagatccactcgtcacacatccgcgttaccccctctcccttggtttcctctcccaccaccaacccccatcccggttatctccgccgccgcccgctttgggaaggcgcgacgaaggcaggcgagaggctccagccggacgaggaggaaagaggagcagcagggccggaggagagatgttcctgtgggactggttctacggggtgctggcctccctcggcctgtggcagaaggaggcgaagatcctcttcctcggcctcgacaacgccggcaagaccacgctgctccacatgctcaaggacgagcggttggtgcagcaccagccgacccancacccgacgtcggaggagctcagcatcggcaagatcaagttcaaggccttcgacctcggcggccaccagatcgcgcgccgcgtctggaaggattactacgcaaaggttgatgctgtagtatacctggtagatgcgtatgataaggagcgatttgctgaatcaaaaaaggagctggacgctctcctgtcagatgattccttggcaaatgttccatttctcatccttggcaacagattgatatcccgtatgctgcctctgaagaggagctgcngtatcacctaggccttagcaacttcaacaacggggaagggncaggtcancnttggcgactccaatggtcggccacttgaggttttcatgtgcagtgttgttcgcaagaatgggctacgcgatggttttcaagtgggtctcccaaaactccaggtaggccctttgtcggggcgcttgctcagcccagcgatttttttgcctgggtatttgttcctggtg

SEQ ID NO: 79122 - protein, 145 aa, Zea mays
  misc_feature: Ceres CLONE 1564125
  misc_feature (6)..(144): Pfam Name: Arf Pfam Description: ADP-ribosylation factor family
  misc_feature (52)..(52): Xaa is any aa, unknown, or other
  misc_feature (143)..(143): Xaa is any aa, unknown, or other
MFLWDWFYGVLASLGLWQKEAKILFLGLDNAGKTTLLHMLKDERLVQHQPTXHPTSEELSIGKIKFKAFDLGGHQIARRVWKDYYAKVDAVVYLVDAYDKERFAESKKELDALLSDDSLANVPFLILGNRLISRMLPLKRSCXIT

SEQ ID NO: 79123 - DNA, 878 bp, Zea mays
  misc_feature: Ceres CLONE 1564126
  misc_feature: Translation starting site: 164
  misc_feature (529)..(529): n is a, c, t, g, unknown, or other
ctccccgcggtggcggccgctctagaactagtggatcccccgggctgcaggaattcgtctcacccctagaaaaagcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcngtgtcgccgggcggcggcgcgtggctgggcgggcagctgttctcggcccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtcagctgttcaacgccgtggccgtggaagactcatcgtcaggggaggcgcgtcggcggcgtctcacaactgggcgctcgtgtcatgaacacgaccgcagtctgcatgaccccacgtctggaggcaagtcgtgtcagctctgcggcagacggccctcgggcc

SEQ ID NO: 79124 - DNA, 937 bp, Zea mays
  misc_feature: Ceres CLONE 1564128
  misc_feature: Encodes the peptide sequence at SEQ ID NO. 79125
  misc_feature (937)..(937): n is a, c, t, g, unknown, or other
ctccccgcggtggcggccgctctagaactagtggatcccccgggctgcaggaattcgtctcacccctagaaaaactttgttgaggggtgatggcggtttctttcgcaaacctcagctccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcgtcagcagttccttcagccccaactccagatgttgctgaagcacaggccccagttgctgaggaggacgacgacgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagctcgaggaagctgttaggagtgtccagatggaagggttgctctggggcgcatccaagcttgtcccagttggatatggtatcaagaagctgcaaatcatgatgaccatcgtcgacgaccttgtctctgtcgacactctcattgaggactatctgtgcgctgagccagttaacgagtacgtacagagttgcgacatagttgccttcaacagatctaggcgtgactttcgatcagtccttcccctgggtgctgggcaaatggtgggtggctgggcatgcaccagcctatttattcatagctatatgtctgccttggggtggcaagtgaaattgcccggagtatttttggatcctattcgagtccatgttccagtacn

SEQ ID NO: 79125 - protein, 282 aa, Zea mays
  misc_feature: Ceres CLONE 1564128
  misc_feature (140)..(229): Pfam Name: EF1_GNE Pfam Description: EF-1 guanine nucleotide exchange domain
  misc_feature: SWISSPROT Homolog: EC 6.1.1.16 Cysteine--tRNA ligase
MAVSFANLSSEAGLKKLDEYLLTRSYITGYQASKDDLAVYTSFSSAPSSKYINVARWFNHIDALVRLSGITAEGQGVKVESSAVPSAPTPDVAEAQAPVAEEDDDDDVDLFGEETEDEKKAAEERAAAAKASGKKKESGKSSVLLDVKPWDDETDMAKLEEAVRSVQMEGLLWGASKLVPVGYGIKKLQIMMTIVDDLVSVDTLIEDYLCAEPVNEYVQSCDIVAFNRSRRDFRSVLPLGAGQMVGGWACTSLFIHSYMSALGWQVKLPGVFLDPIRVHVPV

SEQ ID NO: 79126 - DNA, 1207 bp, Zea mays
  misc_feature: Ceres CLONE 1564131
  misc_feature: Encodes the peptide sequence at SEQ ID NO. 79127
gatacgtgtttcacgtcctctataaacccagaattctaatatttattcccctctactctgtttttttaccaatagctggagctcaccgcggtggcggccgctctagaactagtggatcccccgggctgctggaattcgtctcacccctagaaaaaacacaacgcagcacccgcactctccaggcgtctgccaatccgaaacgaaacccacccgtaggcaaaccaggactgagattgagcggagagcagcacagtcatggcggggcaggaggtggcgaacaagcgggtggtactgaagcgctacgtgacggggttccccggcgcggacgacatggaggtggtcacaggcaccgcgcgcgtggccgtgccgccggggtcgacggccatggtgctcaagaacctctacgtgtcgtgcgacccttacatgcgcggccgtttgaccaagcacgagaggcccagctacgtcccggacttcccccccggggaggctttggaaaactttggcgtctgcaaggtgatagcatctgggcaccaggatttcaaggttggggatcttgtgcgggggatgaccggatgggaggagtacactctcatccctaacccggagtcattttttcaagaccaatcatcctggaattgcctctgtcctactaacaatagggttccggagtattgccgggcctttaccgcaaggggttgggatttatccacagtgtaggcatggctacgaacaaaaggcgaattaatgttctttcctcctcctccctgccatccacggataaccctcttgagctccagccctcgttttgcggcataagtttcggcctacaggcttgtaatgtagaacgttctatttgtcgaccccgagctcatacgtcctgctgtttccacgaacctccaaaatgggtatcaatttccttccggcataacaccaatagtttgcggccgcttgcgaatacaatgtccatcgtgtaccttcgatgacacaaaaatacacggtggacatctcacgattgcgccggcctcatgtgcggacaggtgactcttccccaggtgaggcggaatgtcatcttcctcgacctcttagagatattggggcgggtgggcaatatctcattgggaatacctgagctactcccccatccgggttgcgttcgacgcgcgatcggaattcccctacttcttacagaaatagatcctcacaccca

SEQ ID NO: 79127 - protein, 153 aa, Zea mays
  misc_feature: Ceres CLONE 1564131
MAGQEVANKRVVLKRYVTGFPGADDMEVVTGTARVAVPPGSTAMVLKNLYVSCDPYMRGRLTKHERPSYVPDFPPGEALENFGVCKVIASGHQDFKVGDLVRGMTGWEEYTLIPNPESFFQDQSSWNCLCPTNNRVPEYCRAFTARGWDLSTV

SEQ ID NO: 79128 - DNA, 865 bp, Zea mays
  misc_feature: Ceres CLONE 1564132
  misc_feature: Encodes the peptide sequence at SEQ ID NO. 79129
  misc_feature (538)..(538): n is a, c, t, g, unknown, or other
  misc_feature (758)..(758): n is a, c, t, g, unknown, or other
  misc_feature (796)..(796): n is a, c, t, g, unknown, or other
  misc_feature (803)..(803): n is a, c, t, g, unknown, or other
ctggagctccccgcggtggcggccgctctagaactagtggatcccccgggctgcaggaattcgtctcacccctagaaaaagcgctagcgcgagtggtggcacccacgcacactcttctccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggacgccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccnacagcaacgtgtccgtcatcatccagcccacgtccaagaagaccatcgccgactacggctctcccgaggagttcctctcccaggtcgactacctgctcggcaggcaggcctacggcggcaagactgactcccgagggcgggtttcgagaccggcgcccgtggcacccgccaacgtcctggagagctcccacccccgtgatcgacgggcagcagtactacngccgtgtccgtgctcaccaggaacggcgaacggcgacnaagggcngcaagcaccagttcatcgcgggctaccgttctcgaacgggaagctctacatctgcaaagccg

SEQ ID NO: 79129 - protein, 238 aa, Zea mays
  misc_feature: Ceres CLONE 1564132
  misc_feature (57)..(238): Pfam Name: PsbP Pfam Description: PsbP
  misc_feature (130)..(130): Xaa is any aa, unknown, or other
  misc_feature (203)..(203): Xaa is any aa, unknown, or other
  misc_feature (216)..(216): Xaa is any aa, unknown, or other
  misc_feature (218)..(218): Xaa is any aa, unknown, or other
MASTSCCLLHQSTARLGASPRLAAAPPRSAQLLVCKARKQDAAADQSDVSRRAALALLAGVTAAAGAKVGPAAAAYGEAANVFGKPKASTEYIAYSGDGFKLLIPSKWNPSKEREFPGQVLRYEDNFDAXSNVSVIIQPTSKKTIADYGSPEEFLSQVDYLLGRQAYGGKTDSRGRVSRPAPVAPANVLESSHPRDRRAAVLXPCPCSPGTANGDXGXQAPVHRGLPFSNGKLYICKA

SEQ ID NO: 79130 - DNA, 874 bp, Zea mays
  misc_feature: Ceres CLONE 1564133
  misc_feature: Translation starting site: 313
  misc_feature (430)..(430): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (444)..(444): n is a, c, t, g, unknown, or other
  misc_feature (449)..(449): n is a, c, t, g, unknown, or other
  misc_feature (450)..(450): n is a, c, t, g, unknown, or other
  misc_feature (460)..(460): n is a, c, t, g, unknown, or other
  misc_feature (464)..(464): n is a, c, t, g, unknown, or other
  misc_feature (475)..(475): n is a, c, t, g, unknown, or other
  misc_feature (478)..(478): n is a, c, t, g, unknown, or other
  misc_feature (481)..(481): n is a, c, t, g, unknown, or other
ctccccgcggtggcggccgctctagaactagtggatcccccgggctgcaggaattcgtctcacccctagaaaaaaattccacccctcgccgccatctccgtctctctctctctcccgcaaccaagcagttcaactcacacccgaagcggcgccgctagggtttgctccgacagccgcgaaacctagtccttactgcgccctcccacagaggccgtcattcactaatctagctgctacgcttcgcttcccgctccgattgggagctagggtttagcttatctccgagctcagcttcgggtcgcggcacgcggcatggcggggtacggggaagagaaccagaacgccatgaacgggtacgaggaggaagaggaggaagaagaggttgaagaagtcgaggaggtgtacgaagaggaggaggaaggggacgggnannnaaggaagganacccnnaggggggcancccncccaagggcancanccnatgggcgggccgagaccagaggtgtccaattggagggcgggggcctaacgggaagccggttgggaaatgttgaatgccggaaggcaaggatttaaaagggaatccaaaattctagcgggggggaaccctttcgggggagggtttttcctaggggggggttacccctggggaaaacctctgaaaaaaaatttccccaaagacttttttcagaaaatttgggggggataaaaccggagattctcgggaaacccgaaaggggacaaaccctttcttgggggtgcctgccccgggggattttgggggaattttttaaaaaattttttcccaaaaaccccccctttgggttctttttaaaagggggtttcttaaaagggaaaaaaaaaaaccttttca

SEQ ID NO: 79131 - DNA, 712 bp, Zea mays
  misc_feature: Ceres CLONE 1564135
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (672)..(672): n is a, c, t, g, unknown, or other
nnnnnnnnnnnnnnnnnnnnnnnnnnnnnnnnnnnnnnnnnnnnnnnnnnnnnnnnnnnnnnnnnnnnaaaaactggagctcccgcggtggcggccgctctagaactagtggatcccccgggctgcaggaattcgtctcacccctagaaaaaacaccactgatcaagcaataggacgatcgagcaagaagcaagcagcagtaacaagaaaccatcatcgatccatgtatccaccaatggcggcgctcggaggacggcggaaggaggggcnnntcgtcagcggcccctcccagctagcccttgttttgcgggtggcccctgggtctcccctggccggggcccagccccaccggcccgcgggggaaaacaagaacccgggggcagggtggaacccctggttttcctggggggggcccgggaaaacaaaaggggccccaaaaaggggcaaccccccttttcccccccaaagggggccccctgggggaaaaaatttccgggggggggcccccttttcttttaaaaaaccccccccaggggggggggggggggaaaaaaaacacaggggggggccccccctttttttccccccccccgcgggaaaaaggggtttttttaaaaaaggggggggcccccccccccccaaaaaaaaaacccccccccggggggccggggnttttgtttaatttccccccccggggtttttctcccccccc

SEQ ID NO: 79132 - DNA, 901 bp, Zea mays
  misc_feature: Ceres CLONE 1564136
  misc_feature: Translation starting site: 170
  misc_feature: Pfam Name: Vps26 Pfam Description: Vacuolar protein sorting-associated protein 26
  misc_feature (743)..(743): n is a, c, t, g, unknown, or other
  misc_feature (795)..(795): n is a, c, t, g, unknown, or other
  misc_feature (796)..(796): n is a, c, t, g, unknown, or other
  misc_feature (802)..(802): n is a, c, t, g, unknown, or other
  misc_feature (807)..(807): n is a, c, t, g, unknown, or other
  misc_feature (887)..(887): n is a, c, t, g, unknown, or other
ctccccgcggtggcggccgctctagaactagtggatcccccgggctgcaggaattcgtctcacccctagaaaaaatccgatattccgatctcgatcccgcgacgcggtgtctccggtcagcgccgccgccttctccctcgccggccgccactgcatcgccgcagtcgccatgaattatatcattggagcattcaagccaccttgtgacatctcgatcacattctctgatgcgaggactaggaagcaggtttcggttaagaaggacaatgggaagacaacgatggtccctgttttccagagcctcgaaactatatctggagaagtatcaatagcaccagttccaggtaaaaggattgaacacacgggtgtcaaaattgagttgctaggccaaatagagctctattttgaccgagggaacttctatgacttcacttcgttagtacgtgagttagatattcctggtgaaatctatgaaaggaagacgtttccatttgaattttcaactgttgaaatgccatatgagtcttacaatgggacgaatgtcagactcaggtacattttgaaggtgacaattggcagaaactatgttgggaatattgtggaatatcgggatttctgtgtgagaaactactcacctgtccctacaatcaataacagcattaagatggaagtaggaattgaggattgcttacatattgagtttgaatacagcaaaagcaagtaccatctcaatgatgtgattnatgggaagatatatttcccttctgtcagaataaggtaaaaaatatggactgnngaatangcgtnaggaaatcacaggatcagggctctacacatatgttgaaactgagactcttgcaaagttgaaagtgatggatggtgctccntgtgagaggtgatc

SEQ ID NO: 79133 - DNA, 915 bp, Zea mays
  misc_feature: Ceres CLONE 1564143
  misc_feature: Encodes the peptide sequence at SEQ ID NO. 79134
  misc_feature (563)..(563): n is a, c, t, g, unknown, or other
ccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacagcggtggcggcggcggctactgtggcggcggcggctacngtggtggtggcggcggctacagcggtggcaaccgtggcggcggctacggcaactccgacgggaactggaggaactgagcggtggggcccgcgcggcctagttatcctgttcgctaccgtgttgtttacccctagtccagaggggttatcttcgtcgtctcatgtttgttgttgcccatctgtgtttttgattgcaagtcgctttgtgtcagttgttagtgctgtgttcatcctcggctccagcagaccatgcatcaacagcatggactgcggatccatggatgctgttacccccgtcagccttttcccttagtatcttcaagaaaaaatggtgcttcttggggcaaaaaaaa

SEQ ID NO: 79134 - protein, 156 aa, Zea mays
  misc_feature: Ceres CLONE 1564143
  misc_feature (10)..(81): Pfam Name: RRM_1 Pfam Description: RNA recognition motif. (a.k.a. RRM, RBD, or RNP domain)
  misc_feature (48)..(151): Pfam Name: GRP Pfam Description: Glycine rich protein family
  misc_feature: SWISSPROT Homolog: EC 5.2.1.8 Peptidylprolyl isomerase
  misc_feature (132)..(132): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYSGGGGGYCGGGGYXGGGGGYSGGNRGGGYGNSDGNWRN

SEQ ID NO: 79135 - DNA, 961 bp, Zea mays
  misc_feature: Ceres CLONE 1564144
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (369)..(369): n is a, c, t, g, unknown, or other
  misc_feature (370)..(370): n is a, c, t, g, unknown, or other
  misc_feature (426)..(426): n is a, c, t, g, unknown, or other
  misc_feature (427)..(427): n is a, c, t, g, unknown, or other
  misc_feature (668)..(668): n is a, c, t, g, unknown, or other
  misc_feature (707)..(707): n is a, c, t, g, unknown, or other
  misc_feature (708)..(708): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (905)..(905): n is a, c, t, g, unknown, or other
  misc_feature (907)..(907): n is a, c, t, g, unknown, or other
  misc_feature (908)..(908): n is a, c, t, g, unknown, or other
nnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctggggctccccccgggtggcggccgctctagaactagtggacccccgggctgcaggattcgtctcacccctagaaaaattgtggctcctcacttccgcgccgccacccccttcaggggtaaggaagaaggaggagggcaggatgtcgcaccgtaagttcgagcacccgaggcacggctccctcggcttccttcccaggaagcgctccctccgccaccnngcggcagggtgaaggtcaattcccccaggggatgaaccccaagaaagcctttgccnnatccttacaattggccttttccttggggtaaccaaaggttggggcattaaactccacaaaattttgccccccgtggaaaggggttttttaaaaaaaaaaacccccccggggggtatttccaaaaaaaatttccccctttttttttgaaaggggggaaaaacaatttttgggggaggggggtgtttttcccccccctcctttttaaaaaaacccccccccccccccccccccttttttgtgnaaaaaaattttgtggggggggggggcgccctcccccggnnggnnnnnccccccttttttttttgtgtgggaaaaaaaaaaaacccccccccccccgtgggggggggggcgccccccccccacaaaaaaaaaaaaaaaaaaaaaaaaatatttttttttttttgtggtgttggggcgccccccccccacaccaccacccacattnnnnnnnttttttttttttctttttttttttttntnnaaaaaaaaaaaaaataataatttttttgtaaagagaaagaaaagaaatttttt

SEQ ID NO: 79136 - DNA, 942 bp, Zea mays
  misc_feature: Ceres CLONE 1564145
  misc_feature: Encodes the peptide sequence at SEQ ID NO. 79137
  misc_feature (777)..(777): n is a, c, t, g, unknown, or other
tggagctccccgcggtggcggccgctctagaactagtggatcccccgggctgcaggaattcgtctcacccctagaaaaacttttgcagatatggagcagaagggcgccggtccgggagcacggagctcccacgccatcacgctgctcgggggcacggcctactcgttcggcggcgagctcaccccgcgcgtcccggtggacagcaccatgtacgccttcgacctcaacacccagacgtggtcggcgctggacgcgacgggcgacgtgccgccgccgcgcgtgggcgtgaccatggcggccgcaggcggcacggtgttcacgttcggcgggcgcgacctggagcacaaggagctgaacgagctctacgctttcgacgcggcggcgcgggcgtggacgctgctgtcgtccggcgccgacggcccgccgcaccgcagctaccactccatgacggcggacgcgggcgcggggcgggtgtacgtgttcggcgggtgcggcgacgccggccgcctcaacgacctgtgggcgtacgacgtggcggtggggcaatgggagcagctgccgccgccgggggaggcgtgccagccgcgcggcgggccccggctggtcgtcgccggcgggaaggtgtgggtggtgtacgggttctcgggcgaggagctggacaacgtgcactgctacgacccggccacccgggagttggcccgcggtccaaaccacgggcgacagggcccagccccccgaagcgtgttctgccccgccggggttcgggaagcactggtngcctggtccgcgggcgaagtgggaccccagtggacctcgggccaccttcgtggcccggacaaattctccggcccaaaggcgttcccccctgggaaaccgtgaaaaccggggcccgtgggacaaccagcttgggcacttctagggccgggagaggccgagaccacc

SEQ ID NO: 79137 - protein, 262 aa, Zea mays
  misc_feature: Ceres CLONE 1564145
  misc_feature (62)..(108): Pfam Name: Kelch_1 Pfam Description: Kelch motif
  misc_feature (115)..(160): Pfam Name: Kelch_1 Pfam Description: Kelch motif
  misc_feature (165)..(209): Pfam Name: Kelch_1 Pfam Description: Kelch motif
  misc_feature: SWISSPROT Homolog: EC 3.1.3.16 Phosphoprotein phosphatase
MEQKGAGPGARSSHAITLLGGTAYSFGGELTPRVPVDSTMYAFDLNTQTWSALDATGDVPPPRVGVTMAAAGGTVFTFGGRDLEHKELNELYAFDAAARAWTLLSSGADGPPHRSYHSMTADAGAGRVYVFGGCGDAGRLNDLWAYDVAVGQWEQLPPPGEACQPRGGPRLVVAGGKVWVVYGFSGEELDNVHCYDPATRELARGPNHGRQGPAPRSVFCPAGVREALVAWSAGEVGPQWTSGHLRGPDKFSGPKAFPPGKP

SEQ ID NO: 79138 - DNA, 692 bp, Zea mays
  misc_feature: Ceres CLONE 1564146
  misc_feature: Encodes the peptide sequence at SEQ ID NO. 79139
  misc_feature (418)..(418): n is a, c, t, g, unknown, or other
agctccccgcggtggcggccgctctagaactagtggatcccccgggctgcaggaattcgtctcacccctagaaaaaaaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccgggctcacccagcgtcttcgggtggcgcccgcggaagccgccccaagggcgggaanctcgggactccaaacacgccttcattcattggacacccacgacagtgatatggcctccgacgactaccatttccttgaaacggaaccgggccggagggaaaaaaggggtgaacccccccttcaacccctagggcccaacaactttggatttccctgtttgacccggggaaaagccaattcaaggaagggcccgggcttttcaaaaaaccccttttttaaacccttttgccccgggggcttcctttagaccccttcggggagattttttcgccgc

SEQ ID NO: 79139 - protein, 111 aa, Zea mays
  misc_feature: Ceres CLONE 1564146
  misc_feature: SWISSPROT Homolog: EC 2.7.1.19 Phosphoribulokinase
  misc_feature (96)..(96): Xaa is any aa, unknown, or other
MAICSAHTTTSLRSPCTTVSNAGLRQKQVIFVTSNRRSGGGRRHGGARSFQVSCSVDKPVVIGLAADSGCGKSTFMRRAHPASSGGARGSRPKGGXLGTPNTPSFIGHPRQ

SEQ ID NO: 79140 - DNA, 937 bp, Zea mays
  misc_feature: Ceres CLONE 1564149
  misc_feature: Translation starting site: 352
  misc_feature (721)..(721): n is a, c, t, g, unknown, or other
  misc_feature (722)..(722): n is a, c, t, g, unknown, or other
  misc_feature (919)..(919): n is a, c, t, g, unknown, or other
ctccccgcggtggcggccgctctagaactagtggatcccccgggctgcaggaattcgtctcacccctagaaaaaagagtcccagctccctcactctactctggacgcgactcgaacttaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggatgtttggggttctgaggagtgtatgggttgctaggaaaccaccagggtttgccttcattgactttgatgaccgcagggatgcacaagatgccattcgtgaattggatggtaagaatgggttggagggttgagctgtcaactaaagttggtggtggccgtggccgagaccgtaacggttctgatatgaagtgctatgagtgtggtgaagctggccactttgcacgtgaatgccgcttacggattggttcaggaggcttgggtagtggaaggcgtcgcagccgaagtcctagatatcgcagccgcagccgcagccgcagccgcagcccaagatatcgaatgagcccaagctatagcagaagcccgcgagatcgttctcctaggaagcgaaagtacagcatggtcgcactgggatctcctgcacggagtctcagcatgtcacccgcgctgnncgcgcctcctccagaaatacagcaggtcaccacctgtagcctgatagtgagcatgtcgccgcccgcacctcctcccagaataacagcaggtcacaccggcagcccgagacgtgagcaggtcaccacggtcagcccgtagagtgagcaggtcgccaccaccacctcctgatgccagatgaagcttagtggatccccangacagcagccacacgcga

SEQ ID NO: 79141 - DNA, 775 bp, Zea mays
  misc_feature: Ceres CLONE 1564150
  misc_feature: Encodes the peptide sequence at SEQ ID NO. 79142
  misc_feature (464)..(464): n is a, c, t, g, unknown, or other
tggagctccccgcggtggcggccgctctagaatagtggatcccccgggctgcaggaattcgtctcacccctagaaaaattcaggctccggagtccggacggagtcgcgggccgtggccctgcctcagtatttcctcttccccgcgataggcaacagaaaccgcagcataacaaggaaagcgaagcgaaccctcgccgcgcgagttagcgatggccggagaggacgccgccgccgcgaggaggcccccgaaggaggaggaggaggaggaagatgacgacgatttggacaacgttccgctggcactttccagggccaagaaaccgggtaatgcgagcgcctccaaggtcaagaaggaggaggaggacgatgacgacgacttggacaacgttccgctcgcactttccagggctaagaagggaaacgagaagcagaaaggggcacaatagcatatgaaggcttcttcngaagtcaagaaagaagtcagttctgatgatgattttgtcatgccaacggcgcaaaagaaaagtgcaggtgctgctgggaagtatgccaggacatcccaggttaaaaaattaaagatgagatttgggagatctcagggagacagaaaaaggaaaaaccagtgggtgtcaaaaaaaagcaagtttggctttggccttgtaagggggaaaaaaggttaaaaaaaaaggaaaatgtttgggttgcccgggcaaaaacataatcctccttaaaaaaggggctcctttggggaaattttatgaatccccccttgggg

SEQ ID NO: 79142 - protein, 78 aa, Zea mays
  misc_feature: Ceres CLONE 1564150
MAGEDAAAARRPPKEEEEEEDDDDLDNVPLALSRAKKPGNASASKVKKEEEDDDDDLDNVPLALSRAKKGNEKQKGAQ

SEQ ID NO: 79143 - DNA, 840 bp, Zea mays
  misc_feature: Ceres CLONE 1564153
  misc_feature: Encodes the peptide sequence at SEQ ID NO. 79144
  misc_feature (595)..(595): n is a, c, t, g, unknown, or other
ggagctccccgcggtggcggccgctctagaactagtggatcccccgggctgcaggaattcgtctcacccctagaaaaactctccgctcgccagcctccccctcctgctgctgcctcctcgcttcaagcaacacccgaagcggcaacaaccaccaccaccaccaccaccaccggacctgcctgagcgaccccttggcttcccactccactgaagcagggcgagagagagtaaggaggaggaggagaagccatggcgagcgacggcgacggtaagggccgcgtcgctacggcgccgggggcagggtacgggtacgcggcgtacggcggctaccagggggcggaggagcggaagtggtggccgtggctcgtgcccaccgtcatcgtcgcctgcatcgccgtgttcgtcgtcgagatgtacgagaacaactgccccaagcacgggagccagctcggcgactgcgtcgccggcttcctccgccgcttctccttccagccgctccgcgagaacccgctgctcggcccgtcctcctccactttggaagaaatgggagctcttgactggaataaaatgtccatcaaaaccaaggggtgcgccntattagctgcatctgggctcatgctgggcctaatccattttggttgtgaaacatgctaaagttttgctgttttaatgggaaatccgccctgaagcaagcaattttggattttgttccccaatgggggccaaaaaacccaaccggtcctgggtttttgggggggaaccccgtgtttcctttgcactcctttcctaagggaaaagggtaaacaattctcccccttggggggcttcctggggaacccc

SEQ ID NO: 79144 - protein, 134 aa, Zea mays
  misc_feature: Ceres CLONE 1564153
  misc_feature (116)..(116): Xaa is any aa, unknown, or other
MASDGDGKGRVATAPGAGYGYAAYGGYQGAEERKWWPWLVPTVIVACIAVFVVEMYENNCPKHGSQLGDCVAGFLRRFSFQPLRENPLLGPSSSTLEEMGALDWNKMSIKTKGCAXLAASGLMLGLIHFGCETC

SEQ ID NO: 79145 - DNA, 834 bp, Zea mays
  misc_feature: Ceres CLONE 1564155
  misc_feature: Encodes the peptide sequence at SEQ ID NO. 79146
  misc_feature (512)..(512): n is a, c, t, g, unknown, or other
  misc_feature (731)..(731): n is a, c, t, g, unknown, or other
  misc_feature (803)..(803): n is a, c, t, g, unknown, or other
  misc_feature (808)..(808): n is a, c, t, g, unknown, or other
tggagctccccgcggtggcggccgctctagaatagtggatcccccgggctgcaggaattcgtctcacccctagaaaacaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcggncaggccacgtacctgggcgccccgggtgccgtggggcacgctgccgaccatcctgggtgatcgagttcgtggccatcgccttcgccgagcaccagcgcaccatgggagaaagaccccgagaagagaagtaccccgggcgcgccttcgacccgctcggcttctccaaagacccgccaagttcgaggaagtacagctcaagagatcaagacggccgcctcncatgctggccttcgtcggcttctgcgtccaacagtcggcgtaccccggcaccggcccgctggagacctcgcntcccnacttgccgaccgtggaaaaacacatc

SEQ ID NO: 79146 - protein, 144 aa, Zea mays
  misc_feature: Ceres CLONE 1564155
  misc_feature (54)..(140): Pfam Name: Chloroa_b-bind Pfam Description: Chlorophyll A-B binding protein
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGNWVKAQEWAAVPGGQATYLGAPGAVGHAADHPG

SEQ ID NO: 79147 - DNA, 889 bp, Zea mays
  misc_feature: Ceres CLONE 1564156
  misc_feature: Pfam Name: HD-ZIP_N Pfam Description: HD-ZIP protein N terminus
  misc_feature (733)..(733): n is a, c, t, g, unknown, or other
  misc_feature (769)..(769): n is a, c, t, g, unknown, or other
  misc_feature (810)..(810): n is a, c, t, g, unknown, or other
  misc_feature (874)..(874): n is a, c, t, g, unknown, or other
ctccccgcggtggcggccgctctagaactagtggatcccccgggctgcaggaattcgtctcacccctagaaaaagcacaccacatcgacagctccatcgattcatccaccgctatctctctctctttcaactgcgagggaaaccgagctcaaagtggcaaccatcaatggatattatcggcgcttaatgcgagagacaaggagcagtacgggaacaaccatctcgggctcgggctgagcctcaacctcagcctcggcgacgccaccgcggctccggtcgaggtcaagcccccgccaccgccgcggcagcagcagcagcgagctatcagcgtcgcgcccatcacctccctccccgcgccgcattggtggaagtggaacatccctggtctcttcttcgggacgactatggatccatctctggagaggaaccagcatcagcagcagccggcggtcgcgcgccacggccacgagatgccgttcctgcggggggtggacgtgaaccgggcccctgcctgggagaccaggaggggtagctgcagcgaggaccaccaggagcctggcggcgcgtcttcctcgccaaacagcacgctctccagcagcctcagcgggaagctcgcacctccagagatgagcagctgataggtggccaaccacaccccgagagccggatgcggcagccacgacgaggactcccagcggtgggtcgcgcacgaagctccgcatgtacaagaacnaggtcgtcgtcctgcgagagagcgtcatggagcatnacacagtcaaccccgatcattaagctgcgctcgcgaacgtncttacctgaagccggtaccgggtgggagtgtggttcctgaatcgtctatcttgtagaacttaantccaccgaggtggat

SEQ ID NO: 79148 - DNA, 1011 bp, Zea mays
  misc_feature: Ceres CLONE 1564157
  misc_feature: Encodes the peptide sequence at SEQ ID NO. 79149
ggcggccgctctagaactagtggatcccccgggctgcaggaattcgtctcacccctagaaaaagtcccgtcctcggtcctccatcagtagtaaccactcctcgtcgtctctctcgcggtctcgcctcctgcagctagctctcgccagaaagggaaaccgcatctgcttcagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcggccgacagcccgggcgctgccgccgccgcgggcgcggaggcgccgcgccccaacctctactagtctcaaaaacccccggactgggacacgttcggggcataacctgggcaacacccggccgcccctgggtgctgggggcggtgcatactgcgccccccgtgctcgaagttcctggggcttccttggaccagtttttggctagacccaaagggccccccctctcgggggggtgccgctctccttgtggctatcgcgtttgcccgccctacgacacggtggctcgttgcccccctcggccgtcttggcccctggggggcgttacccttagatttaccgctctatttggtcccggccttgggtcaagatcctcctttcttatagttacctctgggtagtgcccgttcccccagacattaacaccttatttgaaggggccctttggcgccgctattcccttctctcctctggtggagggcgcccgccttctattgtcgctcctcagggccccccgtatttttcctctcgcctttaatcattactccgcgtaatgctttcttctcctttctttattttgcgcgccacttttcgccgctttctaacccgccgctagcccgcgctcccgctttcttttcttatccgttatccccccccgttgtctgcattacattgtccgattttggttcaaccccccactttctt

SEQ ID NO: 79149 - protein, 29 aa, Zea mays
  misc_feature: Ceres CLONE 1564157
MQMQVGGGAADSPGAAAAAGAEAPRPNLY

SEQ ID NO: 79150 - DNA, 920 bp, Zea mays
  misc_feature: Ceres CLONE 1564159
  misc_feature: Encodes the peptide sequence at SEQ ID NO. 79151
  misc_feature (920)..(920): n is a, c, t, g, unknown, or other
ctccccgcggtggcggccgctctagaactagtggatcccccgggctgcaggaattcgtctcaccccctagaaaaaattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggcgcacgtgctcaacgagacgtggagcaagggcaagcgcgactacttcgagggcacggcctacaagggcgaccccggcagcgacgaggccaagctcaaggtcaagttctacctcccgcccttcctccccatcgtccccgtcgtcggcgactactgggggctctacgtccacgatgactaccagtacgccctcctcggcgagccccgccgcaagaacctctggatcctgtgcaggaagacaagcatcgacgaggacgtgttccaccacctgggggagcgggccaagaaggaaggccaccacgcggggcaagctccccaggacgcccccggacgaacccccccccggaaaaggaagctccgcccccccaaaacacaggggtggggggggggtcaaagccgctctctcggaaaatgacggagccctaccgccccggcctccggggctccgggaagggggcctgtaaattcaaacaaaaaaaccaccccccgataggagaaaggtaagggatctcttaggcccccccaattggccccctctctctatgcgagtgggagcaatccgcctggcgtgttccn

SEQ ID NO: 79151 - protein, 200 aa, Zea mays
  misc_feature: Ceres CLONE 1564159
  misc_feature (24)..(169): Pfam Name: Lipocalin_2 Pfam Description: Lipocalin-like domain
MAAEEGEKAKSGGGGQQMTVVRGLDVARYMGRWYEIASFPSFFQPRDGRDTRATYRLLEDGATAHVLNETWSKGKRDYFEGTAYKGDPGSDEAKLKVKFYLPPFLPIVPVVGDYWGLYVHDDYQYALLGEPRRKNLWILCRKTSIDEDVFHHLGERAKKEGHHAGQAPQDAPGRTPPRKRKLRPPKTQGWGGGQSRSLGK

SEQ ID NO: 79152 - DNA, 820 bp, Zea mays
  misc_feature: Ceres CLONE 1564163
  misc_feature: Encodes the peptide sequence at SEQ ID NO. 79153
  misc_feature (475)..(475): n is a, c, t, g, unknown, or other
  misc_feature (538)..(538): n is a, c, t, g, unknown, or other
ggagctccccgcggtggcggccgctctagaactagtggatcccccgggctgcaggaattcgtctcacccctagaaaaagagggatacatcatcagtacatggcccggcccggcccagagaggagcgcgcccatatcgcttccctgaggccgagagcgaagcggagcgagcaccggacgagaggcatggccatggcgcgggcggagctccgcaccgtgaccgtgcgctcttccccgcttccgcgctgcgtcctctcccggctgctgccgttgctcctctcagtctcagccatcggcgctgcgtctgcggcgccactaaagttcgggatcaactacgggcagattgcgaacaacctcccgcagccgacgcaggtgtcgggcctcctgcagtcgctgaacgtgaaccgcgtgaagctctacgacgccgaccccatcgtgctgacggccttcgccgggcacgggcgtcgagttcatcantcggcaacgatgacctctacaacctgaccgacgcacgcaagggccggggcctgggtggcgcangcacgtccagccgttcctccccagcacgcgcatcaccctgcatcaccgtgggcaacgaggtgctctccggcaaggacacgaccgccatgcagagccttcctccccgccatggcagaccgtgtacccaagcccgtggtcggccctggggcctcggcgggccaggtgaaacgttttcgacggggccaattcgggtccaaaatccctggccaagaaggctacccccgcccgttcgttgggggggcccttttccgggaagggaacttcgggggcagaaaaaattcc

SEQ ID NO: 79153 - protein, 105 aa, Zea mays
  misc_feature: Ceres CLONE 1564163
  misc_feature: SWISSPROT Homolog: EC 3.2.1.39 Glucan endo-1,3-beta-D-glucosidase
  misc_feature (97)..(97): Xaa is any aa, unknown, or other
MAMARAELRTVTVRSSPLPRCVLSRLLPLLLSVSAIGAASAAPLKFGINYGQIANNLPQPTQVSGLLQSLNVNRVKLYDADPIVLTAFAGHGRRVHXSATMTSTT

SEQ ID NO: 79154 - DNA, 803 bp, Zea mays
  misc_feature: Ceres CLONE 1564165
  misc_feature: Translation starting site: 159
  misc_feature (404)..(404): n is a, c, t, g, unknown, or other
  misc_feature (427)..(427): n is a, c, t, g, unknown, or other
  misc_feature (439)..(439): n is a, c, t, g, unknown, or other
  misc_feature (549)..(549): n is a, c, t, g, unknown, or other
  misc_feature (601)..(601): n is a, c, t, g, unknown, or other
  misc_feature (636)..(636): n is a, c, t, g, unknown, or other
ggagctccccgcggtggcggccgctctagaactagtggatcccccgggctgcaggaattcgtctcacccctagaaaaaatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcangtgaagactgcgccacggacggntacgacgccgtnccagtcgggtaccacggcgtgcgcgaggacaagctcacccgcccggagctgggcccactgggcaaggcggcgccccgccgctgcgccactgcaggagttcgggctcacgncgtcgacgccttcgaagcccggcagcccctcgacttcgcgacctcttcaggnagggcgacctcatcgacgtctccgggaattcattnggaagggggttcaaagtgggcattcagaggcacaacttcaagcccgggctgaatcacccacggttccaaaagccaccgggcaacttggtttccattggaacccgggaccaaccccggggcccccttgttcaaaggggaaaaaaaaacccccgggaaggaaaggaaaa

SEQ ID NO: 79155 - DNA, 792 bp, Zea mays
  misc_feature: Ceres CLONE 1564166
  misc_feature (759)..(759): n is a, c, t, g, unknown, or other
ctccccgcggtggcggccgctctagaactagtggatcccccgggctgcaggaattcgtctcacccctagaaaaagcggctcgtgaacacctcatctttttagccacttttgccaccaccgacgacgaccgatcgatcagctagcagctaggccatcccgcgcgcgtcacgaggaacccacggccggcgtcgccattgttgtcgctgtaacttgcaagctttccctagcatcggcccttttccccttccttttccctcgctcgtcctcgtgctagctgtgtataaaagcgcgtcgctagcgcgctcatggagcagcagcagcatcaggaggtgaggaggaacaggaaaggcgtgctgcaggtgcaggacggctctgagatccgggctctcgtggagaacaggcggagttcgctaggttcgtcgacgacaggttccggaagctcgacgcccattggcaacggaaagctgtcggggaaagagctcccaccccggccgtcccttgaaaattggggccccccctcggggttgcccgggccaaaaagggggtttttccccccccggggggggggacccccccttccccggggggggggccaaaaaagatttccccccccgggaaaaaaaaaaaaatggggggggaaaaggccaaaatttcccggggggggggggggtcgaagaaaacccccccgcccccaaaaaaaagcgccccccccccttttttaaaaaaagagcccccccccctcttttccccccccccctntgtaaaataaaacgggggggggggagacccccc

SEQ ID NO: 79156 - DNA, 922 bp, Zea mays
  misc_feature: Ceres CLONE 1564168
  misc_feature: Encodes the peptide sequence at SEQ ID NO. 79157
ctccccgcggtggcggccgctctagaactagtggatcccccgggctgcaggaattcgtctcacccctagaaaaaatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccggcccgctccgccccggggtcgatcaggtcgagggcaccgtgaaggccgtcgtcggccccgtctacgaccgtttccacgccgtcccgctcgacctcctcaagttcatcgaccgcaaggttggtgagtccgttgaggagatagaccgccgcgtccctccagtggtgaaggaagccccaaccttggcccgctcggctgcgaaggaggttcgccaggccggcctggtgggcacggccactggccttgccaagtcagccatcgcccgcgccgagccaaaggcccgggagctctacacccgctacgagcctgtggcagagcggcgtgccgccgaggcctgtgtggccctgaaccgtctccctctggtgccctcggtcaccagggtcgtcctccccactgccgcacagctctctgccaggtacatttcggcggtgcgtgatggtgcctagcgcgggaaacgcgttgtccacctatctcccgcttgttgccactgagcggctcgcccggctggttcaggtacccccgtggctgaagttgctgcaaca

SEQ ID NO: 79157 - protein, 213 aa, Zea mays
  misc_feature: Ceres CLONE 1564168
  misc_feature (29)..(214): Pfam Name: REF Pfam Description: Rubber elongation factor protein (REF)
MADSATNDAPLVASNQPTEEEVTVERAAATEEQEEERLRYLEFVQQAAAQALVLAAAAYAYAKQGAGPLRPGVDQVEGTVKAVVGPVYDRFHAVPLDLLKFIDRKVGESVEEIDRRVPPVVKEAPTLARSAAKEVRQAGLVGTATGLAKSAIARAEPKARELYTRYEPVAERRAAEACVALNRLPLVPSVTRVVLPTAAQLSARYISAVRDGA

SEQ ID NO: 79158 - DNA, 917 bp, Zea mays
  misc_feature: Ceres CLONE 1564172
  misc_feature: Encodes the peptide sequence at SEQ ID NO. 79159
ctggagctccccgcggtggcggccgctctagaactagtggatcccccgggctgcaggaattcgtctcacccctagaaaaactctctctgaccttatccccttgcggcaaaaccttgcgcgcaacaatggccgcctccctcccgaccaccgccgcgcgcctcgcggccccggccttcgcctaccggtcgcccaaggctccctccgccaccgccctcccgcgtgccgccgccttccctgcaatcgccgtcgcggcggcgcccctgcgcccgcgccgcgcgccgaggccggtggcggcccgggccgggggcgaggagcgggagactatactgctccccgggtgcgactacaaccactggctgatcgtcatggagttccccaaggaccccgcgcccacccgcgagcagatgatcgacacctacctcaacacactcgccaccgtcctcggcagcatggacgaagccaagaagaacatgtacgcattcagcacgaccacctacaccgggttccagtgcaccgtggacgaggagacgtcagataagttcaagggtctgcctggggtgctgtgggtgctccctgattcctacatcaacgtgatgaacaaggactacggaggtgacaagtacgtgaaccgcgagataatcccctgcacgtacccgacgtaccagccgaatgagcggaggacgtccaagtacgagagcaggcggtactagacgtcgagagatgggccacccggcgccagcacgaaaccgagccagcaggcaccagctcagactcagacccgagtcgcgtcttcgcgacgagctctgcaagccatttgtcccacgtcctaccctagcctgaagtagaacaagaaaggacgacgccctaaaagtctgtcccattgggcacccgcttactgaactgggacaagacaggtt

SEQ ID NO: 79159 - protein, 194 aa, Zea mays
  misc_feature: Ceres CLONE 1564172
MAASLPTTAARLAAPAFAYRSPKAPSATALPRAAAFPAIAVAAAPLRPRRAPRPVAARAGGEERETILLPGCDYNHWLIVMEFPKDPAPTREQMIDTYLNTLATVLGSMDEAKKNMYAFSTTTYTGFQCTVDEETSDKFKGLPGVLWVLPDSYINVMNKDYGGDKYVNREIIPCTYPTYQPNERRTSKYESRRY

SEQ ID NO: 79160 - DNA, 877 bp, Zea mays
  misc_feature: Ceres CLONE 1564173
  misc_feature: Encodes the peptide sequence at SEQ ID NO. 79161
  misc_feature (712)..(712): n is a, c, t, g, unknown, or other
  misc_feature (755)..(755): n is a, c, t, g, unknown, or other
  misc_feature (776)..(776): n is a, c, t, g, unknown, or other
  misc_feature (777)..(777): n is a, c, t, g, unknown, or other
  misc_feature (794)..(794): n is a, c, t, g, unknown, or other
  misc_feature (860)..(860): n is a, c, t, g, unknown, or other
ctccccgcggtggcggccgctctagaactagtggatcccccgggctgcaggaattcgtctcacccctagaaaaaaacgcgtctctctgtaaaccacagtccacagccaccaagatcgccgcgctctctccaacatctcctgaccaaagcgaatccagcatcaccggggtccaggaggcagcatggctgacgaccagcagccaccggcgcaacggtactggttcccgtactggaccgcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccagaggcgctggcggtggtgtccctgatccacctgcccagccgcagcccacgcggctgtccagcaggccatcgccgtcgccttcccgcgctcagccactgtcgcccattagagagcccaacgcttcaccggcaccggttgccaaagagcacaagcagccttctcctcttcatcataccgagcatggtgttcctaagcaaaaagacatcaccgttccgcaagagaaaaccatccatgaaccgcttgtagcatccaagacacaaacaaagaccccagagaaagaaaaagacaaggaaaagggaaaggagaaggagaaggaaggcagccagctgcacaaggaaaaagantaggagaagaaagacaaggagaaggaaaaggaaaaagaaaggnagaaggaggatcataaagatnnagaaagacaggatcccnaagagaagaaagaaaagattaagagaaggagggcagccagctacacaagaagctcagggcgggtgntcgccgacatggtgcac

SEQ ID NO: 79161 - protein, 176 aa, Zea mays
  misc_feature: Ceres CLONE 1564173
MADDQQPPAQRYWFPYWTAPAPRPVARPQLSRRETRPAPSPPATASPSRRPSHPQQAATPASRGAGGGVPDPPAQPQPTRLSSRPSPSPSRAQPLSPIREPNASPAPVAKEHKQPSPLHHTEHGVPKQKDITVPQEKTIHEPLVASKTQTKTPEKEKDKEKGKEKEKEGSQLHKEK

SEQ ID NO: 79162 - DNA, 856 bp, Zea mays
  misc_feature: Ceres CLONE 1564174
  misc_feature: Encodes the peptide sequence at SEQ ID NO. 79163
  misc_feature (747)..(747): n is a, c, t, g, unknown, or other
  misc_feature (807)..(807): n is a, c, t, g, unknown, or other
ctccccgcggtggcggccgctctagaactagtggatcccccgggctgcaggaattcgtctcacccctagaaaaaacggagcgaggctcctccgcatttcttatctatcctgatccaaaccctccgagggggaaacaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtcttcgtcaagaacaactacttccgcgccgacgcgcccgacgcgccgccgaagcgcgggcgcgggcggcccccgaaggcgcgggaccccggcgcgccggtgtcgccgccatcggggcgcgggcgcgggcgcccgcccaagcccaaggacccgctggacgccgccgtgaagcaggccaccgcgggcatgcccagggcccgcggccgcccgcccaagaaggccaagaccgagggcggcgcgtccccggcccccgccggcgacgggctcacccccgtcaagcgcggccgcggccgcccccccaaggtacgccccgtcgtgcccagcgagacggcccgcgcttgacggacgctgctgcatggngttagtgcgtagcgattcgtcccgccgccaccgccgcaggggtgatgtttgtaggcctcnttttcctcatctaattgtcctcctaatcggcgtctcgcgcatttattat

SEQ ID NO: 79163 - protein, 183 aa, Zea mays
  misc_feature: Ceres CLONE 1564174
  misc_feature (13)..(81): Pfam Name: Linker_histone Pfam Description: linker histone H1 and H5 family
MATEEVAKPSPIPPYPEMILAAIEDLGDKSGSNKSAISRYIEGKYDGDLPPAHASLLAAHLARMKESGELVFVKNNYFRADAPDAPPKRGRGRPPKARDPGAPVSPPSGRGRGRPPKPKDPLDAAVKQATAGMPRARGRPPKKAKTEGGASPAPAGDGLTPVKRGRGRPPKVRPVVPSETARA

SEQ ID NO: 79164 - DNA, 853 bp, Zea mays
  misc_feature: Ceres CLONE 1564177
  misc_feature: Translation starting site: 207
  misc_feature: SWISSPROT Homolog: EC 2.6.1.2 Alanine transaminase
  misc_feature (677)..(677): n is a, c, t, g, unknown, or other
  misc_feature (765)..(765): n is a, c, t, g, unknown, or other
  misc_feature (790)..(790): n is a, c, t, g, unknown, or other
ggagctccccgcggtggcggccgctctagactagtggatcccccgggctgcaggaattcgtctcacccctagaaaaaaacgccaaacatctggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcaaagcagattcttgcaactattcctggacgggcaacaggtgcatatagtcacagtcagggtatcaaaggattgcgtgatgcaattgctgctgggatcacctcacgtgacggattccctgcaaatgcagatgacattttcattacagacggagcaagtccctggggtccacatgatgatgcnattactgattaggaatgagaaagatggcattctgtgcccaattcctcagtaccccttgtactcggcctccatagctcttcatggtggnaggctctgtcccctattacttgagnaaaaactggtggggggggttggggaaatctctgatcttaaagaaacactcggaagagctcggt

SEQ ID NO: 79165 - DNA, 944 bp, Zea mays
  misc_feature: Ceres CLONE 1564178
  misc_feature: Encodes the peptide sequence at SEQ ID NO. 79166
  misc_feature (95)..(95): n is a, c, t, g, unknown, or other
tcccgcggtggcggccgctctagactagtggatcccccgggctgcaggaattcgtctcacccctagaaaaaaatcccccttctttctctttccgntcgctctcctatgctctctggcctctgcgtatgcgcctaggcgagcccgtgcgctggttggcctcccggacgcggccgcggcgggcgatggggtcgtcggcgccggtgagggcggcgggcggtacaagggatcccggcgagaacccggcggtggggaggctgcgggggctcttcacaggcgacgcggcagatgggtgggagaagtcctgggagtttggtgtgaccccatgggatttgggaaagccaacacctgtcattgaacatcttgcttgatcaggaacactcccataagggacacctttggttcctggatgtggaatgggatacgatgtggtcgctctttgctagccctggaacctttttgttggtgggcttgggatatttctggatttggggctgtttaaaaagggcaaaaccagggggccattcctcctttggccccttggcagaattattttttacttttttccggggccgaaaaaattttcctcccgaggggggattccccaggggggaaacaatttccgacacctttattttttttattattacccggtttcctttgttggtggcccttttgaccccagagccttttaggggggggcctttgggccaataaaacctcttaattccggttctctttataaccccgggtgtggggagcgctcctctccccccgcgggtttttttccggaaatgggggcgtccagagggggggggaccaccccccggacaaacttatatagggggcggcgggctttcccaagagagggtggcggcaaccccagggggtttttgaaatcccttcttttttttggggaaaataagaggtgccgccccttttccccc

SEQ ID NO: 79166 - protein, 80 aa, Zea mays
  misc_feature: Ceres CLONE 1564178
MRLGEPVRWLASRTRPRRAMGSSAPVRAAGGTRDPGENPAVGRLRGLFTGDAADGWEKSWEFGVTPWDLGKPTPVIEHLA

SEQ ID NO: 79167 - DNA, 887 bp, Zea mays
  misc_feature: Ceres CLONE 1564182
  misc_feature: Encodes the peptide sequence at SEQ ID NO. 79168
  misc_feature (504)..(504): n is a, c, t, g, unknown, or other
  misc_feature (505)..(505): n is a, c, t, g, unknown, or other
  misc_feature (571)..(571): n is a, c, t, g, unknown, or other
  misc_feature (620)..(620): n is a, c, t, g, unknown, or other
  misc_feature (703)..(703): n is a, c, t, g, unknown, or other
  misc_feature (706)..(706): n is a, c, t, g, unknown, or other
  misc_feature (707)..(707): n is a, c, t, g, unknown, or other
  misc_feature (759)..(759): n is a, c, t, g, unknown, or other
  misc_feature (763)..(763): n is a, c, t, g, unknown, or other
  misc_feature (764)..(764): n is a, c, t, g, unknown, or other
  misc_feature (766)..(766): n is a, c, t, g, unknown, or other
  misc_feature (768)..(768): n is a, c, t, g, unknown, or other
  misc_feature (789)..(789): n is a, c, t, g, unknown, or other
agctccccgcggtggcggccgctctagaactagtggatcccccgggctgcaggaattcgtctcacccctagaaaaaattcctctgcgcctcccgtctggccgtcttccagacgtctccaatcggagctcccagcgtctcggagaagaggagcagcacggcacggcagctgtggcgaggaaggctcttgtcctgtcccatcccaacccagcagccgtccaaggaggaggagatccaatcggcgtgcaggcgtccaccgtccatccatcgatccaattccaatctgcaggcctctgcgtcgcggcttgttcgtggaggagaggttgctgtggaacccgccgccagttagccatgtcgtcctccgtgctgaaggctgcggccgacagggctattcgcaggcaggccctcacgctgacggacgccgcggcgtccaggatccggcagctcctcagcctcaggcagcggccattcctgcggctcggcgtcaaaagcgcgtggttgcaacnngcctctcgtacacgctcaactatgccgacgaaaaaggagaagtttgatgagcttgtggaggagaangggagtgaaaggtgctgatcgaccccccaagctctgatgcatgttctanggaccaagatggactacgttgacgaaccgttaaaagtccgagttccgtggtcgtaacccgaactttcccaaggggggagttgngcnntgtccgcaatctttttctgactaccgggcgccaaaagagagagctccgttgngggnncngnccccgcggtgctgtctggccnggtctgtcgtggaaaaagcaacgcgtcccgctgcagctccagaaactatcgggggttccctggaggtttcttcttgtaggcatttgttccccgtcgcc

SEQ ID NO: 79168 - protein, 79 aa, Zea mays
  misc_feature: Ceres CLONE 1564182
  misc_feature (52)..(52): Xaa is any aa, unknown, or other
  misc_feature (74)..(74): Xaa is any aa, unknown, or other
MSSSVLKAAADRAIRRQALTLTDAAASRIRQLLSLRQRPFLRLGVKSAWLQXASRTRSTMPTKKEKFDELVEEXGSERC

SEQ ID NO: 79169 - DNA, 988 bp, Zea mays
  misc_feature: Ceres CLONE 1564184
  misc_feature: Translation starting site: 125
  misc_feature (414)..(414): n is a, c, t, g, unknown, or other
ctcaccgcggtggcggccgctctagaactagtggatcccccgggctgcaggaattcgtctcacccctagaaaaaatcaatactgttttggtgaagggagtatatttacagtactacaaagggagatggctaaaactgctacaatttttttagatggacgatgtttgtcattgagggtgggaagtacccaccagattgcattggacttaatgcggacctcatctagggtgctgatatctacgagaagaccaatgaattcattgatagggtagccaagattgttgattcagatgatctcagtgtggaggagcgaaaccaccggtctgttgtatacgagaacggcaattgcaaccccacgcgcctcatgggggatcatctcctctatggggtgttgttacaccggggggggaccacnatgaggacccaataacagcccaccaaggatttcccctgtcctagaattaatactgagccttacccaagaattggcaaagggcattcctcaaaccctacttggataacccattatttattgcctagaaatacgcatgctcccccctatccccaaggggccttccttatcatccaagtcataaaaggtgttgaatttatccaaccacaatgacccctcgccctgagtttcccagaaacgggggagaccttcaggagaaaggagggattgccgtacctagatacaccactatgtgcggtcttaatcgaaagggctatcactaagaaaaattatggtcttaggaatgacgacttaacccacacatctgagtcttaattaccgcgggggtgaactagacacccacaaccttccgtccgcgtttgactccaaaggaaaatccccagaaattctcatctaaattcccccgtgctgttctagtccacatcacccgctattataacgaggtctctttgcgggtcccgaagacacgctaaaggtggggtgtctgctcgggcgtcgtcattttaatacaggcacg

SEQ ID NO: 79170 - DNA, 849 bp, Zea mays
  misc_feature: Ceres CLONE 1564186
  misc_feature: Encodes the peptide sequence at SEQ ID NO. 79171
  misc_feature (793)..(793): n is a, c, t, g, unknown, or other
ctggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgggggctaccgcatcgccggcggcctgctcggcgaggtcgtcgacccgctctatcccggcggcagcttcgacccgctcggcctccgcgacgaccccgaggccttcgttgagctcaaggtgaagagctcangacggccgcctcggcatggtctccaatgtcggatcttcgtcagggcatcgtcacgg

SEQ ID NO: 79171 - protein, 234 aa, Zea mays
  misc_feature: Ceres CLONE 1564186
  misc_feature (65)..(214): Pfam Name: Chloroa_b-bind Pfam Description: Chlorophyll A-B binding protein
  misc_feature (216)..(216): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVGGYRIAGGLLGEVVDPLYPGGSFDPLGLRDDPEAFVELKVKSSXRPPRHGLQCRIFVRASSR

SEQ ID NO: 79172 - DNA, 893 bp, Zea mays
  misc_feature: Ceres CLONE 1564190
  misc_feature: Encodes the peptide sequence at SEQ ID NO. 79173
  misc_feature (562)..(562): n is a, c, t, g, unknown, or other
ctccccgtcggtggcggccgctctagaactagtggatcccccgggctgcaggaattcgtctcacccctagaaaaaagcagctcatcagataggcaaacaccaagaagctaagctagcgcgccatgcagacgccgaccatgtcgacgtccatggccaccacggcgccagcgaagccccccgcgccgccgcggcaatgctgcaggtacctcctcctcccctccaccggccaccgccggagcgtggcggcatggtctgccaaaaagaagaacccgtggctggacccgttcgacgatgggcccgacgaggagttcgattaccagggcatgttctccggcgggaagcaggaggaagacccgcggccgcccgaggaccctgagaacccgtacgggttcctgaggttcccgcagggctacaacccggagctggacagcctcgcctccaaagtccgcggcgacgtgcggcgcgcgtgctgcgtcgtgtcgggcggcgtgtacgataacgtgcttttcttccccgtcgtgcagatgctcaaggtacggtaccccggcgtgctggtggaccntgtgggcgtccgccaggggcaagcatgtggtacgagatgtgcatgaacgtcaggtacgctaacgtctatgaccccgagacgactggccggatcccgcccgattcacgcacatgcctcgcggcctaaagatagggtactatgatctgatcatctccacaagcctgggcgggatcggccaccctcccttccttttcatgtccccggccgcaaaaagtcgggtagtttccccaaaggtaaaggggtggggggggcctttcctaagaaatgttaagggcccaattaaaccccgccaaagggggacccatgtttaaaaacgcgggaggggaaggcg

SEQ ID NO: 79173 - protein, 156 aa, Zea mays
  misc_feature: Ceres CLONE 1564190
  misc_feature (142)..(142): Xaa is any aa, unknown, or other
MSTSMATTAPAKPPAPPRQCCRYLLLPSTGHRRSVAAWSAKKKNPWLDPFDDGPDEEFDYQGMFSGGKQEEDPRPPEDPENPYGFLRFPQGYNPELDSLASKVRGDVRRACCVVSGGVYDNVLFFPVVQMLKVRYPGVLVDXVGVRQGQACGTRCA

SEQ ID NO: 79174 - DNA, 866 bp, Zea mays
  misc_feature: Ceres CLONE 1564191
  misc_feature: Encodes the peptide sequence at SEQ ID NO. 79175
ggagctccccgcggtggcggccgctctagaactagtggatcccccgggctgcaggaattcgtctcacccctagaaaaatagaaaaaacactctcctctcctgtctatccactttccactccttcactgccctccgtctccctcccctcccccctttgctcgccatggccatggcgacctccaccttctccccgcgtcccgccagcctcaggcccctgcgggcgggcggcaagcccgtcggactcctccccttcccgcgccgcctcgcctgtgccaccgccgccggggaggcgccgcccgtggagcagcgggacaaggcggagccggcccccgccgcggcctccaacggggccgccgtcaagtacgaggccccgccgccgcccgcgccagcgccggtcccggccttccgggacgccaggtgggtcaacggcacctgggacctcgccaagttcgacaagggcagcggcgtcgactgggacgccgtcatcgacgccgaggccaggagaaggagatggctcgaagactatccggaggcgactaacacagacgaggctgtcgtcttcgacacttccattattccatggtgggcttggatgaaacgcttccaccttcccgaagccgagaagctaaatggtcgcgccgccatggtcggcttcttcatggcctacttcgtggacagcttgacgggcgcgggcctcgtcgaccagatgggcaacttcttctgcaagacgctgctgttcgccgccgtcgcaggcgtgctgctggtcaggaaaaacgaagacgtcgagtcgctgaaagagctcgtcgacgagaccacgtctatgacaggcagtggcaggcgacctggcaagagactccgctggggaa

SEQ ID NO: 79175 - protein, 234 aa, Zea mays
  misc_feature: Ceres CLONE 1564191
MAMATSTFSPRPASLRPLRAGGKPVGLLPFPRRLACATAAGEAPPVEQRDKAEPAPAAASNGAAVKYEAPPPPAPAPVPAFRDARWVNGTWDLAKFDKGSGVDWDAVIDAEARRRRWLEDYPEATNTDEAVVFDTSIIPWWAWMKRFHLPEAEKLNGRAAMVGFFMAYFVDSLTGAGLVDQMGNFFCKTLLFAAVAGVLLVRKNEDVESLKELVDETTSMTGSGRRPGKRLRWG

SEQ ID NO: 79176 - DNA, 811 bp, Zea mays
  misc_feature: Ceres CLONE 1564193
  misc_feature: Encodes the peptide sequence at SEQ ID NO. 79177
  misc_feature (597)..(597): n is a, c, t, g, unknown, or other
ggagctccccgcggtggcggccgctctagaactagtggatcccccgggctgcaggaattcgtctcacccctagaaaaagtgccagcaggccattcttctcgccttactccctcacagaacccagtaaaatattgccagtcccgccgtcgagatggccccacgccgcctgctcgtcctcgccgtcgtcgccctcgcggccaccgccgccgcggccaactccggcttcgcggactcgaacccgatccgccccgtcaccgaccgcgcggcctccgcgctcgagtccacggtcttcgccgcgctcggccgcacccgcgacgcgctccgcttcgcacgcttcgctgtgaggtacggcaagagctacgagagcgcggcggaggtccacaagcggttcaggatcttctccgagagtctccagctcgtccgctccaccaatcggaaaggcctctcctaccgcctcggcatcaaccgcttcgcggacatgagctgggaggagttccgtgcgacccggctcggcgcagcctagaactgctccgccacgcttaccggcaacccacggatgcgcgccgccgccgttgcgctgccggagacaaaaactgnagggaggatggggatttgtgaagcccattaaaaaaccagggccccctgggggatattaggtgggaccttaacaccactgggggcctttagggttgtataacccggggaaatgggaaggcccttttttcttttaaaaaaactttttggccggggggtttgccattacaaaattgggagagaacggagggcttttctcccccggcctttaaaaaac

SEQ ID NO: 79177 - protein, 123 aa, Zea mays
  misc_feature: Ceres CLONE 1564193
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAPRRLLVLAVVALAATAAAANSGFADSNPIRPVTDRAASALESTVFAALGRTRDALRFARFAVRYGKSYESAAEVHKRFRIFSESLQLVRSTNRKGLSYRLGINRFADMSWEEFRATRLGAA

SEQ ID NO: 79178 - DNA, 911 bp, Zea mays
  misc_feature: Ceres CLONE 1564195
  misc_feature: Encodes the peptide sequence at SEQ ID NO. 79179
  misc_feature (678)..(678): n is a, c, t, g, unknown, or other
  misc_feature (759)..(759): n is a, c, t, g, unknown, or other
  misc_feature (763)..(763): n is a, c, t, g, unknown, or other
ctccccgcggtggcggccgctctagaactagtggatcccccgggctgcaggaattcgtctcacccctagaaaaagagtcgtcgccccctcgctttcaccccacgcggaagcaagaattcgtcgtcaaattcccagcttgcgcgtgtttctgtggatttcttcccgcttccctgctcctgcctcctatgggcctttgatccggggcttcgtggatcttgggaagaggaggtgcggtgggcgcctcggcggcgatctggcggggaggatatggccagcgggaaggagccgatcgaggtcaggtttcgtctcttcgacggcacggatatcgggcctacgaagtacgatccctccaccacggtctcctcgctcaaggagttcatcctcgctcggtggccgcaagataaggatatagctccaaaaactgttaatgacttgaagcttatcaatggtggaaggatattggagaataaccggacacttgcagagtcccgtgttccagtaggagagatcccaggtggtgtaattacaatgcatgtggtagtgcggcctccacaagctgacaaaaacaagaagcagcttgccaattcccccaagcagaacagatgtggatgcaccattctctgataaggcgtctgcttggtgctgtacaatctgtgtgtacacataagattttgtatngtgctttgctgtgttcacacagcatggattcgttttgatatccaatttcttgagccatacaaattccagaagtaagacccnacgnatacgaagatttctggatcgttttggtctagagtgtaggatttggatgctccctgctgtataaattgtgtgtcaaaactgaaaaaaaagtctctttcctttcctgctatatgactttatatcgattccttccagctccgttggctttt

SEQ ID NO: 79179 - protein, 118 aa, Zea mays; identical to SEQ ID NO: 79069
  misc_feature: Ceres CLONE 1564195

SEQ ID NO: 79180 - DNA, 862 bp, Zea mays
  misc_feature: Ceres CLONE 1564196
  misc_feature: Encodes the peptide sequence at SEQ ID NO. 79181
  misc_feature (697)..(697): n is a, c, t, g, unknown, or other
  misc_feature (698)..(698): n is a, c, t, g, unknown, or other
  misc_feature (707)..(707): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (792)..(792): n is a, c, t, g, unknown, or other
acccgcggtggcggccgctctagaactagtggatcccccgggctgcaggaattcgtctcacccctagaaaaactcgaggaggctgccgcggagagcacgcggtcgatgaagctgctccgggagaaggaagcggaggtggcggccgtgtccagcaaggttgcccgattggaggcccttgtggcggagctagagggcaagaactctgaattttttggtgagaagggtgagctggcggagaaattgggggaggccaaggaggcggttcggattgtgtcgagtgaaaaggcggaggtggagaggagcctgcaggacttcaggaaggcggctgaggcttatcgggtggacatggagggaaaattgaaggcaaagttggatgaattgaaggtgttgggtgccgagaaggcggagattgaggccagagtagagtcattggaggcgaagctggtggctgcaatggttgacaagagggaactgcaggctgaggtggcggcaaagaagaaggagtctggtttggtgaagggagaaaatgataagcttcagtctgaggttgtggctgctgagaagaagcacaactttgctgtcgcagaggttaaaagtctcaggatggaattggccacgttgctggctgagaatgaggctgctgctaaggcatttgatgctgagaaggctagactttttggcgagttggagagcctgnnagagaagtnggagaannntcagcagacaaggaagtagctgaggtaacaccccgtggagaggatgctcaggccattaagtgagggccaattggangagctcacagttcatgtcccaactcagctcctgcatgatcttgatatgagggtcccgcctgctgatgaaa

SEQ ID NO: 79181 - protein, 244 aa, Zea mays
  misc_feature: Ceres CLONE 1564196
  misc_feature (233)..(233): Xaa is any aa, unknown, or other
  misc_feature (236)..(236): Xaa is any aa, unknown, or other
  misc_feature (238)..(238): Xaa is any aa, unknown, or other
  misc_feature (239)..(239): Xaa is any aa, unknown, or other
TRGGGRSRTSGSPGLQEFVSPLEKLEEAAAESTRSMKLLREKEAEVAAVSSKVARLEALVAELEGKNSEFFGEKGELAEKLGEAKEAVRIVSSEKAEVERSLQDFRKAAEAYRVDMEGKLKAKLDELKVLGAEKAEIEARVESLEAKLVAAMVDKRELQAEVAAKKKESGLVKGENDKLQSEVVAAEKKHNFAVAEVKSLRMELATLLAENEAAAKAFDAEKARLFGELESLXEKXEXXQQTRK

SEQ ID NO: 79182 - DNA, 824 bp, Zea mays
  misc_feature: Ceres CLONE 1564197
  misc_feature: Encodes the peptide sequence at SEQ ID NO. 79183
  misc_feature (478)..(478): n is a, c, t, g, unknown, or other
  misc_feature (512)..(512): n is a, c, t, g, unknown, or other
  misc_feature (516)..(516): n is a, c, t, g, unknown, or other
  misc_feature (519)..(519): n is a, c, t, g, unknown, or other
  misc_feature (520)..(520): n is a, c, t, g, unknown, or other
  misc_feature (527)..(527): n is a, c, t, g, unknown, or other
  misc_feature (528)..(528): n is a, c, t, g, unknown, or other
  misc_feature (535)..(535): n is a, c, t, g, unknown, or other
  misc_feature (539)..(539): n is a, c, t, g, unknown, or other
  misc_feature (543)..(543): n is a, c, t, g, unknown, or other
  misc_feature (605)..(605): n is a, c, t, g, unknown, or other
  misc_feature (627)..(627): n is a, c, t, g, unknown, or other
ctccccgcggtggcggccgctctagaactagtggatcccccgggctgcaggaattcgtctcacccctagaaaaagcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctctaaggaccccgncgtgagcatcgccatcgtgaagcagtcggtgtcncctngcnngcgcccnntgctggncggncagnctgtctcggcccatggtggtgcgcaagcggcgcaacttgttcctgacgagctgggcctgccntacaacaagcccaaggactacntgtcataaagcacgcggggcttttaagttccagggtatgaacctggtccttggccgcctaaacgtaaactgtttaacccttgggccgggaaggaccccatccttaaggaaagggccttctggggggttttaccaaattgggggctttgggtccttaaccaaaaacccaaatcctggatgggaccccaaccctgggag

SEQ ID NO: 79183 - protein, 164 aa, Zea mays
  misc_feature: Ceres CLONE 1564197
  misc_feature (64)..(164): Pfam Name: Thi4 Pfam Description: Thi4 family
  misc_feature: SWISSPROT Homolog: EC 1.5.5.1 Electron-transferring-flavoprotein dehydrogenase
  misc_feature (113)..(113): Xaa is any aa, unknown, or other
  misc_feature (126)..(126): Xaa is any aa, unknown, or other
  misc_feature (127)..(127): Xaa is any aa, unknown, or other
  misc_feature (130)..(130): Xaa is any aa, unknown, or other
  misc_feature (132)..(132): Xaa is any aa, unknown, or other
  misc_feature (135)..(135): Xaa is any aa, unknown, or other
  misc_feature (163)..(163): Xaa is any aa, unknown, or other
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPXVSIAIVKQSVSPXXRPXLXGQXVSAHGGAQAAQLVPDELGLPYNKPKDYXS

SEQ ID NO: 79184 - DNA, 894 bp, Zea mays
  misc_feature: Ceres CLONE 1564198
  misc_feature: Encodes the peptide sequence at SEQ ID NO. 79185
  misc_feature (448)..(448): n is a, c, t, g, unknown, or other
  misc_feature (457)..(457): n is a, c, t, g, unknown, or other
  misc_feature (482)..(482): n is a, c, t, g, unknown, or other
  misc_feature (567)..(567): n is a, c, t, g, unknown, or other
ctggagctcaccgcggtggcggccgctctagaactagtggatcccccgggctgcaggaattcgtctcacccctagaaaaaatccgttcttcagccggcgcctcccacgtctccagtccgacactccgactcactccccctcccccgccccaacccgtcgcaatggccgccgtctccgcagccccgaggccctcgatgcctccccgactcgccctccgtgcccacctcttctcctccgcctctccgctcccaatgcgcgcgctccccttactccgcagccgcttccgctccttgaccacggcctacgctgtcaagcaggacacggccctctggacccctgcacccgtctccgccatcagtgctgccaccgacgacggctccgtctccctcatcgccgtcgacctatctgacgccacggacctcgtggactcgtacacgaacccgggccnatacctccntgatcgcgtacccggcgaggagctncagccggcgtacatggtcatctcctcgccgcctaaagcggggcccccggttcgaattcctcgtcaaaagcgtgccgggagctacngcgggggcggctctgcccccttcaagaacgggaatgtggggagcctcggcgcctcccgggggagggggtccccccttgacagataaatctccccaaagtccgaaaaccgggctaatttttccgggggggaacgggaaacgggcgaatcaaccccttttccggttcgggttccctgccaaaaaaaagtttaagggggggctttttttgggggaacaaagttggaaatcttgttccaccccggaaaggttttaaaccggggggacacccggggatataaaaaaaaaacccctttttaacacaccaaaaaaaaccgtggaaagggcaaaa

SEQ ID NO: 79185 - protein, 163 aa, Zea mays
  misc_feature: Ceres CLONE 1564198
  misc_feature (96)..(96): Xaa is any aa, unknown, or other
  misc_feature (99)..(99): Xaa is any aa, unknown, or other
  misc_feature (136)..(136): Xaa is any aa, unknown, or other
MAAVSAAPRPSMPPRLALRAHLFSSASPLPMRALPLLRSRFRSLTTAYAVKQDTALWTPAPVSAISAATDDGSVSLIAVDLSDATDLVDSYTNPGXYLXDRVPGEELQPAYMVISSPPKAGPPVRIPRQKRAGSYXGGGSAPFKNGNVGSLGASRGRGSPLDR

SEQ ID NO: 79186 - DNA, 740 bp, Zea mays
  misc_feature: Ceres CLONE 1564199
  misc_feature: Encodes the peptide sequence at SEQ ID NO. 79187
  misc_feature (457)..(457): n is a, c, t, g, unknown, or other
ctacccgcggtggcggccgctctagaactagtggatcccccgggctgcaggaattcgtctcacccctagaaaaaaattcgcttctctgtcaacttcacttcctcgtcgacgcctccggcccaccaaccatgccggcggctgcggcggcgcagaggctcctcgcggcgagcacgaaaatcatcggcgttgggcgcaactacatagcccactccaaggagctcggcaatccggtccccaaggagcccgtcctgttcctgaagccgacctcgtcgtttctccacgctggtgtggccaccgccgccgttgagatcccggagccgctcgagtcgctacaccacgaggtcgagctcgccgtcgtcatttcccggcgcctcctgtcgccgccgtcctgcatcgcgggccgctcggcggtccgcgccagttgccgctgaggctgtttccagcggggggtggcgtnctccctacttaggggtgttgtccccctggggtaccggccaacgaatggaaatggtaaccggccccagggctcccccttgggcccaaaagggccccgccccctcccaacaaaaaaaaaaagaacggggcccccccaaagggaaaaaagtttgaaaaaaaaaaaatttgggggaggggaattttggaaaaaaaaatatccttccccccagagaaaaaaagggcgggggggccacaaattttgtgggggtaaaaaaaaaatatttttttttcccaaaaaaaagaat

SEQ ID NO: 79187 - protein, 100 aa, Zea mays
  misc_feature: Ceres CLONE 1564199
MPAAAAAQRLLAASTKIIGVGRNYIAHSKELGNPVPKEPVLFLKPTSSFLHAGVATAAVEIPEPLESLHHEVELAVVISRRLLSPPSCIAGRSAVRASCR

SEQ ID NO: 79188 - DNA, 891 bp, Zea mays
  misc_feature: Ceres CLONE 1564200
  misc_feature: Encodes the peptide sequence at SEQ ID NO. 79189
  misc_feature (703)..(703): n is a, c, t, g, unknown, or other
  misc_feature (704)..(704): n is a, c, t, g, unknown, or other
  misc_feature (750)..(750): n is a, c, t, g, unknown, or other
  misc_feature (756)..(756): n is a, c, t, g, unknown, or other
  misc_feature (765)..(765): n is a, c, t, g, unknown, or other
  misc_feature (791)..(791): n is a, c, t, g, unknown, or other
  misc_feature (792)..(792): n is a, c, t, g, unknown, or other
  misc_feature (811)..(811): n is a, c, t, g, unknown, or other
  misc_feature (816)..(816): n is a, c, t, g, unknown, or other
  misc_feature (825)..(825): n is a, c, t, g, unknown, or other
  misc_feature (864)..(864): n is a, c, t, g, unknown, or other
ctccccgcggtggcggccgctctagaactagtggatcccccgggctgcaggaattcgtctcacccctagaaaaagcgtctctctgtaaaccacagtccacagccaccaagatcgccgcgctctctccaacatctcctgaccaaagcgaatccagcatcaccggggtccaggaggcagcatggctgacgaccagcagccaccggcgcaacggtactggttcccgtactggacctcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccagaggcgctggcggtggtgtccctgatccacctgcccagccgcagcccacgcggctgtccagcaggccatcgccgtcgccttcccgcgctcagccactgtcgcccattagagagcccaacgcttcaccggcaccggttgccaaagagcacaagcagccttctcctcttcatcataccgagcatggtgttcctaagcaaaaagacatcaccgttccgcaagagaaaaccatccatgaaccgcttgtagcatccaagacacaaacaaagaccccagagaaagaaaaagacaaggaaaagggaaaggagaatgagaaggaaggcagccagctgcacatggannaagataggagaagaaagactagggagagggaaagggaaaagataangagaanggagatcantaaagatagaaaagacaggatcccannagagagaaaagaaagattnagagnagggaggcngccagctacacaaggagctcaaggcgggtgtcgccgacntggtgcacacgctcagctctttcgcac

SEQ ID NO: 79189 - protein, 237 aa, Zea mays
  misc_feature: Ceres CLONE 1564200
  misc_feature (175)..(175): Xaa is any aa, unknown, or other
  misc_feature (176)..(176): Xaa is any aa, unknown, or other
  misc_feature (191)..(191): Xaa is any aa, unknown, or other
  misc_feature (193)..(193): Xaa is any aa, unknown, or other
  misc_feature (196)..(196): Xaa is any aa, unknown, or other
  misc_feature (205)..(205): Xaa is any aa, unknown, or other
  misc_feature (211)..(211): Xaa is any aa, unknown, or other
  misc_feature (213)..(213): Xaa is any aa, unknown, or other
  misc_feature (216)..(216): Xaa is any aa, unknown, or other
  misc_feature (229)..(229): Xaa is any aa, unknown, or other
MADDQQPPAQRYWFPYWTSPAPRPVARPQLSRRETRPAPSPPATASPSRRPSHPQQAATPASRGAGGGVPDPPAQPQPTRLSSRPSPSPSRAQPLSPIREPNASPAPVAKEHKQPSPLHHTEHGVPKQKDITVPQEKTIHEPLVASKTQTKTPEKEKDKEKGKENEKEGSQLHMXXDRRRKTREREREKIXRXEIXKDRKDRIPXERKERXRXGRXPATQGAQGGCRRXGAHAQLFR

SEQ ID NO: 79190 - DNA, 1332 bp, Zea mays
  misc_feature: Ceres CLONE 1564201
  misc_feature: Encodes the peptide sequence at SEQ ID NO. 79191
aaaaaaaggaaaaaaaaacatcaataataatccactgcggtcgctcgtcctcctcccaacctcctcccaagttgcctcgtgctctgcttcttcggttttcaggagcgtcggccattgctgctggaaaagcagaccattgggactccctcgtgcgttttccaaatcagtcaggttgatggcgatggagggaccagttttatgccgccctgcaatgcaagccaaatcgcctgctgctgcgctggtcaacaactccctgaccagattcgggcagcttgggaccatttcaaaatacaggaacgtttcaagattcatttctcccatctctcagccatctacgaagaacataggtccatgctgtagcttcagctcgtcttctgatggcaatggatacatggctggaaactttagcgacagtgatgaagattatgttaattctactgtgctagaagcagttgaggtgagaagtggatcggaaggatatgtgataaagatgcgagatgggaaaaacttgcgttgtgtccataacaattctcaagggagaaatattccagagagtgcaccccaacctgctattgttttgaggattgaagatggaagcgaaactttacttccaatcattgttttggagatgccaagtgtacttctgatggcggctattcgtaatgtccacattgcacgaccaaccatatatcaagttgtcaaggaaatgattgataaaatgggctatgaggtaaaacttgttcgggtaaacaaaagaattcaagaagcgtactgtgctgaactttgtctaacaaagattgatgattctacagacagcatcaccttcgatcttcggccttcagatgccataaacattgctgttcgttgcaaggttcctgtacaagtccatagaagtcttgcatacagtgacggcatcagaccagtcgagccagcaagaatggcagtagcagctggcctatcagatgggttgttatttacagagcttgacagacccgatggacaggcatctgttgaggctcaagagtttggattggtgaagaacatgctcattgcagccgtagaagagagatacaaggatgctgcatcatggaaggacaaactgatgcggctgaggtctaagcggaagaactgggcctgacagcgttgcatgtctggatggtgtaaataaagatgatgcccagctgaattccagtacgcattccagataattgatgctgggttatggctatgtaactagctgtacatattgtatggacccgaggatggtcttctgtaaattcagactaagctttgaagtgaaacactaatccttcggagaaaaaaaaaaaaaaa

SEQ ID NO: 79191 - protein, 320 aa, Zea mays
  misc_feature: Ceres CLONE 1564201
  misc_feature (114)..(253): Pfam Name: DUF151 Pfam Description: Uncharacterised ACR, COG1259
MAMEGPVLCRPAMQAKSPAAALVNNSLTRFGQLGTISKYRNVSRFISPISQPSTKNIGPCCSFSSSSDGNGYMAGNFSDSDEDYVNSTVLEAVEVRSGSEGYVIKMRDGKNLRCVHNNSQGRNIPESAPQPAIVLRIEDGSETLLPIIVLEMPSVLLMAAIRNVHIARPTIYQVVKEMIDKMGYEVKLVRVNKRIQEAYCAELCLTKIDDSTDSITFDLRPSDAINIAVRCKVPVQVHRSLAYSDGIRPVEPARMAVAAGLSDGLLFTELDRPDGQASVEAQEFGLVKNMLIAAVEERYKDAASWKDKLMRLRSKRKNWA

SEQ ID NO: 79192 - DNA, 883 bp, Zea mays
  misc_feature: Ceres CLONE 1564202
  misc_feature: Encodes the peptide sequence at SEQ ID NO. 79193
  misc_feature (642)..(642): n is a, c, t, g, unknown, or other
  misc_feature (655)..(655): n is a, c, t, g, unknown, or other
tggagctccccgcggtggcggccgctctagaactagtggatcccccgggctgcaggaattcgtctcacccctagaaaaaaagcgttccagatcgtactggaccaatctgccaccacactttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgttcccggaagccaagcccgcctcggcggcggcggcggcgagcaggagtgtggtcggggtggacagggactacctgtcctacgacgagccaaagacggtgttcccgggcgaggcgtgcgacgacctcggcggcgagttctgcgaggcgccgtaccaggacggcgtctccagggagctggcgcacgcctgaagaccctgatccatccatgtctgtccacacgctatgtacgtatgtgtagcagatggtttacatcaacntgttaaaacaacntcagcagcacttcgcatggcgggtcggaatccttatttttggggacctaagttcctaatcatcaatccagagggtccgcaatccgggtccgtaaaaacccagggctggaacctgccctccccattttcccggtttttttttctcctttcccgaaaattttttggggtgccggccgcggtttcttccggggcccccggggttttaaaacatcctcccgaagggggggta

SEQ ID NO: 79193 - protein, 138 aa, Zea mays; identical to SEQ ID NO: 75588
  misc_feature: Ceres CLONE 1564202
  misc_feature (1)..(126): Pfam Name: Lir1 Pfam Description: Light regulated protein Lir1

SEQ ID NO: 79194 - DNA, 927 bp, Zea mays
  misc_feature: Ceres CLONE 1564203
  misc_feature: Encodes the peptide sequence at SEQ ID NO. 79195
ctccccgcggtggcggccgctctagaactagtggatcccccgggctgcaggaattcgtctcacccctagaaaaagtgccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagtgccacatgttcgggtacgccaccgacgagacccccgagctgatgccgctgagccacgtgctggccaccaagctgggcgcgcgcctcaccgaggtgcgcaagaacagcacctgcgcctggctgaggcccgacggctagacccaggtgacggtggagtacgtgaacgagggcgggcgccatggtgcccgtccgcgtgcacaccgtgctcatctccacccagcacgacgagacccgtcacaacgacgagatcgccgccgacctcatggagcacgtcatcaagccgtggatccctgtagagtccctcgacgaggagacccatctcacttaacccgtccgggcgcttcgtcatcggggggccccagggtgacccggcctcccccggcgcaaaa

SEQ ID NO: 79195 - protein, 170 aa, Zea mays
  misc_feature: Ceres CLONE 1564203
  misc_feature (4)..(103): Pfam Name: S-AdoMet_synt_N Pfam Description: S-adenosylmethionine synthetase, N-terminal domain
  misc_feature (118)..(170): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MAAESFLFTSESVNEGHPDKLCDQVSDAVLDACLAQDPDSKVACETCTKTNMVMVFGEITTKATVDYEKIVRDTCREIGFTSDDVGLDADRCKVLVNIEQQSPDIAQGVHGHFTKRPEEIGAGDQCHMFGYATDETPELMPLSHVLATKLGARLTEVRKNSTCAWLRPDG

SEQ ID NO: 79196 - DNA, 878 bp, Zea mays
  misc_feature: Ceres CLONE 1564205
  misc_feature: Translation starting site: 140
  misc_feature: SWISSPROT Homolog: EC 1.10.99.1 Plastoquinol--plastocyanin reductase
  misc_feature (470)..(470): n is a, c, t, g, unknown, or other
  misc_feature (554)..(554): n is a, c, t, g, unknown, or other
  misc_feature (594)..(594): n is a, c, t, g, unknown, or other
  misc_feature (727)..(727): n is a, c, t, g, unknown, or other
  misc_feature (784)..(784): n is a, c, t, g, unknown, or other
agctccccgcggtggcggccgctctagaactagtggatcccccgggctgcaggaattcgtctcacccctagaaaaaaagcctgtggacgccagtgagtgaacaccagccgtcttggcccgcttctcccctgctgcggccatggcgacctccgcggcgctctcgaccgccgccaaccccacccagctctgccggtcccgcgctgcgctgggcaagccagtgaaggggcttggcctggggatggggcgggagcgcgcaagccagcggagcatcacgtgccaggcggcgagcagcatccccgccgaccgcgtccccgacatggagaagcggaagctgatgaacctcctcctcctgggcgccatatcgctgcccaccgtcggcatggtcgtcccctacggcgccttcttcgtccccgccggctccgggaacggcggcggcgggacctacgccaaggacaagctgggcaacgacnatcacggtggaggagtggctcaacacgcacggtcccaacgaccgcacgctcgcgcaggggctcaagggtgaccccacgtacctnggtggtggagcaggacaagacgctggccacctacgggatncaacgccgtgtgcacccacctcgggctgccgtcgtgccgtggaacggcgccgagaacaagttcatctgcccctgccatggatcccagtacaacaccaggggcaaggtggtccgcggaccggcgcctctgtcgnctggctctggttcacgccgacgtcgacgacggcaagggtcttcttcgtcccgggggntgagacggacttcagaccggccagaaacccgtggtgatggccatgaggagatatcccgaccaaagcgggctcaatgctcctaggcttttcccca

SEQ ID NO: 79197 - DNA, 830 bp, Zea mays
  misc_feature: Ceres CLONE 1564206
  misc_feature: Encodes the peptide sequence at SEQ ID NO. 79198
  misc_feature (555)..(555): n is a, c, t, g, unknown, or other
  misc_feature (556)..(556): n is a, c, t, g, unknown, or other
  misc_feature (643)..(643): n is a, c, t, g, unknown, or other
ctggagctccccgcggtggcggccgctctagaactagtggatcccccgggctgcaggaattcgtctcacccctagaaaaaatccatccatctattctccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggattttgccagnntcttcaggaatccagcgacgaggagagggagcacgctgaaaagctcatggagtaccagaacaaacgtggaggcagggtgaggctccnatcgattgtgacgcctttaacccgagttgacaccctgagaaaggagatgctctgtacgctatggaagctggctctggccttgggaaaactggttcatgagaaactgccaaacctgcatggtggtggcaaacaaggggcaatgaactcctagttgaagagaatttcttccggaagggaggtcccttca

SEQ ID NO: 79198 - protein, 205 aa, Zea mays
  misc_feature: Ceres CLONE 1564206
  misc_feature (90)..(194): Pfam Name: Ferritin Pfam Description: Ferritin-like domain
  misc_feature: SWISSPROT Homolog: EC 1.16.3.1 Ferroxidase
  misc_feature (127)..(127): Xaa is any aa, unknown, or other
  misc_feature (156)..(156): Xaa is any aa, unknown, or other
MLRVSPSPAAAVPTQLSGAPATPAPVVRVAAPRGVASPAAGAACRAAGKGKEVLSGVVFQPFEEIKGELALVPQSPDKSLARHKFVDDCEAALNEQINVEYNASYAYHSLFAYFDRDNVALKGFCQXLQESSDEEREHAEKLMEYQNKRGGRVRLXSIVTPLTRVDTLRKEMLCTLWKLALALGKLVHEKLPNLHGGGKQGAMNS

SEQ ID NO: 79199 - DNA, 904 bp, Zea mays
  misc_feature: Ceres CLONE 1564207
  misc_feature: Encodes the peptide sequence at SEQ ID NO. 79200
ctccccgcggtggcggccgctctagaactagtggatcccccgggctgcaggaattcgtctcacccctagaaaaaaaacccatccctcccgcgagatctctcaccggagtcaccgccccccagatccgcctcccctcgccggcgcgctcgcgtgttttccgctcgtccgccgccatgtcgcacaaccacggcgacacgatcctgctccacccctcgtcggcgcagtccgacatggacgagatcgagagcctcatccacgccgcgccatctccggccaccgttctccccgcgcggccaccgtctccgacgcgggcctccattcccgtatcctcctctccggcgttggcgccggcgcccgtccccacgaagccgcctctccccgccgcctccattccgatctccgtctctgtctcccccgttctaacgtccgtctccgttcccatcggcgctgacgggtttggacctccacccaacacgctcacagagccggtatgggacaccgtaaagcgagacttagcacgcatcgtcagcaatctcaagctcgtcgtcttccccaatccctaccgcgaggaccccggcaaggcgctcagggactgggacctgtggggtcccttcttctcatcgtcttccttggcctcacgctctcctgggcagcttccgtaaaaaatctgaagtatttgctgttgcatttgctgtccctggagctggggctaaattctgaacctgaaagttctgcttctgggtgaaacatcaacttcttcaaaagcctaagcctcttgggtaatgccggtttccactggaacttggggctccaacttggcaggtgaaaggaaaagggaaatttaaaattggccggggggaaaaccaattgggagggagatcccggggtggcattccatttagag

SEQ ID NO: 79200 - protein, 162 aa, Zea mays
  misc_feature: Ceres CLONE 1564207
MSHNHGDTILLHPSSAQSDMDEIESLIHAAPSPATVLPARPPSPTRASIPVSSSPALAPAPVPTKPPLPAASIPISVSVSPVLTSVSVPIGADGFGPPPNTLTEPVWDTVKRDLARIVSNLKLVVFPNPYREDPGKALRDWDLWGPFFSSSSLASRSPGQLP

SEQ ID NO: 79201 - DNA, 1041 bp, Zea mays
  misc_feature: Ceres CLONE 1564208
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (154)..(154): n is a, c, t, g, unknown, or other
  misc_feature (160)..(160): n is a, c, t, g, unknown, or other
  misc_feature (161)..(161): n is a, c, t, g, unknown, or other
  misc_feature (164)..(164): n is a, c, t, g, unknown, or other
  misc_feature (416)..(416): n is a, c, t, g, unknown, or other
nggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnttcccccngggggnnccnctaaaactggagctccccgcggtggcggccgctctagaactagtggatcccccgggctgcaggaattcgtctcacccctagaaaaagcggcccatttacctgcacacgtccatacccagtaagtgagacttgtcgtccattctgaagtccggcggcggcggcagcggcgagggcgaggcctctgcgacttccagatctccccgacgaagaggaagtctctacagcggaaggggagggagatgtcgtacatgncgggtgacctgctgacaagaagctgaagcttgttaaagggctcgccagggccgagcccccgtgggttcaggccttgggaacgggctcgcccatggacaattcctcccccaaaggggaaaaatcagaaaatgggggcttccctaagggaatgtttttccccgggaatttccccaaaaacaatcccaaaatcccctttccccgggggccaacccacaaaaaaagggggattttatccccccccccccccccccaaagggttttttttttggggggggcccctgggggattttaaaaaaaaaacagggggggcccttaaaaaaaaaattttttccaaagggggggtggtaccaaaaaaaaaaaaaaataccccccccacaaacaaaaaaaaaaggggccgaaaaaaaaaaaaagcgctccacaggggggtggtaaaaaaaaaaaaaccccccccccccccccccgggggggggaagaggcccccccccccaaaaaaaaaatcccccccagggggggtaaaaaaaaaaaaaaatataaccccgcggggagaaaaaaaaaaaaatttttttggggggcgcctttttttttttcccccccgcggggggggatgcaaaaatttgtttccaca

SEQ ID NO: 79202 - DNA, 852 bp, Zea mays
  misc_feature: Ceres CLONE 1564214
  misc_feature: Encodes the peptide sequence at SEQ ID NO. 79203
  misc_feature (698)..(698): n is a, c, t, g, unknown, or other
  misc_feature (699)..(699): n is a, c, t, g, unknown, or other
  misc_feature (702)..(702): n is a, c, t, g, unknown, or other
  misc_feature (743)..(743): n is a, c, t, g, unknown, or other
  misc_feature (834)..(834): n is a, c, t, g, unknown, or other
ctccccgcggtggcggccgctctagaactagtggatcccccgggctgcaggaattcgtctcacccctagaaaagtgccgctcgccgccgtcgccgcggccgacggcgccagggtcgtcgcggccgacttcgagctctcgtccaccgacctcctccactcgcccgcgggcgccgtgcgcctctcgctcgccctccgtccgggcctcgccgacgcgtgcgagccgtcggaggccgtcgtcctcgggctcggccccgcgcccatggccgttgaccttgaccactcgaggatcgagttcacggaccttcgggttagagtggagcaggagaagtcggcgtcctctgacggtgacggcagcaccagccggaacgctgccgcctcgacggccagcacggtgagcgaggaggacagggcgttctcttcttccgccgaggcggcacagcagccgcccgacgtcgaggaggccaccacggcgtcggcgcccgtgtcccggcgctcgccggacacgccgacttcgcgcggcgggaaggccaggccaaggccgacgtcgacgtgctcccgtccccggccggggacatcgtcgacgtggaggcggagcagagcgcgatgcagcggcagatcatgggagatgtacgtgaagagcatgcagcagttcagcgagtcgctggccaagatgcagctgccggttgcgctcggcggcnngcngcggcgtagtagagaaggaagagacgcccgatgacaggaanggtgatcgagcggcagcaggggaagaagaccggggccagggtgtttctacggagcagagctttcttctgaactgggtaaaaaagatacccngggaaaatggactaatct

SEQ ID NO: 79203 - protein, 158 aa, Zea mays
  misc_feature: Ceres CLONE 1564214
  misc_feature (147)..(147): Xaa is any aa, unknown, or other
  misc_feature (148)..(148): Xaa is any aa, unknown, or other
MAVDLDHSRIEFTDLRVRVEQEKSASSDGDGSTSRNAAASTASTVSEEDRAFSSSAEAAQQPPDVEEATTASAPVSRRSPDTPTSRGGKARPRPTSTCSRPRPGTSSTWRRSRARCSGRSWEMYVKSMQQFSESLAKMQLPVALGGXXRRSREGRDAR

SEQ ID NO: 79204 - DNA, 862 bp, Zea mays
  misc_feature: Ceres CLONE 1564216
  misc_feature: Encodes the peptide sequence at SEQ ID NO. 79205
  misc_feature (599)..(599): n is a, c, t, g, unknown, or other
  misc_feature (789)..(789): n is a, c, t, g, unknown, or other
  misc_feature (792)..(792): n is a, c, t, g, unknown, or other
ctccccgcggtggcggccgctctagaactagtggatcccccgggctgcaggaattcgtctcacccctagaaaaagcgtctctctgtaaaccacagtccacagccaccaagatcgccgcgctctctccaacatctcctgaccaaagcgaatccagcatcaccggggtccaggaggcagcatggctgacgaccagcagccaccggcgcaacggtactggttcccgtactggacctcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccagaggcgctggcggtggtgtccctgatccacctgcccagccgcagcccacgcggctgtccagcaggccatcgccgtcgccttcccgcgctcagccactgtcgcccattagagagcccaacgcttcaccggcaccggttgccaaagagcacaagcagccttctcctcttcatcataccgagcatggtgttcctaagcaaaaagacatcaccgttccgcaagagaaaaccatccatngaaccgcttgtagcatccaagacacaaacaaagaccccagagaaagaaaaagacaaggaaaagggaaaggagaaggagaaggaaggcagccagctgcacaggaaaaagataaggagaagaaaagacaggagaggggaaaggaaaagataaggagaaggaggatcataaaggatagaaagacaggatcccnaangagagaaagaaaagattaggaggagggaggcggcagctacacaggagctctcaggcggggtgtcccccaa

SEQ ID NO: 79205 - protein, 210 aa, Zea mays
  misc_feature: Ceres CLONE 1564216
  misc_feature (141)..(141): Xaa is any aa, unknown, or other
  misc_feature (204)..(204): Xaa is any aa, unknown, or other
  misc_feature (205)..(205): Xaa is any aa, unknown, or other
MADDQQPPAQRYWFPYWTSPAPRPVARPQLSRRETRPAPSPPATASPSRRPSHPQQAATPASRGAGGGVPDPPAQPQPTRLSSRPSPSPSRAQPLSPIREPNASPAPVAKEHKQPSPLHHTEHGVPKQKDITVPQEKTIHXTACSIQDTNKDPRERKRQGKGKGEGEGRQPAAQEKDKEKKRQERGKEKIRRRRIIKDRKTGSXXRERKD

SEQ ID NO: 79206 - DNA, 909 bp, Zea mays
  misc_feature: Ceres CLONE 1564218
  misc_feature: Encodes the peptide sequence at SEQ ID NO. 79207
ctggagctccccgcggtggcggccgctctagaactagtggatcccccgggctgcaggaattcgtctcacccctagaaaaaaacccaacctaacccacaagccacacaacccaagcacaaaacacatcaccgcatctttttccttccgagctgtacgtatctgcagagagagagagagagagagagagagagagagaaagattaggtcagagaccatgaagcacccgaggccgacggagcaggatgtgtcgctggcgctgtcgctgagcacggactcgtccacgacgacgtccgactcggcggggacgccaccggcgaagcgagcgcgggcgcgggcgcggcggcggggcgccgtggtggccacgtcgggggagggcgagttcgtctgcaggacctgcagccgcgccttcccctcgttccaggcgctgggcggccaccgcaccagccacctgcgcgcgggacgccacggcctcgacctcggcgtcgtcggcgcccgggcgctcaagcagcacaagcagcaggccgccaacgccaacgccaacggctgcgaaggaggcaagcagcggcacgagtgcaacgtctgcgggctcggcttcgagatgggccaggcgctgggcggccacatgcggaggcacgcgaggaaggaataatgggcgccgcccacgcctggggtcacctctggcgcaccgaggcgtcacgcgccggcgacccgcccgtcttgctcgagctcctcgctttaatcgatccgccgggcatagggtcgggctatccccccttgtttttttggggggaggctaaccccccatcttgactcctgaggacgcgggggtttatcccggacatggtaaaccgattgggtccttcgatgccttctttttgtatttcccccaggaatgtactcgctcccgcg

SEQ ID NO: 79207 - protein, 144 aa, Zea mays
  misc_feature: Ceres CLONE 1564218
MKHPRPTEQDVSLALSLSTDSSTTTSDSAGTPPAKRARARARRRGAVVATSGEGEFVCRTCSRAFPSFQALGGHRTSHLRAGRHGLDLGVVGARALKQHKQQAANANANGCEGGKQRHECNVCGLGFEMGQALGGHMRRHARKE

SEQ ID NO: 79208 - DNA, 864 bp, Zea mays
  misc_feature: Ceres CLONE 1564222
  misc_feature: Encodes the peptide sequence at SEQ ID NO. 79209
  misc_feature (766)..(766): n is a, c, t, g, unknown, or other
  misc_feature (773)..(773): n is a, c, t, g, unknown, or other
  misc_feature (800)..(800): n is a, c, t, g, unknown, or other
  misc_feature (805)..(805): n is a, c, t, g, unknown, or other
ctccccgcggtggcggccgctctagaactagtggatcccccgggctgcaggaattcgtctcacccctagaaaaaactcgccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaggagaggcttctgaagagggcccaagctgagaatgaaggaaaaactgttgagtcgaagaaaccaattgttgtgaagtatggccttaaccatgtgacttacctcattgagcagaacaaggctcagcttgttgtcatcgctcatgacgtggatccgattgaactggttgtgtggcttccagccctgtgcaggaagatggacgtcccttactgcattgttaaagtaaaggctcgccttggatcgattgttcacaagaagaatgcatcagtcttgtgtctcaccactgtcaagaacgaggataagcttgangtcagcnagatcttggaagctattaaggcaaacnttcancgacaagtcgatgaagtcaggaaagaagtggggaggtggcatcatggggatccagtcgc

SEQ ID NO: 79209 - protein, 238 aa, Zea mays
  misc_feature: Ceres CLONE 1564222
  misc_feature (113)..(208): Pfam Name: Ribosomal_L7Ae Pfam Description: Ribosomal protein L7Ae/L30e/S12e/Gadd45 family
  misc_feature (206)..(206): Xaa is any aa, unknown, or other
  misc_feature (209)..(209): Xaa is any aa, unknown, or other
  misc_feature (218)..(218): Xaa is any aa, unknown, or other
  misc_feature (219)..(219): Xaa is any aa, unknown, or other
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVESKKPIVVKYGLNHVTYLIEQNKAQLVVIAHDVDPIELVVWLPALCRKMDVPYCIVKVKARLGSIVHKKNASVLCLTTVKNEDKLXVSXILEAIKANXXRQVDEVRKEVGRWHHGDPV

SEQ ID NO: 79210 - DNA, 828 bp, Zea mays
  misc_feature: Ceres CLONE 1564223
  misc_feature: Translation starting site: 653
  misc_feature (756)..(756): n is a, c, t, g, unknown, or other
ctccccgcggtggcggccgctctagaactagtggatcccccgggctgcaggaattcgtctcacccctagaaaaagctcagtggccgccgccggaccgtggacgcagctagcccatcagcccatggcagggacggacgtcgcaggctccgcacgcggctccgatgccgcgctcggcaagacgggcgaaccacccgccgcggcgcgctctggcgcaggcgcgcagccaagaaggtgactctcgctctgctagcctccttctcggcgctgctgtacagccagattcagccgccgccgtctaagatccccggcacgccgggcgggcctccggtcacggcgcccagaacaaggctcaaggacggccggcacttggcgtacctggaatccggcgtcccaaaggagaaggccaagtacaagatcatattcgttcacggcttcgactgctgtagatacgacgtgctgaatgtctcccaggggctgttggaagagctgggaatttacctgctgtcctttgaccggcccgggtacgccgagagcgacgcccacccggcccggacagagaagagcgtcgcccttgacatcgcggagctggcggacaatctccagctcggccccaagttccatctcatcggcttctccatggggcggcgagatcatgtggagctgccctcagtacatcccgcacaggctcgccggcgtgcgattcttgccccgtgcaaatttactggtgggtcggcttcccccggacgtgttcagganggctggcccttgcagtttcgcagaccagcgcgcgtctgggtcgctaccactgcctggcttgacacctggtga

SEQ ID NO: 79211 - DNA, 939 bp, Zea mays
  misc_feature: Ceres CLONE 1564224
  misc_feature: Encodes the peptide sequence at SEQ ID NO. 79212
  misc_feature (548)..(548): n is a, c, t, g, unknown, or other
  misc_feature (858)..(858): n is a, c, t, g, unknown, or other
ctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttggggctgcgtgttcccggagctgctcgcccgcaacggcgtcaagttcggcgaaggccgtgtggttcaaggccggggtcgcagatcnttcagcgaaggtggggctggactacctcggcaacccggagcctgatccacgcgcagagcatcctcgccatctgggccctgccagggtcgtgctcatgggcgccatcgagggggtaccgcgtcgcctggcgcccgctccggagaggtcgtcgacccgctctacccccgctgcagcttcgacccgctcggcctcgccgacaaccctgagcctcgcggagctcaaggtgaagactcaagacggcggcctcgcatgtctccatggtcgggtcttcgtcccagcatcgtcacgggaaggcccgtcgagaactcgncgaacactcgcgacccgttaacacaacgatggcctatgcacacttttgccggaaaatgtgagggggtgagcgcaccgcccc

SEQ ID NO: 79212 - protein, 206 aa, Zea mays
  misc_feature: Ceres CLONE 1564224
  misc_feature (64)..(181): Pfam Name: Chloroa_b-bind Pfam Description: Chlorophyll A-B binding protein
  misc_feature (139)..(139): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGLRVPGAARPQRRQVRRRPCGSRPGSQIXQRRWGWTTSATRSLIHAQSILAIWALPGSCSWAPSRGYRVAWRPLRRGRRPALPPLQLRPARPRRQP

SEQ ID NO: 79213 - DNA, 896 bp, Zea mays
  misc_feature: Ceres CLONE 1564225
  misc_feature: Encodes the peptide sequence at SEQ ID NO. 79214
  misc_feature (697)..(697): n is a, c, t, g, unknown, or other
  misc_feature (706)..(706): n is a, c, t, g, unknown, or other
  misc_feature (845)..(845): n is a, c, t, g, unknown, or other
  misc_feature (896)..(896): n is a, c, t, g, unknown, or other
ctccccgcggtggcggccgctctagaactagtggatcccccgggctgcaggaattcgtctcacccctagaaaaaacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggcaggaaggagaaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcatttgaagtctgcacccccatgtcgatgagcgagtgnaggacctcntagatttcagtatctacttggacatcagtgatgaagttaagtttgcatggaaaatccagcgggacatggcagaagcgtggcacagcctttgaagcatcagggccagtatcgaggccaggaaacaggattttgatgcccnttatgatccgcaaaagcagtatgctgatgcctgtgattgaagttctgcccn

SEQ ID NO: 79214 - protein, 178 aa, Zea mays
  misc_feature: Ceres CLONE 1564225
  misc_feature (61)..(179): Pfam Name: PRK Pfam Description: Phosphoribulokinase / Uridine kinase family
  misc_feature: SWISSPROT Homolog: EC 2.7.1.19 Phosphoribulokinase
MAICSAHTTTSLRSPCTTVSNAGLRQKQVIFVTSNRRSGGGRRHGGARSFQVSCSVDKPVVIGLAADSGCGKSTFMRRLTSVFGGAAEPPKGGNPDSNTLISDTTTVICLDDYHSLDRNGRKEKGVTALDPRANNFDLMYEQVKAIKEGQAVEKPIYNHVTGLLDPPELIAPPKIFVI

SEQ ID NO: 79215 - DNA, 883 bp, Zea mays
  misc_feature: Ceres CLONE 1564230
  misc_feature: Encodes the peptide sequence at SEQ ID NO. 79216
  misc_feature (855)..(855): n is a, c, t, g, unknown, or other
  misc_feature (859)..(859): n is a, c, t, g, unknown, or other
  misc_feature (866)..(866): n is a, c, t, g, unknown, or other
ctccccgcggtggcggccgctctagaactagtggatcccccgggctgcaggaattcgtctcacccctagaaaaagcagagcccagagtccgcccgtgacaacccgtagcgtctctgatctctctcgtgactcccggtccggaggagcacaggcatggagctggagcagaagccgccgccgccgccggcggggtactggagcggcgtggcgggcgggcgcccctgcgacgcgtgcgccgcgcggccggcgcggctgcactgccgcgcggacggcgcgttcctgtgccccggctgcgacgcgcgggcgcacggcgccgggtcgcggcacgcgcgcgcgtggctgtgcgaggtctgcgagcacgcccccgccgccgtcacctgccgcgccgacgccgccgcgctctgcgccgcctgcgacgccgacatccactccgccaactcgctcgcgcgccgccacgagcgcctccccgtggcgcccttgctcggcgcgctctccgacgcgccggcgccgcagcacttcccctccgcggcggcggcagcgggggaagaagcgtcggcggcggaggaggaggacgggagcgacgaggccgaggcggcgtcgtggctgctccccgagcccgacaacagccacgaggacagcgccgccgccgactcattcttcgcggagccggacgcgtacctcggcgtcgacctggacttcgcgcggtgcgtggacggcgtcaaggccatcggcgtgccggtcacgccggcgccgctcgagctggacatggctgccggcagcttcttctacccccacactccatgaacacagcgtgccgtcgtcctctgaggtgggcggtgaacagggggaaaagancggnaggcgcnggctgatgcggtaccgt

SEQ ID NO: 79216 - protein, 216 aa, Zea mays
  misc_feature: Ceres CLONE 1564230
  misc_feature (64)..(106): Pfam Name: zf-B_box Pfam Description: B-box zinc finger
  misc_feature (19)..(63): Pfam Name: zf-B_box Pfam Description: B-box zinc finger
MELEQKPPPPPAGYWSGVAGGRPCDACAARPARLHCRADGAFLCPGCDARAHGAGSRHARAWLCEVCEHAPAAVTCRADAAALCAACDADIHSANSLARRHERLPVAPLLGALSDAPAPQHFPSAAAAAGEEASAAEEEDGSDEAEAASWLLPEPDNSHEDSAAADSFFAEPDAYLGVDLDFARCVDGVKAIGVPVTPAPLELDMAAGSFFYPHTP

SEQ ID NO: 79217 - DNA, 780 bp, Zea mays
  misc_feature: Ceres CLONE 1564231
  misc_feature: Encodes the peptide sequence at SEQ ID NO. 79218
  misc_feature (549)..(549): n is a, c, t, g, unknown, or other
  misc_feature (574)..(574): n is a, c, t, g, unknown, or other
  misc_feature (697)..(697): n is a, c, t, g, unknown, or other
ctccccgcggtggcggccgctctagaactagtggatcccccgggctgcaggaattcgtctcacccctagaaaaaagggttcgcggatcccccacgacacctataagcaccaaccctagcccaaaaccccgcttccacttcacagcctctccgcctccgctcctcgcgccgccgccgcgtctcctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctcccaccattggtatttctgttgatcaccgcccgcagaacaaatcccttgagggactgcaggtcnatgtccagaggcttaagacatacanggcctagctggttatctttccaaggcgtgcacacaaggttaaaggctggtgactctactcccagaggagcttgccacccgctacccaggtcccggggtgactacatgcccatttactcctggntgaggaaacgtttcatttggagggtggtgaaggtcccccaaatgaaaatgaaagtcccttttgctgccctatgggcaaagctc

SEQ ID NO: 79218 - protein, 121 aa, Zea mays
  misc_feature: Ceres CLONE 1564231
  misc_feature (6)..(121): Pfam Name: Ribosomal_L13e Pfam Description: Ribosomal protein L13e
  misc_feature (112)..(112): Xaa is any aa, unknown, or other
  misc_feature (120)..(120): Xaa is any aa, unknown, or other
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRPQNKSLEGLQVXVQRLKTYXA

SEQ ID NO: 79219 - DNA, 975 bp, Zea mays
  misc_feature: Ceres CLONE 1564232
  misc_feature: Encodes the peptide sequence at SEQ ID NO. 79220
  misc_feature (285)..(285): n is a, c, t, g, unknown, or other
  misc_feature (418)..(418): n is a, c, t, g, unknown, or other
  misc_feature (613)..(613): n is a, c, t, g, unknown, or other
  misc_feature (616)..(616): n is a, c, t, g, unknown, or other
  misc_feature (630)..(630): n is a, c, t, g, unknown, or other
  misc_feature (642)..(642): n is a, c, t, g, unknown, or other
  misc_feature (643)..(643): n is a, c, t, g, unknown, or other
  misc_feature (782)..(782): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
ctccccgcggtggcggccgctctagaactagtggatcccccgggctgcaggaattcgtctcacccctagaaaaagatcccgccgccggaggcgccatggtccccgctgccggaggcggcagcgtgtgggcgaacggcgccccccgcttcggcgacatggtctgggccaaggtgaagtcgcacccgtggtggccgggccacatctacagcgtcagcctcaccgacgacgaggaggtgcaccgcggctaccgctacgggctggtcctgggtcgtccgttactgtcgnagcgtaacaaaagcctacgggtggttcgagcccgcgagctcgtcccttcgaggagcacttcaccgagaatgctgcccatggctgcagcacccgcagtagtttcgcccggcggcgttggccggaagcccgttcnaactaaaggttagccccggtcggcaaagggccggccttagaggcctttgttcctttgccccggtgtttaaaaaaaagcccccaacgcccctgtccgcccccccacccccaggggaagggggaaatttcccccccttggggccaaattgttcccggggcctttttggaaaactttggaaacctttgaaattttttnagnccccccaaagaggntaggtagatggnncccaaagagtgaagggtgtttttctgcccccccccaaaaaggcgggccccaaataacacccgggggggaaaaccccccccccgttaactcccgggggggaacaccgggggagaaataatatgtggcgcccacacctttnccctggggtaaaaaaaaaaagagcgcccccccgatttttttttggaggaaaaacccccccgccaaagagggtttttccccacacctaaaataaaaacccccccctccccccccccaccnnntggggggggggggggtgggttcccacaaagggggggcccttcttttttcacaaaaaaaaaaaaaacgccgcc

SEQ ID NO: 79220 - protein, 142 aa, Zea mays
  misc_feature: Ceres CLONE 1564232
  misc_feature (46)..(115): Pfam Name: PWWP Pfam Description: PWWP domain
  misc_feature (95)..(95): Xaa is any aa, unknown, or other
  misc_feature (139)..(139): Xaa is any aa, unknown, or other
PRGGGRSRTSGSPGLQEFVSPLEKDPAAGGAMVPAAGGGSVWANGAPRFGDMVWAKVKSHPWWPGHIYSVSLTDDEEVHRGYRYGLVLGRPLLSXRNKSLRVVRARELVPSRSTSPRMLPMAAAPAVVSPGGVGRKPVXTKG

SEQ ID NO: 79221 - DNA, 1096 bp, Zea mays
  misc_feature: Ceres CLONE 1564234
  misc_feature: Encodes the peptide sequence at SEQ ID NO. 79222
ctcaccgcggtggcggccgctctagaactagtggatcccccgggctgcaggaattcgtctcacccctagaaaaagttatgaacattctagagcgtcatgctagctattcgatgtctggcaaggagctttctaaactcgttgcttttgtcaaggggactcactttgatcttgtgaaatatctacaacgagaaaggcaagggtctgctcgtctagagaattttgcttcagaactcgtactgattggacaaaagctccgaatggatacactgcaaagtctacttgatgcagagctccttctagttcatatgtgttcagtcaagtcccaggaatgaaccctggtgctagatacttcactggggtgtgcagacgttttgctggatctcttgtacccctcgatttacgattgtgaagaagcatatagcacttactctgcattgatcatgatctcttcattatatatatcctgaactttctttaatactcctctgcaccgaacggacctgttcaatcttgctccctgtgatccatactacttgcgaaatatgcgtcccttgttatcttggaaataggcccccgcacccaatgcacatttggaactgggcaattaaaatgctgtgttgtttttcaaaacaccgtatgcataattatggatgtgattctgtttctaacacgcttttttgtataagaaactattctcgtccgaaaacgcgcggcaccccaggagaaaaccggttagagtatataaaattataggatcgcacgtcgaaaacggagggtttttgtttgttacaccatttaatagagacaaatacaccccaattataagggcgcgcttttgacgccacagtctacaccttgttgtctggtgagcacccaatattataagcccaccattcttgctcacaaaatataattggacatactgaaaagaccccagagaatgtgtgaattatgccaatcacgctatgtccaatagactgtgtaaactgtatgttaccgcctacattaaagacacgctgtgcctataataagagagtgcttaacacaaacataagagtggtacacttacgcgtccacggaggagactgccctacag

SEQ ID NO: 79222 - protein, 109 aa, Zea mays
  misc_feature: Ceres CLONE 1564234
HRGGGRSRTSGSPGLQEFVSPLEKVMNILERHASYSMSGKELSKLVAFVKGTHFDLVKYLQRERQGSARLENFASELVLIGQKLRMDTLQSLLDAELLLVHMCSVKSQE

SEQ ID NO: 79223 - DNA, 942 bp, Zea mays
  misc_feature: Ceres CLONE 1564236
  misc_feature: Encodes the peptide sequence at SEQ ID NO. 79224
  misc_feature (884)..(884): n is a, c, t, g, unknown, or other
ctccccgcggtggcggccgctctagaactagtggatcccccgggctgcaggaattcgtctcacccctagaaaaaggtccccaccaggcaatcaagaacaccacctaccgctgacttgtcaattcctgtctgtgcgcgcgcgcgcgtggcgccggccgagcggccgttgacccgatgaccggcgcggcggccgtcgatcccccggtgcctcggccgcggcggctcacggtcctcccgctcatcgcgctcatcttctacgacgtctcgggaggccccttcggcatcgaggactcggtccgcacgggcggcggcgcgctgctcccgatccttggcttcatcgtcctcccagtcctctggtcgctcccggaggcgctggtcacggccgagctcgcatcggctttccccacctacgccgggtacgtggcctgtgtgtccgccgccttcggccccgccgtggcgttcctcgtcgggttctccaagtgggcgtcggggacgctcgacaacgcgctctacccggtgctgttcctcgactacctccgctccggcggcgggctggcgctgccgccgccggcccgctcgctggcggtcctcgcgctcacggccgcgctcacctacctctactaccggggggctcacatcgtcggcctctcggcgctggggctcaccgcgttctcgctctccccgttcctcgcgctcaccgtgctcgcggccccctagatccgcccgtcccgctgggctcgcatcgacgcccgcgccgtcgacctcaggggctacttcaactccatgttctggaacctcaacttctgggacaagccagcacgctcgccggcgatgtcgagtaccccagagacgtccccaaagcggtgtcggcgccttcggctctcntcgggcgtactcattcgctgttgatggtaccggtgcctgcttcgatacgcggctaatg

SEQ ID NO: 79224 - protein, 180 aa, Zea mays
  misc_feature: Ceres CLONE 1564236
MTGAAAVDPPVPRPRRLTVLPLIALIFYDVSGGPFGIEDSVRTGGGALLPILGFIVLPVLWSLPEALVTAELASAFPTYAGYVACVSAAFGPAVAFLVGFSKWASGTLDNALYPVLFLDYLRSGGGLALPPPARSLAVLALTAALTYLYYRGAHIVGLSALGLTAFSLSPFLALTVLAAP

SEQ ID NO: 79225 - DNA, 666 bp, Zea mays
  misc_feature: Ceres CLONE 1564238
  misc_feature (471)..(471): n is a, c, t, g, unknown, or other
tccccgcggtggcggccgctctagaactagtggatcccccgggctgcaggaattcgtctcacccctagaaaaagcgacgcctcaaatcgctccctgcctctgccctctggtcacctcgcttccgctcccggctcccctccggccacccagacatcgtccagttcgctcgccaagagacaggaccgggagaccatggcggtaccagctccaccgacgaaccagatcgccctagttcaaaggagggccttcagccctctttcaaaaaaggaaagggggaaacggtttgccttccccaaaccccaagggaagcccccgaaaaaatgggttcatgggggaaaaaaccccgggggggggccaaaaaaacccccccccccgggggggggggtgaaaatccccccccccggggaaaaattttgtttttttcccccccacaccggggggggggggccaaaaaaaaaaaccccggcgganaaaaaggggggggagaaaaaaaaggggtggggcctccccccccccccccgggcggggggaggaatttttttttttcccccccccggggggggaggaagaggaaatatattttctcccccccccacccaaaaaacaagcccccctccccttctgtatatgtgggggggggggtccccccccccacccaccacaata

SEQ ID NO: 79226 - DNA, 798 bp, Zea mays
  misc_feature: Ceres CLONE 1564239
  misc_feature: Encodes the peptide sequence at SEQ ID NO. 79227
aagctggagctccccgcggtggcggccgctctagaactagtggatcccccgggctgcaggaattcgtctcacccctagaaaaaacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggccccagctcttatgagaaagtccaaggaccaaagggctttgaaaatctggcttcccatgcaccagtttggtgggcagaacctgaacaattgaggagattgtcagtttgcctgccccccttcagggtgaaacccccttttcaacaaggttaattcaacgggggaaaaggtggcccccctttaaaattttttaaaattaaaaaaaggggggcttttttggggaacgcccccaggggggaaattttttccaattttttttgtttaaaaaaagagggaaaaactttttggggaaaaattttatttttccaaaaactttttctccccggggggtttttgggggggggttttttaaaaacctccttttggggggccctttaaaaaaaaaatttggggggggggggaaaactttttaaaaaaaaaaattttttttccccccggccccgcggggggagaaaaataaattttttggttga

SEQ ID NO: 79227 - protein, 82 aa, Zea mays
  misc_feature: Ceres CLONE 1564239
  misc_feature (10)..(81): Pfam Name: GSHPx Pfam Description: Glutathione peroxidase
  misc_feature: SWISSPROT Homolog: EC 1.11.1.12 Phospholipid-hydroperoxide glutathione peroxidase
MAASSTATSVHDFIVKDASGKDVDLSTYKGKVLLIVNVASQCGLTNSNYTELAPALMRKSKDQRALKIWLPMHQFGGQNLNN

SEQ ID NO: 79228 - DNA, 898 bp, Zea mays
  misc_feature: Ceres CLONE 1564242
  misc_feature: Encodes the peptide sequence at SEQ ID NO. 79229
  misc_feature (749)..(749): n is a, c, t, g, unknown, or other
  misc_feature (764)..(764): n is a, c, t, g, unknown, or other
  misc_feature (871)..(871): n is a, c, t, g, unknown, or other
  misc_feature (880)..(880): n is a, c, t, g, unknown, or other
ctccccgcggtggcggccgctctagaactagtggatcccccgggctgcaggaattcgtctcacccctagaaaaagtttgaagctagaggtgtcgacccttcgtcccgcatcgtttcctcctcctttttccccgttcgtcccctggattggcgtctacccggcgcgacccggaccgaatcctaagtccgcctgccgccgccgccgccggctcccgttggaaacgagtttggagtaaagaaaccaaccttgcatctgtgttctgtctgtctatgctgctttgctttggattcacaaaaaaataagccttgcatctcactgacttgagataactatgcctaaggacaggagctcccgcgtttcctctcacgagagccgccgggctcgtgcctccccatacttgtcagcgtctcatggacagagcagttcttcacgccggtcacaagagtctcctgcggccgcggcagcgaagcaagctgcagagtgggaggatgttcggtgctcggtctgcatggaccacccgcacaacgctgtcctgctggtctgctcgtcgcacgagaagggctgccgccccttcatgtgcgacaccagctcgcggcactccaattgctatgaccagtaccggaaggcctccaaggactcctccaaggattcagggacagagtgcagcgagtgccagcagcaggtccagctctcgtgcccgctgtgccgtgggccagtcagcgacgggcatcaggactacgacgcacggnagtacatgaacaccnaggtccggtcctgcaccatggagtcgtgcgagttcaggggtgcctaccagagctgaggaagcatgctaaggtggagcaccagcgcggagccgatggagtagacctgnaccgcagcnggattggcgccgatgaac

SEQ ID NO: 79229 - protein, 162 aa, Zea mays
  misc_feature: Ceres CLONE 1564242
  misc_feature (51)..(162): Pfam Name: DUF1644 Pfam Description: Protein of unknown function (DUF1644)
  misc_feature (140)..(140): Xaa is any aa, unknown, or other
  misc_feature (145)..(145): Xaa is any aa, unknown, or other
MPKDRSSRVSSHESRRARASPYLSASHGQSSSSRRSQESPAAAAAKQAAEWEDVRCSVCMDHPHNAVLLVCSSHEKGCRPFMCDTSSRHSNCYDQYRKASKDSSKDSGTECSECQQQVQLSCPLCRGPVSDGHQDYDARXYMNTXVRSCTMESCEFRGAYQS

SEQ ID NO: 79230 - DNA, 942 bp, Zea mays
  misc_feature: Ceres CLONE 1564243
  misc_feature: Translation starting site: 175
  misc_feature: SWISSPROT Homolog: EC 1.1.1.42 Isocitrate dehydrogenase (NADP(+))
tccccgcggtggcggccgctctagaactagtggatcccccgggctgcaggaattcgtctcacccctagaaaaagcctgccgtctctcttccaccttccaccacaagcgccgccgcagccggtgcctgctccttcccgatccccgaggcaaagctgcgactccgcaaccgccgccatggcgttcgagaagatcaaggtctccaacccaatcgtcgagatggacggtgatgagatgaccagggtattctggcagtctatcaaggacaagcttatcctcccatttctggacctggacatcaagtactatgatttggggatactgcaccgtgaagcaactgatgacaaggtcacagtggaggctgcagaggctactctcaagtacaacgtggctattaaccgtgcgaccattactccagatgaaactcgggttaaggagttcaatctgaaacacatgtggaagagcccaaatggcacaattaggaacattataaatggcactgtgttcagagagcctattatatgcaaaaacgttccaagacttgttccaggatggactaagcccatctgcattgggaaggcatgcctttcggtgatcaatacctagctaccgatgcagttctgaaggggcctgggaaagctgaagctagttttttgagggaaaagaagaacagattgatctgggagggattcaacttccctggtgccggaagaagttgccttggtctttgtaccacaccgaccagttaatccgagctttttgcggaggtttccaataacaacggcttataaaaaaaaaatggccccccctccttttcaccaaaaacccattcctgaaaaataaataagggccggtttaaggaacttttcccaggagggctctaaacccgaccgcgatttccaattctagggtgccgggaatagggatagaaccaccccttatgtt

SEQ ID NO: 79231 - DNA, 621 bp, Zea mays
  misc_feature: Ceres CLONE 1564246
  misc_feature: Encodes the peptide sequence at SEQ ID NO. 79232
  misc_feature (237)..(237): n is a, c, t, g, unknown, or other
  misc_feature (268)..(268): n is a, c, t, g, unknown, or other
tccccgcggtggcggccgctctagactagtggatcccccgggctgcaggaattcgtctcacccctagaaaaaacgagaaaaatcaaatcaggagacggggattccagagagcccctgtcgggtagggaagggaaggagaggcgaagcggaggcgagatgggggcggccgaatccgtgccggagacctccatacacgaattcaccgtcaaggattgcaacgggcaaggaagtgagccntggaaatcctacaaggggggatggtcctccntttgttgttaaacgttcggcctcccaaattgtggggtttccccgggaaaacccattttccccccccccccttggaacggaaacccttttttccccaaataggtcccgggggccccaaagaaatttccaaaaaaatttttggggaattttcccccctttggaaaaaaaaagtttttctttttggccccccccgggggccccccccggggtttccttgttttttccccccccaaaaataaaacaaaaaaaaaattttttttttgggggggggggcccccccccccaattttttttttatagagggggggggtaatattcccccccccccccctttttttttttttttcaaaaaaa

SEQ ID NO: 79232 - protein, 40 aa, Zea mays
  misc_feature: Ceres CLONE 1564246
  misc_feature (38)..(38): Xaa is any aa, unknown, or other
MGAAESVPETSIHEFTVKDCNGQGSEPWKSYKGGWSSXCC

SEQ ID NO: 79233 - DNA, 944 bp, Zea mays
  misc_feature: Ceres CLONE 1564248
  misc_feature: Encodes the peptide sequence at SEQ ID NO. 79234
  misc_feature (708)..(708): n is a, c, t, g, unknown, or other
  misc_feature (709)..(709): n is a, c, t, g, unknown, or other
ctggagctccccgcggtggcggccgctctagaactagtggatcccccgggctgcaggaattcgtctcacccctagaaaaatgatggggctagcaacatgagaggtgatattaaaggattgaaaacattggtcatgcaagagtcaccttctgcttattatatccattgttttgcacatcaactccaactagttgttgttgccaagggaaataatgattgtgagtggttttttgatcaagtaactctcttattgaatatcgttggagtttcttgtaagtgtcacggtatgcttcgagatgctagacttgggaatctcatgaaatcacttgaatgtggtgaacttgatactgggagaggattgaatcaagagatggggttgcctaggcctggtgagactcgatggggctcttattacaaaactatatgcaacataattactatgtatcctgtaatccgagatgttctcatgattcttggagaagatactacaattagaagtgattggacaaggatacattctatgcttggagcatttgagtcatttgactttgtttttgatgcacacttaatgtttgttattcttggatatacaaatgatttatcagtgtgtttgcaaagaagggaacagatattattaatgcattttccttgttaatgtggcaaagagaaagaatgcacaattaaggcttgatggttgggatcaattccnntcaagaaccacttcattttgcaacaacatgatatccaattcctgctatggatgggaaatatagcccttatgaagatcatcacgatttgttcataaccaaccatgatgacactttcaaagaaaagatatattgggtcattgatcaattacctaaagctgatagtcggttattgagctatatggaactcctttctgatgtcagcttaaaacctccacctctttgctcttttatgaca

SEQ ID NO: 79234 - protein, 185 aa, Zea mays
  misc_feature: Ceres CLONE 1564248
MRGDIKGLKTLVMQESPSAYYIHCFAHQLQLVVVAKGNNDCEWFFDQVTLLLNIVGVSCKCHGMLRDARLGNLMKSLECGELDTGRGLNQEMGLPRPGETRWGSYYKTICNIITMYPVIRDVLMILGEDTTIRSDWTRIHSMLGAFESFDFVFDAHLMFVILGYTNDLSVCLQRREQILLMHFPC

SEQ ID NO: 79235 - DNA, 926 bp, Zea mays
  misc_feature: Ceres CLONE 1564250
  misc_feature: Encodes the peptide sequence at SEQ ID NO. 79236
ctccccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgccagcatcccctccaagtgcggcgtcagcatcccctacaccatcagcacctccaccgactgctccagggtgaactaaaacctagaccacgcgcgacgacggccgcctgatcgatcgaccaaccatttccgccgtcgccgccggccgaatcatcggtcgtcgtcatgatgatatctatccatctacgcgtgatgatcgatggctacttgtctactgctatgtactactaataaaatctctccccgtgtgtgtacacgtacgcttgcatgtgcatggtagcatggacgtacgacctcgtccatgtataagtgtgtgacgggtgagacggacagagagagaagaggaactgatcgattcgaagacggcatgtcccttttggcggttggggtaatccatccccaacttttgagtgattaaaaaattattcttgggcagcctatttttccataggggaggaaacaaatgtgtacgggt

SEQ ID NO: 79236 - protein, 121 aa, Zea mays; identical to SEQ ID NO: 62569
  misc_feature: Ceres CLONE 1564250
  misc_feature (32)..(117): Pfam Name: Tryp_alpha_amyl Pfam Description: Protease inhibitor/seed storage/LTP family

SEQ ID NO: 79237 - DNA, 1320 bp, Zea mays
  misc_feature: Ceres CLONE 1564254
  misc_feature (57)..(57): n is a, c, t, g, unknown, or other
  misc_feature (59)..(59): n is a, c, t, g, unknown, or other
  misc_feature (771)..(771): n is a, c, t, g, unknown, or other
  misc_feature (817)..(817): n is a, c, t, g, unknown, or other
  misc_feature (985)..(985): n is a, c, t, g, unknown, or other
atgctctttgttggcgctcgtcactttcctttatcttcacccatcctcttctttttntntaaaaaggttttgtttgttttaactccccgcggtggcggccgctctagaactagtggatcccccgggctgcaagaattcgtctcacccctagaaaaagatgttggacatttgaaaacaattgtgaaatcttaatatccatacgttgagagctatcctgagctcaattgcttacactgcctggaatgcacttgattattcttatgccttcgctaggaatagctgagcaactaaataaggaacggctggaacaggtggcactgaaaagtggccacaccactgatgaagtgactcctttgcatactgacattgacaggagtaattttgattctgctgatcaggctgcaaatgtcaatgttgctactagcagtaagcgtggatctatgagtgaagcagctttgatcattttcatcttgctacccccacaaaaatcgattcatgtccccattttgaaactctcggacctatgcttggtctgtatcggaacctccggaataagactgcccttgtgataataatatgcatccatccggggcgtcttccaggagctttaaggtctgacttcgaaaaagcctctgaaaaagtgaaaaactttgaccattattgtgggagggagtaagttcaaatttgaaagtccgtggttggggcaattataacaccctgtggaacaaaaaccttgttataatagtgtgtgtccctgctcgatgtttctcnctgtatcggccacgagttcaatatttttaggtaccccaggagctgngatagagggcgataaaaaaataaccctcttgttgtctctttgtacctccacatataaatatctccccacgggttgtaaaatatatgcttctctatatagaggggcgtgatatatatatttgtgtttctcccgccgcagagaccttcctcatgtagacagagacgcttngccgatatataaatttaaccgccctgtataaaccaaaagttgttaaatacctgtttggtgctctgagaccaacagtaactcctgcgtatatttagaggagacaccgcgtgtttctccagtgtgagaaaattttgaattcgctgcgactaccatttgttgaccgcctaattagaaagccccccccgcagagctttgtctcttaaagagagtcaggttgaaaaaacctaaacatatcttttcgaccgatggtttcatattgaactatatactgcatatttttctaagccactgaatagtgcttcttcgagtgcttttgtaaagaggcagaacacagg

SEQ ID NO: 79238 - DNA, 833 bp, Zea mays
  misc_feature: Ceres CLONE 1564255
  misc_feature (672)..(672): n is a, c, t, g, unknown, or other
  misc_feature (712)..(712): n is a, c, t, g, unknown, or other
ctccccgcggtggcggccgctctagaactagtggatcccccgggctgcaggaattcgtctcacccctagaaaaatgcctccacgacgattcggcacaaacggagcaactgcacgctcagcctcatcctgcgacctccctctccacgaaaatggttgcaggtggttgctccgcctggccccacctgctcctcaccacactgtcgacgtcttccttcccatgccactgcctttttccttcccatgctgtcgtcgtcgctgcacacctgttaggcgtgttccgcctctcctctctatagctgggcagctgagcttctctccccttggcttcacatccgctagcgagccgtgcctccaccgtcgcctgctcggaccggtgggacccagctcccccacgtggtctcgtcccatccattagcccggatctcacgtcccgctccctctgaggacccaatcgtcttcctccttcgccgtcgccgggaactcgtctccatgcttcactttctcaaggtgagcctagggtttcttctctgccgcggaatgcatggatgaccggcgtggatggcgccccccaatctccatgccccagcgcgcgctccggcaaacgggaggcgaggccatccgcgcgcgatggcgctggacccgtgcggcgacctcgtggtgacgccgaagacngcggcccaagacaggcgtcctgctccgtgccatgccgccnaaggtcacccccgacgaggtgtgcgcagtggcacgcagttcatggaccacctatccagagaccgagcccgacgtctggggcgttctcacgccatctccaagaaggccgccttcggccctag

SEQ ID NO: 79239 - DNA, 930 bp, Zea mays
  misc_feature: Ceres CLONE 1564256
ctccccgcggtggcggccgctctagaactagtggatcccccgggctgcaggaattcgtctcacccctagaaaaagtcccgtcctcggtcctccatcagtagtaaccactcctcgtcgtctctctcgcggtctcgcctcctgcagctagctctcgccagaaagggaaaccgcatctgcttcagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcggccgacagcccgggcgctgcggctggcggcgggtcgcggaggcgccgcgcccgagccgctacgagtcgcagaagcggcgggactggcacacgttcgggcagtacctgcgcaaccaccggccgccgctggagctggcgcggtgcagcggcgcgcacgtgctcgagttcctgcgctacctcgaccagttcggcaagaccaaggtccacgcgccggggtgccccttcttcggccacccgtcgccgcccgcgtcgtgcccgtgcccactgcggcaggcctggggcagccttgacgcgctcatcggccgcctgcgcgcctgcttcgaggagcacgggggcccggccgaggtcttccccttcggcgcccgcgccgtgcgctctaccttcgcgaagtccgcgacagccatggcaaggcgcggcgcatcgccttacgatatgaaacgcctgtaagcggcgtccgcctcgtcccagtcgtcgccgcatggcgcgacgacccccgccgtgcaagcccctcccgtctcaagccgggcctttctgacccgcggccctaaaggccccactttggggcgcacgtccccgaagccgggagggggacaagaacacttcttttg

SEQ ID NO: 79240 - DNA, 1214 bp, Zea mays
  misc_feature: Ceres CLONE 1564258
  misc_feature: Encodes the peptide sequence at SEQ ID NO. 79241
gttttcatcttgccgttcctctgggtgctttttttatgtcctctcataattttttgttgtggaggaaaaagctggagctccccgcggtggcggccgctctagaactagtggatcccccgggctgcaggaattcgtctcacccctagaaaaaaccaccactttctcactgaccactgtgccgcggcatgctcaccggacggacacaaggtcgacgaccactaagcatagagaacgacgatggccgcgtcggcgctgcagcagaccatcagcttcctcgggcaggccctggtctcccgccccgccggcgtcgatgccggcggccgcatcaccatgcgccgcaccgtcaagagcgctccccagagcatctggtacggccctgaacgccccaagtaccttgggccgttctccgagcagatgccgtcatacctgacgggcgagttccccggcgactacgggtgggacaacccccccctctccgcggaacccaagacgttcgcgcgcaaccgggagctggaggtgatcccactcccggtgggacatgcttggggcccctgggggtggcgtggtccccaaagttcctggtcgaagaacgggcgttaagtttccggcgaaggccgtattggtttcatggtcccggcgtcacattctttcctcgggaaaggcgggggctttggacctaccctggggggataaccccaaaacacccggggtgctaccgccgcccccaaaccatttccactgggccctattcttaggggccagtggccctaaatggtgaggtggcgctctattaagggggcctttgccacttcccgagaaggggcctttttgggtgagagaggggtgcctccgccctttcctcagaggaaataggcccttccctaccaaagggttgtcgctcctcccgaacatgggggccccttgcaacaacaccgctgtgggggcccctctttcgtaacgaatatcttgatctacccccccgccccttaattcttctcgggtaaaagggacccctaccaaaaacgggcccaccctcccccttgttctcccccatttcccagggagtacttctgtgccaaggaacactgcttttatcggaaaggagccccacctctaggaacactttttaagaataggtagcacgaagccgttccacaataacctctgggggctcaaacccttatttccgccccgcgaaaatatacggaaccgcc

SEQ ID NO: 79241 - protein, 120 aa, Zea mays
  misc_feature: Ceres CLONE 1564258
MAASALQQTISFLGQALVSRPAGVDAGGRITMRRTVKSAPQSIWYGPERPKYLGPFSEQMPSYLTGEFPGDYGWDNPPLSAEPKTFARNRELEVIPLPVGHAWGPWGWRGPQSSWSKNGR

SEQ ID NO: 79242 - DNA, 949 bp, Zea mays
  misc_feature: Ceres CLONE 1564260
  misc_feature: Encodes the peptide sequence at SEQ ID NO. 79243
  misc_feature (409)..(409): n is a, c, t, g, unknown, or other
acccgcggtggcggccgctctagaactagtggatcccccgggctgcaggaattcgtctcacccctagaaaaacgtcgtcgagcaaccaccagcaggtggtggtgatgattcaaccgtccacacgtcggacgacgaagctgtcgtcgtctacaggttgacggcagcctcccgcttcctcgtcagcgacgacgtgagcacggcgaccttggctccctttgtgagtctggcgctccagcctatcgctgcctgtccgcacgccctgggtatctccgcgtggttccggcaggagcagcacgagccgtccccgtatggcctggcgttccgccagaccccaacgatctgggaacatgctgacgacgtaaacgccttgctgaacaaaggcatggccgcggacagccgcttcctcatngccattgtgctgagggagtgcggcgagacgtttcgtgggatcgactcgttggttgaccgtcgtgtgggccatggtggggcgcgcgccacatttgcggccgctttcccccactcaagtgcagcgtgcttgacttcccgccgtttgtccccgggtgctccctctgattgcaaactggcatttcctccccaggcaatttggtttgaaaagtatccaccctgcaaccggttgttttcctcaaaaaaacccctaactgactggggggaaaaaaagaagggggcaaaaatttggaaaaatttgagcaagcccttttccccccggaattcaggggggaaaggaaaaccctggggggggggggggggggataaaaccgccaaccttaaacctgagagaaccctttttttttttttttttttttaggcgggtttaacgggttgttggggccccacaaaaggggaaaaaatatctcctgggaggggtgtaaaaacaaaaattccccccgggtggggaggttgcgccaccaggggtctctctggagggttt

SEQ ID NO: 79243 - protein, 147 aa, Zea mays
  misc_feature: Ceres CLONE 1564260
  misc_feature: SWISSPROT Homolog: EC 2.1.1.128 (RS)-norcoclaurine 6-O-methyltransferase
  misc_feature (9)..(9): Xaa is any aa, unknown, or other
MAADSRFLXAIVLRECGETFRGIDSLVDRRVGHGGARATFAAAFPHSSAACLTSRRLSPGAPSDCKLAFPPQAIWFEKYPPCNRLFSSKKPLTDWGEKKKGAKIWKNLSKPFSPRNSGGKGKPWGGGGGDKTANLKPERTLFFFFFF

SEQ ID NO: 79244 - DNA, 863 bp, Zea mays
  misc_feature: Ceres CLONE 1564262
  misc_feature: Translation starting site: 142
  misc_feature (451)..(451): n is a, c, t, g, unknown, or other
  misc_feature (452)..(452): n is a, c, t, g, unknown, or other
  misc_feature (460)..(460): n is a, c, t, g, unknown, or other
  misc_feature (470)..(470): n is a, c, t, g, unknown, or other
  misc_feature (493)..(493): n is a, c, t, g, unknown, or other
  misc_feature (552)..(552): n is a, c, t, g, unknown, or other
ctggagctccccgcggtggcggccgctctagaactagtggatcccccgggctgcaggaattcgtctcacccctagaaaaatccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttccctcagtggtaccgggagggcgagctgatccacgggggcgtggcgaatgcggccgtgctgggcatcttcnntggggcanggcgtgagcngcatccccgtggttcgggggccnggcgcggacccgagcgccatcgcggccttctcctttcgggtcgctgctgggcacgccanctgctgctgatgggggggggtggaaatccaaaccggggggtggactttcttcaaaccgggattccagggcccgggaatggggcccccccctgggttcccccccccttaaaaatttgcccaaatttaccggggagaaaagggaaccccgggggggcaagtttttttaaacccgtttgggccttccccgggcccgttaaagagaagggggtttaaatttcccccaaatttaaaaaattttggaggggtttaaaagtgggggcaaaaaaaaaaaaaccccccccaatccccggggtttgcccaaagtccccccc

SEQ ID NO: 79245 - DNA, 915 bp, Zea mays
  misc_feature: Ceres CLONE 1564263
  misc_feature: Encodes the peptide sequence at SEQ ID NO. 79246
  misc_feature (521)..(521): n is a, c, t, g, unknown, or other
  misc_feature (534)..(534): n is a, c, t, g, unknown, or other
  misc_feature (787)..(787): n is a, c, t, g, unknown, or other
ctccccgcggtggcggccgctctagaactagtggatcccccgggctgcaggaattcgtctcacccctagaaaaaagcagccagctcccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcaaacaagggggtgtcgctgccgacgtgggcgagagttcgagctcgggcgggcgccggtctactggaagaccagcagcggcctcccgccctcgccgggcgaggggctgaccctgttctacaacccggcggcgacgaagatggccccngaacgaggtgttncggcgtggcgttcaacggcggcttcaaccagcccatcatgtgcggcggagagccgaggcagatgacgctgcaggagcggggcaaagccgacccgcccatctacaccatcaggatacgcgtgccgcagcacgccgtaagcttgatcttctccttcaccaacgggggccgagtgggacgggccgtacacgctccaagtcagggtcccccaagcatggcagaacaagcgctgagctttcttcacgagggcctggcngtacgactcacaaggagggcgcctgcgactggcatctaccggacgagactccctcacatcgggggggggggggccccccccacgggggaggggggggggggacggggccaacctgaaatccggacgga

SEQ ID NO: 79246 - protein, 132 aa, Zea mays
  misc_feature: Ceres CLONE 1564263
  misc_feature (112)..(112): Xaa is any aa, unknown, or other
MATLSSCSRLSSGTGAAAIHRQPARAGAVLVVTCRRSSSATVRAAAAATAAAPAAVELQTRGCRCRRGREFELGRAPVYWKTSSGLPPSPGEGLTLFYNPAATKMAPERGVXAWRSTAASTSPSCAAESRGR

SEQ ID NO: 79247 - DNA, 907 bp, Zea mays
  misc_feature: Ceres CLONE 1564264
  misc_feature: Encodes the peptide sequence at SEQ ID NO. 79248
  misc_feature (488)..(488): n is a, c, t, g, unknown, or other
  misc_feature (802)..(802): n is a, c, t, g, unknown, or other
  misc_feature (803)..(803): n is a, c, t, g, unknown, or other
ctccccgcggtggcggccgctctagaactagtggatcccccgggctgcaggaattcgtctcacccctagaaaaaatctcatcatcgagtcatccatctaaacatccgatccgaccatggcggcagacgcacttcggggccttctccccggcgtttacgccgtgctgatggtaatcgccgtcgcaagcgctgcctccagcgacgtgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggcgctgactgcgttgcacagctccacagcgctgcggggaacccgtgccccggtcaagaaccttccagaattgtgccacaatcgtcaaagggcnaacttcgtcgtggtccctggaaagacagactacccatcgaaggaatgtgcgtccgcaaccctggtgtgggtcgatcaagaagcacctactagaccatttccacaagaaacctgtgccaccaaagccaaagccagaacctaagccagagccggagccgaagccagaacctaagccagagccagagaacacccacctacaccaacatacggatcctcaactccgatctacatcctccatccaggcagttgtttgacaagaaacacatgtttgatcacttcacaagcacacgactaccatcacttctttgacacttnncacagaaacagttccacaaagccaaaccagaacctagcagaacaaacccatgccccagcagatacactctccaactcaactatggtcgccacacgactacaccc

SEQ ID NO: 79248 - protein, 154 aa, Zea mays
  misc_feature: Ceres CLONE 1564264
  misc_feature (34)..(145): Pfam Name: DUF1210 Pfam Description: Protein of unknown function (DUF1210)
  misc_feature (125)..(125): Xaa is any aa, unknown, or other
MAADALRGLLPGVYAVLMVIAVASAASSDVSSVVVGLAKCADCTRKNLKAEAAFKGLEVAIKCKNSKGEYESKAMGKLDGFGAFSIPLSTDLHGADCVAQLHSAAGNPCPGQEPSRIVPQSSKGXLRRGPWKDRLPIEGMCVRNPGVGRSRSTY

SEQ ID NO: 79249 - DNA, 635 bp, Zea mays
  misc_feature: Ceres CLONE 1564265
  misc_feature: Encodes the peptide sequence at SEQ ID NO. 79250
  misc_feature (477)..(477): n is a, c, t, g, unknown, or other
  misc_feature (478)..(478): n is a, c, t, g, unknown, or other
ctggagctccccgcggtggcggccgctctagaactagtggatcccccgggctgcaggaattcgtctcacccctagaaaaactcacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctccctgctggtgccgaggagcccgtcgcggcccgaacgggccgccnnaaggcggaaggctggctgctccctgctgggtcccgaaggaaaactcccggccggtcgaagcaaggaaggcaacccccccccaaagaaaggaaaggcttgcctggcctggctccccttcccgggcttgggggggccccaaaagggaagcccccccccc

SEQ ID NO: 79250 - protein, 134 aa, Zea mays
  misc_feature: Ceres CLONE 1564265
  misc_feature (83)..(83): Xaa is any aa, unknown, or other
MATAEVQTPTVVAAEEAPVVETPPPAVVPEESAPAEAEAEAEAAAPADPEELPAAEQQAAAEAEAAAPCWCRGARRGPNGPPXGGRLAAPCWVPKENSRPVEARKATPPQRKERLAWPGSPSRAWGGPKREAPP

SEQ ID NO: 79251 - DNA, 837 bp, Zea mays
  misc_feature: Ceres CLONE 1564266
  misc_feature: Encodes the peptide sequence at SEQ ID NO. 79252
  misc_feature (486)..(486): n is a, c, t, g, unknown, or other
  misc_feature (616)..(616): n is a, c, t, g, unknown, or other
  misc_feature (688)..(688): n is a, c, t, g, unknown, or other
ctccccgcggtggcggccgctctagaactagtggatcccccgggctgcaggaattcgtctcacccctagaaaaactcgacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaagcgtgggagcgccggcgcaggggcatgcgccgcggggccacggcgctgcggcgcgcccgcagcgtcacggacgacgacctcgacgagctccgcggctgcatcgacctgggcttcggcttcgagccggcgcccgccgccgcgtgcgcctgcgcctgcgccgggaggaaccgcctcctggagacgctgcccgcgctcgacctctactacgccngtccacggcggggccggcggaaagcgcccccgtgctcgtgcggcgccgcgtcggaggcgtcctcgtccggaggagtcgccgctcggcagccccatgtccatactctctccaggcgacacgccggaagacngtgaagatgcggctgaagcatttggcgcagggtgtttgcgctgtccatgctggagcgccactgagctctccnggccacggcccgccgctaccttgtcgcattgggaagaagaagaaaaaccatttcaagatgccccccaccgcggaaggaaggaatcctccggcggtcccctccagccgaaaaaaaaggaaaagaaaaaaatcctgttagggtttggccct

SEQ ID NO: 79252 - protein, 150 aa, Zea mays
  misc_feature: Ceres CLONE 1564266
  misc_feature (21)..(129): Pfam Name: DUF1685 Pfam Description: Protein of unknown function (DUF1685)
  misc_feature (108)..(108): Xaa is any aa, unknown, or other
MEKAGQQRHVIGGGGKKAPALGLQKQNSWSPDIERDEAWERRRRGMRRGATALRRARSVTDDDLDELRGCIDLGFGFEPAPAAACACACAGRNRLLETLPALDLYYAXPRRGRRKAPPCSCGAASEASSSGGVAARQPHVHTLSRRHAGR

SEQ ID NO: 79253 - DNA, 882 bp, Zea mays
  misc_feature: Ceres CLONE 1564267
  misc_feature: Encodes the peptide sequence at SEQ ID NO. 79254
ctccccgcggtggcggccgctctagaactagtggatcccccgggctgcaggaattcgtctcacccctagaaaaaaggttaaagagacgccgccgccgcaagccgtccgccttgcccctcgaaggcttggtcctccttgtatcccgacctcctccgccacagacccgtttccccgctagagttatcgttcctctgcagcgatggcgatcaagcggaccaaggcggagaagaagatcgcgtacgacaagaagctgtgcagcctgctcgatgagtacaccaaggtgctcatcgccctcgccgacaacgtcggctccaagcagctccaagacatccgccggggcctcaggggcgactcggtggtgctcatgggcaagaacacgctcatcaggcgctgcatcaaggtctacgccgagaagaccggcaaccacacctttgacccgctcatggacctgctcgtcggcaacgttggcctcatcttcaccaagggagacctcaaggaggtgcgcgaggaggtcgccaagtacaaggttggggctcctgctcgtgttggtctggttgctcctgttgatgttgtcgtgccccctggcaacactgggctggatccctcccagacctctttcttccaggtgcttaacatccccaccaagattaacaagggtactgtggaaattatcacccctgtggagctgatcaagaagggtgagatagtggggctcgtccgagtctgccctgctcgccaagctgggcatccgccccttctcgtacggtctccaggtcaccagcgtctacgaaggatggtctgtgttcagcccctgagtggctgacctttctgaagaggacctatcgagaagttcgccactggtgtctcatggtcgcttctctt

SEQ ID NO: 79254 - protein, 207 aa, Zea mays
  misc_feature: Ceres CLONE 1564267
  misc_feature (6)..(110): Pfam Name: Ribosomal_L10 Pfam Description: Ribosomal protein L10
  misc_feature: SWISSPROT Homolog: EC 4.2.99.18 DNA-(apurinic or apyrimidinic site) lyase
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGEIVGLVRVCPARQAGHPPLLVRSPGHQRLRRMVCVQPLSG

SEQ ID NO: 79255 - DNA, 826 bp, Zea mays
  misc_feature: Ceres CLONE 1564268
  misc_feature: Encodes the peptide sequence at SEQ ID NO. 79256
  misc_feature (575)..(575): n is a, c, t, g, unknown, or other
  misc_feature (578)..(578): n is a, c, t, g, unknown, or other
  misc_feature (580)..(580): n is a, c, t, g, unknown, or other
  misc_feature (581)..(581): n is a, c, t, g, unknown, or other
  misc_feature (593)..(593): n is a, c, t, g, unknown, or other
  misc_feature (595)..(595): n is a, c, t, g, unknown, or other
ctggagctccccgcggtggcggccgctctagaactagtggatcccccgggctgcaggaattcgtctcacccctagaaaaacgtgctctctcagaggtgggctggcttctcctccccctcttacaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtttgcttcgtcctcgctaggtttcattccgcggtctgtttgtgccgttggggctagatccgggtcgtggttcaacagatctgcttcgttttggtacagatctgcgttcgctcgaatcgagcatgacgttttcatgtgattatgcaggtcatcaccgaccgggagacggggaggtctcgcggcttcggcttcgttaccttctcctccgagaactccatgctcgacgctatcgagaacatgaacggcaaggagctcgacggccgtaacatcaccgttaccagggcccagtcccntgncnngtggcggttgcngncggtggctaccgccggcgggtcgcggcgggcggcgggttattggtggccgggccccttgaccggccggtattgggcggggggtgggcggctaacgggggttcgggccccgaggggtgggggggcgcggggcttccgggaagcggggggggggggttataacgggggttccgcccccaagggggtggggtggtggggggggctttaaggggggggggggggggggggggggg

SEQ ID NO: 79256 - protein, 56 aa, Zea mays
  misc_feature: Ceres CLONE 1564268
MAAADVEYRCFVGGLAWATSNESLENAFASYGEILDSKVCFVLARFHSAVCLCRWG

SEQ ID NO: 79257 - DNA, 921 bp, Zea mays
  misc_feature: Ceres CLONE 1564273
  misc_feature: Encodes the peptide sequence at SEQ ID NO. 79258
  misc_feature (784)..(784): n is a, c, t, g, unknown, or other
acccgcggtggcggccgctctagaactagtggatcccccgggctgcaggaattcgtctcacccctagaaaaaaattgcaattgcaaccaataaccatatacacacagctagctagcttcacatatcgcaagcacccagatcggcaggaccagcggcagcggcagcggtgccggcaagaagcaggccgcgcgctccactctccgaccccggccgaaacaaaggtgatggcgcagctgccgccgagggcgccggggggcgccgcgccgcaggaccactggtcggcggcgggggagttcctggggttcgccgcggccagacgcggcgcgcaccgccgctcggcgagcgactcggccgcgttcctcgaggccctgcccatggaagacgtcatcggcggcgacggcttcgaccgcctcgacgacgaccagctcatgtccatgttctccgacgtcgacgcgccggccgtctccgccggggacgcggcgcagctcatggacgtggcggacgccgacgcggacgcggacgacgacgggtcggccgcctcgtcgcgcgccgccgcggacggcgtcgccgctgaccccaaaaggtcaagaggttagtggcactctgctagctagtacattttttaactagtagtggtcgtcctttccattcgtctacggatctaccatggcggccaaacagtagtttttttttaaaaaaaaagaaaagaaaattgaagatgtaatttgtggagtgggactgcccgtccccgaaatcaaaatcaggatcggaggccttaatttgncatttttggcggtcacccctaaattaacaattggaaccaaaggcccaaacaaagtccaatccccggttccctgggtttaggatattgcaaaggggctcccccaaagcccaatccgggaaatctgactcccgaaacca

SEQ ID NO: 79258 - protein, 123 aa, Zea mays
  misc_feature: Ceres CLONE 1564273
MAQLPPRAPGGAAPQDHWSAAGEFLGFAAARRGAHRRSASDSAAFLEALPMEDVIGGDGFDRLDDDQLMSMFSDVDAPAVSAGDAAQLMDVADADADADDDGSAASSRAAADGVAADPKRSRG

SEQ ID NO: 79259 - DNA, 812 bp, Zea mays
  misc_feature: Ceres CLONE 1564274
  misc_feature: Translation starting site: 178
  misc_feature (358)..(358): n is a, c, t, g, unknown, or other
  misc_feature (374)..(374): n is a, c, t, g, unknown, or other
  misc_feature (375)..(375): n is a, c, t, g, unknown, or other
  misc_feature (432)..(432): n is a, c, t, g, unknown, or other
  misc_feature (495)..(495): n is a, c, t, g, unknown, or other
  misc_feature (496)..(496): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (678)..(678): n is a, c, t, g, unknown, or other
  misc_feature (684)..(684): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (742)..(742): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (773)..(773): n is a, c, t, g, unknown, or other
  misc_feature (774)..(774): n is a, c, t, g, unknown, or other
  misc_feature (782)..(782): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (804)..(804): n is a, c, t, g, unknown, or other
ctggagctccccgcggtggcggccgctctagaactagtggatcccccgggctgcaggaattcgtctcacccctagaaaaaatgccatgcccgccgcgatcgacgtaggaggagagggaggtgttagcaggcttattcgatcggctcgcgccattgcaccgcagcagcgttcggcggcatgtcgtcgtcgccggagacggaggccgccgggagcagcagcagcagcaggaagttcaagggcgtgcggaagcgcaagtggggcaagtgggtgtcggagatccggctgcccaacagccgcgaacgtatctggctgggctcctacgacgcccccgacaaggccgcgcgcgccttcgacgccngccttcgtctggcctnnccgcggccgcggcgccgccgggcgcggaacctcaaacttcccgggactcgccgccgnccgtgccgcgcgggggggggcccgccaccaaccaaaccccccgggaagaggtgcaaggggggnnccnnnttttttcccaagagaaaaaaaggggcgcccctttttagggggcccaaaaaagagggggcgccccccccccctaaaaaaaaagnnnnnnnnctcgggggggggggggggtgttttaaaaaaaaaaacacaacacccccccccccccaaaaaaaaannnnnnnnnnnnnnnnnnnnaanaaaaanaannnnnnnccnnnnnnnnnnnnnnnnnnnnnnnnncccnnncaccnnnnnnnnnnanaaaaaannnnnnnnnnnnnnnnnnnnnnncnncccccccncnnnnnnaaannnaaaattatnttctttct

SEQ ID NO: 79260 - DNA, 1129 bp, Zea mays
  misc_feature: Ceres CLONE 1564279
  misc_feature: Encodes the peptide sequence at SEQ ID NO. 79261
atttcacaccctcactctcactaatcgttcttgagacttgagagaagaggcgctgcatctggcatggctatcacagcacggaagttcctgcatggcggcgcagctggcaccatcgcgcaaggcgtcgccgacgtgggcggcatcagcttcggcctgtgggagatggtgaccggcttcttcgccgacatcctcgccggcctctttgcggttcttgctggcgcggcccagctgctcgtcctgccactgcaggtgctctggcagtcgctcgtcaccgtcgtcaccggcgccgctggcgccatcgcctccggcctcaacggcctgtggcagcacgtcacaggcatcttcgcccatatcgtcgcgggcatcgccggcgcggcccacctgttggtcctgccgctagagacgctctggcagtggctcgccaccagcatggccgatgccgtgggcgccatcatctccgccctcgacggcccgtggcaggtcgtcgcgggcttcctccccggagcctgggccgccctggtgaacgcagcacacgagatccctcgtaagctagcggagctctgccggtggatccaggccgctgcccccgtcttgctcccgtacgtgctgggcatagctgcggtcgtcctcgtcgcggcgctcgtctggtttttctgctgtcttgctacggtcctcctcgccgccagcgtcggggtcggccaggtactcgtgatcgccgccttccacctcgggcacgggctgttctacgtttgctctgccgttttctcggcgttcgcctccctcctgccgtcctgcatgcagtgcctgaactgcgccgctggggtcaccatgaacgccccgggcgcgtccggcatgctgatatcgcgcgctgccttcgaggcagcgccggcgctctttttcgcgctgatgcgagccgctccacccatcgtggccgccaccgtcttctgcacggaaacggtggcctcggtcatcgcttctccggtcgccgctctttttggcgtccggcgatgaactggtcaagcatgccacgagcagaagtgagtatgactgtatgagcatgatgtaaagctcctacgtttagttgactaatagaactcgaggagtcttctaccaaaaaaaaaaaaaaaaa

SEQ ID NO: 79261 - protein, 315 aa, Zea mays
  misc_feature: Ceres CLONE 1564279
MAITARKFLHGGAAGTIAQGVADVGGISFGLWEMVTGFFADILAGLFAVLAGAAQLLVLPLQVLWQSLVTVVTGAAGAIASGLNGLWQHVTGIFAHIVAGIAGAAHLLVLPLETLWQWLATSMADAVGAIISALDGPWQVVAGFLPGAWAALVNAAHEIPRKLAELCRWIQAAAPVLLPYVLGIAAVVLVAALVWFFCCLATVLLAASVGVGQVLVIAAFHLGHGLFYVCSAVFSAFASLLPSCMQCLNCAAGVTMNAPGASGMLISRAAFEAAPALFFALMRAAPPIVAATVFCTETVASVIASPVAALFGVRR

SEQ ID NO: 79262 - DNA, 808 bp, Zea mays
  misc_feature: Ceres CLONE 1564280
  misc_feature: Translation starting site: 190
  misc_feature: Pfam Name: UPF0114 Pfam Description: Uncharacterized protein family, UPF0114
  misc_feature (559)..(559): n is a, c, t, g, unknown, or other
  misc_feature (563)..(563): n is a, c, t, g, unknown, or other
  misc_feature (618)..(618): n is a, c, t, g, unknown, or other
  misc_feature (631)..(631): n is a, c, t, g, unknown, or other
ctccccgcggtggcggccgctctagaactagtggatcccccgggctgcaggaattcgtctcacccctagaaaaaactcgctccacttccattcccagcgaccccgcccgcccggaggcgtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggctacgggaaccgtgggcgggcccaacggccacgccatcgctcccgccacagacaccaagtccaccgccgtcgagaccaccgtcgagagggtgatcttcgacttccgggtcctgggcactctcgccgtcgccgggtcactcgccggctccgtcctgtgcttcctcaatggctgtgtcttcatcaaagaagcgtaccangttnactggtcgagctgtgtcaagggggttcatacgggggcaaatgggtcctcaggtcntcaaggcccatcnatgtgaaatcttgctggacaagtcatgctgaaatttggggaaggggtcttaaggggccttttaataagaaaagttctccgccgggggtttcctcccggaaatcaaaacggggcccctcaagggggtttctttttttttttgggggaattttccctttttaaaggaaaaccccccaaa

SEQ ID NO: 79263 - DNA, 943 bp, Zea mays
  misc_feature: Ceres CLONE 1564282
  misc_feature: Encodes the peptide sequence at SEQ ID NO. 79264
  misc_feature (723)..(723): n is a, c, t, g, unknown, or other
  misc_feature (823)..(823): n is a, c, t, g, unknown, or other
  misc_feature (833)..(833): n is a, c, t, g, unknown, or other
  misc_feature (857)..(857): n is a, c, t, g, unknown, or other
  misc_feature (887)..(887): n is a, c, t, g, unknown, or other
  misc_feature (919)..(919): n is a, c, t, g, unknown, or other
ccgcggtggcggccgctctagaactagtggatcccccgggctgcaggaattcgtctcacccctagaaaaaacctccgcagctagcatcgatccgccattgctcaccgcacaagtgcacgctcacctgtcacctcacacacgcagctaagtagctaacgccggaggcgagaacaagaaaaagctcgacatggccgaggagaagaagcagggcctgcagctgctggacttctgggtgagcccattcgggcagcgctgccgcatcgcgatggacgagaagggcctggcctacgagtacctggagcaggacttggggaacaagagcgagctgctcctccgcgccaacccggtgcataagaagatccccgtgctgctgcacgacggccgccccgtctgcgagtccctcgtcatcgtgcagtacctcgacgaggcgttcccggcggcggcgccggcgctgctccccgccgacccctacgcgcgcgcgcaggcccgcttctgggcggactacgtcgacaagaagctctacgactgcggcacccggctgtggaagctcaagggggacggccaggcgcaggcgcgcgccgagatggtcgagatcctccgcacgctggagggcgcgctcggcgacgggcccttcttcggcggcgacgccctcggcttcgtcgacgtcgcgctcgtgcccttcacgtcctggttcctcgcctacgaccgcttcggcggcgtcangcgtggagaaggagtgcccgatgctggccgcctgtgccaagcgctgcgccgagcgccccagcgtcgcctagatctctacccgcccgagtaagtctacgancttctctgcnggatgaagaagaggctgggcatcnagtagagcatcccatcgtcggccgtgggcntggccggtatgtatatgacgaaccattatctngtttttggtttgagtgtgcccaac

SEQ ID NO: 79264 - protein, 208 aa, Zea mays
  misc_feature: Ceres CLONE 1564282
  misc_feature (7)..(80): Pfam Name: GST_N Pfam Description: Glutathione S-transferase, N-terminal domain
  misc_feature (102)..(198): Pfam Name: GST_C Pfam Description: Glutathione S-transferase, C-terminal domain
  misc_feature: SWISSPROT Homolog: EC 4.4.1.5 Lactoylglutathione lyase
  misc_feature (179)..(179): Xaa is any aa, unknown, or other
MAEEKKQGLQLLDFWVSPFGQRCRIAMDEKGLAYEYLEQDLGNKSELLLRANPVHKKIPVLLHDGRPVCESLVIVQYLDEAFPAAAPALLPADPYARAQARFWADYVDKKLYDCGTRLWKLKGDGQAQARAEMVEILRTLEGALGDGPFFGGDALGFVDVALVPFTSWFLAYDRFGGVXRGEGVPDAGRLCQALRRAPQRRLDLYPPE

SEQ ID NO: 79265 - DNA, 857 bp, Zea mays
  misc_feature: Ceres CLONE 1564283
  misc_feature: Encodes the peptide sequence at SEQ ID NO. 79266
  misc_feature (820)..(820): n is a, c, t, g, unknown, or other
  misc_feature (822)..(822): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
ggagctccccgcggtggcggccgctctagaactagtggatcccccgggctgcaggaattcgtctcacccctagaaaaaaagcagcacagtcatccacactaacgaacgaactgaggtcgacgacgactgatcgagcagcgacgatggcggctgtgctgaacagcaggaagacgccgcaggtggttgccgtgctggtggcggcggcgctgctggcgtcgtccgcttcggcggcgatcacctgcgggcaggtggggtcgtcgctggctccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagtacgtgatccggcttaattgcttgctgtcatcatccatgcatatgcatctcgatctttcatttttctcaattcttttggggcacgcatgcaggatcagctaagttatacgacgaccaagctaataagcctaccgaacgtacacgtacgtcccgcgcgctgcacgagtgatgaagccagggaagaaataaaataaagctagctgtattgccaggagcagcatgcagtatcgatctataaatatcctgtactgtagtactctattatatatgtatgtgtggcctgcagtgcgagttgcttcgatccacctactttgtcngncnnnnnnnnnnnnnnnnnnnnnnnnnnnnnnnnna

SEQ ID NO: 79266 - protein, 153 aa, Zea mays
  misc_feature: Ceres CLONE 1564283
  misc_feature (33)..(118): Pfam Name: Tryp_alpha_amyl Pfam Description: Protease inhibitor/seed storage/LTP family
MAAVLNSRKTPQVVAVLVAAALLASSASAAITCGQVGSSLAPCIPYATGRASALPASCCSGVKSLNSAARTSADRQAACRCLKSLANSVKSVNMGTVATIPGKCGVSVGFPISMSTDCNKYVIRLNCLLSSSMHMHLDLSFFSILLGHACRIS

SEQ ID NO: 79267 - DNA, 983 bp, Zea mays
  misc_feature: Ceres CLONE 1564284
  misc_feature: Encodes the peptide sequence at SEQ ID NO. 79268
  misc_feature (440)..(440): n is a, c, t, g, unknown, or other
gcggtggcggccgctctagaactagtggatcccccgggctgcaggaattcgtctcacccctagaaaaactttgttgaggggtgatggcggtttctttcgcaaacctcagctccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcgtcagcagttccttcagccccaactccagatgttgctgaagcacaggccccagttgctgaggaggacgacgacgatgatgttgacctttttggtgaggagaccgaagatgagaangaagctgctgaagagcgtgctgcagctgccaaggcttctgggcagaagaaagaatcttgggagtcaccagttttacttgatgggaaaccctgggaagatgaaaactgacttggccacctccaagaaacttgttaggaatgtccaaaatggaaaggttgctccgggggccaatccaaccttggcccggtgggatttgggaccaaaaagccgccaattctgggaggcccttcgggaagaaactttttctttgtaaaactcccttttgaggaaatattgggccctggacccgtttaaaagtttcccaaaagttgcaaaatattttccctcaaaaaaaattgagggggattttttaaaacccccccccccggggggggggcaaaaggggggggggtgggaaaacccccccccattttcccccctctttttctccctttgtgggccccaatatacccgccgaattatttttaccccttttgggggagaggccccccccacaatattttttttttatccaaaccccccccggggtttgtctaaaaaaaa

SEQ ID NO: 79268 - protein, 154 aa, Zea mays
  misc_feature: Ceres CLONE 1564284
  misc_feature: SWISSPROT Homolog: EC 6.1.1.16 Cysteine--tRNA ligase
  misc_feature (119)..(119): Xaa is any aa, unknown, or other
MAVSFANLSSEAGLKKLDEYLLTRSYITGYQASKDDLAVYTSFSSAPSSKYINVARWFNHIDALVRLSGITAEGQGVKVESSAVPSAPTPDVAEAQAPVAEEDDDDDVDLFGEETEDEXEAAEERAAAAKASGQKKESWESPVLLDGKPWEDEN

SEQ ID NO: 79269 - DNA, 682 bp, Zea mays
  misc_feature: Ceres CLONE 1564285
  misc_feature (252)..(252): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
ctggagctccccgcggtggcggccgctctagaactagtggatcccccgggctgcaggaattcgtctcacccctagaaaaacccctcccctccccatctcgctcttgcggagatcgaagagaagctgaggcctagcgccgcacccgccgccgcatcagccatcagccatgacgctggccgctcgcctcgtctcgcgctcccgtcagctacattcggttcaaagctgctttttgccgaatggaggtgcactcangtcgctctttgcaggatgcagtcagctgacggcctccggttagggggggatannnaatattcccctggaagggggaaatttcttttttgggggaaaaaaaaaattttgaaccctcttggggcccttaaagggaaaaaatttttttttttcaaaaccccccgggggtttttcaaaattccccccccctaaaaaaacttttgggaaaaaggggggttttttttttttttttttttaggggggaaaaaataaaccttgggggggcccccccccgaggggggccccttttggggggggggtttttttttaaaaaccccccccccccccccccaaaaaaaaaaaggggggggtgtgttttaaaaaagtgggggggggaacacccccctttttttggtagagagggcacccccctccaaaaaaaaaaaaaaaaaaa

SEQ ID NO: 79270 - DNA, 950 bp, Zea mays
  misc_feature: Ceres CLONE 1564286
  misc_feature: Encodes the peptide sequence at SEQ ID NO. 79271
ctccccgcggtggcggccgctctagaactagtggatcccccgggctgcaggaattcgtctcacccctagaaaaatgaccgatcgttcgttccttccttctcttctccctcccaattcgcgggccgcgcgcctattttatttactactgtattcgtatcattatactgtttggtttccatccctggcagatctcccactctctcgtcagatcctctcggctagctagctagctaggacagaggagggaggggaaggcgctggctatggcgactgcggcggcggcggcggcggcggccatggaggagccggacgtcgtcaacggccgcgacgtggtgagctgggtggcgtccggggtggtgctgtggtcgaccgccttcttgctggtgcgggcgctgttccccaagcgctcctacgacttctgcaaccgcgccgtctccaccatgcacgccgtcgccgccgtgtgcctcgcctgcctctccgtcgacgactggtcgtgccccgtctgcccgctcgccgccgcatcctcccctcgccagatgaaggcgctggcggttacgctggcgtacatggtgtacgacgcggcgtgctgccacctcaacggcgacacgcggctggacaacgccgtgcaccacctggtcagcatcgtcggcatcggcgcggggctcgcctaccagaagtgcggggacggagatggtggccagcatgctcctgaacgagatgtccagcccgctgctgcacctgcggaagatgctcaaggaactgggcgtgcgggacccgagcttgaacctcctcgtcgacgtgctcttcgccgccacttcttcgcgccccgggatgggcgtcggggcttaactcacctaagttaccgtgacggccgaacaccccatcctcatcaagggtaatggcgacaggggctccacttggtgagaccttacctggttccggcgtattcc

SEQ ID NO: 79271 - protein, 211 aa, Zea mays
  misc_feature: Ceres CLONE 1564286
MATAAAAAAAAMEEPDVVNGRDVVSWVASGVVLWSTAFLLVRALFPKRSYDFCNRAVSTMHAVAAVCLACLSVDDWSCPVCPLAAASSPRQMKALAVTLAYMVYDAACCHLNGDTRLDNAVHHLVSIVGIGAGLAYQKCGDGDGGQHAPERDVQPAAAPAEDAQGTGRAGPELEPPRRRALRRHFFAPRDGRRGLTHLSYRDGRTPHPHQG

SEQ ID NO: 79272 - DNA, 841 bp, Zea mays
  misc_feature: Ceres CLONE 1564287
  misc_feature: Encodes the peptide sequence at SEQ ID NO. 79273
  misc_feature (721)..(721): n is a, c, t, g, unknown, or other
  misc_feature (779)..(779): n is a, c, t, g, unknown, or other
  misc_feature (780)..(780): n is a, c, t, g, unknown, or other
  misc_feature (785)..(785): n is a, c, t, g, unknown, or other
tggagctccccgcggtggcggccgctctagaactagtggatcccccgggctgcaggaattcgtctcacccctagaaaaaaactcgccgtctgccttctgcgcctccatttcggcctctgtcccttgcaagttcaatctcacctccaaccatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctgaaatgaacaagcggtccttcaagtacgcatgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactccgaaatactccaaggcacgttatgatgagattgtgaaggaagtctcatcctacctcaagaaaagtgggtacaaccctgataagaatgccctcgntcccccatttctgggttttgagggcgaacacattgattgagaggtccaaccaaccttnngattntacaaaggccccaaccctgccttgaggctccttgaccagatccacgagacccaaga

SEQ ID NO: 79273 - protein, 203 aa, Zea mays
  misc_feature: Ceres CLONE 1564287
  misc_feature (5)..(204): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (191)..(191): Xaa is any aa, unknown, or other
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKSGYNPDKNALXPPFLGFEGEHID

SEQ ID NO: 79274 - DNA, 916 bp, Zea mays
  misc_feature: Ceres CLONE 1564288
  misc_feature: Encodes the peptide sequence at SEQ ID NO. 79275
ctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccgggcgcagcttcgacccgctcggcctcgccgacgaccctgaagccttcgcggagctcaaggtgagggactcaagaacggccgcctcgcatggtcctcatgttcagggtcttcgtcaaggcatcgtcacgggaaaggcccgctgagaactcgcgaacacttggcgacccgttacaaaaagcatgggcttatgcaccaatttgtgccgcaaaggt

SEQ ID NO: 79275 - protein, 237 aa, Zea mays
  misc_feature: Ceres CLONE 1564288
  misc_feature (64)..(227): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEGYRVAGGPLGEVVDPLYPGRSFDPLGLADDPEAFAELKVRDSRTAASHGPHVQGLRQGIVTGKAR

SEQ ID NO: 79276 - DNA, 860 bp, Zea mays
  misc_feature: Ceres CLONE 1564293
  misc_feature: Encodes the peptide sequence at SEQ ID NO. 79277
  misc_feature (572)..(572): n is a, c, t, g, unknown, or other
ctggagctccccgcggtggcggccgctctagaactagtggatcccccgggctgcaggaattcgtctcacccctagaaaaaaggactttgctcggctgacaccaggtagccgcccctcctctatccaccccttcacttgcttggtcttccactcacccctctctcgttattcacccggtctcctctcctgcaaagaggaagatgagctcgctacacgccacacgagcggagcttggcctggttgtcctgtacctgaacaaagccgaggcccgggacaagatctgcagggcgatccagtacggctccaagttcgtaagcaacgggcagcctggcactgcgcaggaggtcgacagatcgaccaccttggctcgcaaagtcttccggctcctcaagtgggtcaatgatctgcatgctcttatcagcccgccggccaaagggactccgctcaccctcgttctgcttggcaaatccaaaaacgcgctgctttcgacgttcttgttcttggatcagtttgtgtggctcggacgaacggggatcgtcaagaacaggaggcgacggaccgcgttgccaggntatccctgtactgctggatggcttttctctgctgtgcaggtctagttgagcttggagagcttaaaggctatcgagatcgatgaagaagcttgcagagagctgagggacccgataaatttgagacgagcagtacccggacaaatgaggcagtcaaatgacgggtccgggcttggtcaggcggcattggacctggtcctggccctcggcttctttaactgggcccaaaaagtccctcccggaaggacgggaccctttgggtcgtacccccccttaaccccggtataaaga

SEQ ID NO: 79277 - protein, 138 aa, Zea mays
  misc_feature: Ceres CLONE 1564293
  misc_feature (11)..(139): Pfam Name: PEX11 Pfam Description: Peroxisomal biogenesis factor 11 (PEX11)
MSSLHATRAELGLVVLYLNKAEARDKICRAIQYGSKFVSNGQPGTAQEVDRSTTLARKVFRLLKWVNDLHALISPPAKGTPLTLVLLGKSKNALLSTFLFLDQFVWLGRTGIVKNRRRRTALPGYPCTAGWLFSAVQV

SEQ ID NO: 79278 - DNA, 956 bp, Zea mays
  misc_feature: Ceres CLONE 1564295
  misc_feature: Encodes the peptide sequence at SEQ ID NO. 79279
  misc_feature (375)..(375): n is a, c, t, g, unknown, or other
  misc_feature (378)..(378): n is a, c, t, g, unknown, or other
  misc_feature (379)..(379): n is a, c, t, g, unknown, or other
  misc_feature (413)..(413): n is a, c, t, g, unknown, or other
  misc_feature (456)..(456): n is a, c, t, g, unknown, or other
  misc_feature (458)..(458): n is a, c, t, g, unknown, or other
  misc_feature (473)..(473): n is a, c, t, g, unknown, or other
gcggtggcggccgctctagaactagtggatcccccgggctgcaggaattcgtctcacccctagaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccanggnnctgatcagtactggagcaacatcaggtgcccccnaggcacacgggcagagcagctggaagaacgccttgaagaaggncnggcgcctgctccggnctcagccagaaagactacttcaaactgccctcctcttccggtagccgatcaaaccactcgtttcgcctcaaagccaaaggttccaggcggaatttcgggctttagggccccaaggcaatcccaaaggttttaaaaaggggtttaacccgacccccggtattcctggccaaaagggcccccttaaaaaaaaaatggggttccagttttttttttggggcgggggggaaaaggaattttttttatggccccccgccccaaaaaaacccccgccacaaggaaaaccccttccccccctccgaaaaggggggcctaaaggggtccccccagaagacacccctttcttcgcgggggggggccgagaaaaaaaaaaacaccccccccccccttttttttttttttgggggggggggaaaaaaataaaaaatttttttccccccggggtctttttgttttttcccccaaaaaagggctttttattttccc

SEQ ID NO: 79279 - protein, 172 aa, Zea mays
  misc_feature: Ceres CLONE 1564295
  misc_feature: SWISSPROT Homolog: EC 3.1.27.1 Ribonuclease T(2)
  misc_feature (96)..(96): Xaa is any aa, unknown, or other
  misc_feature (98)..(98): Xaa is any aa, unknown, or other
  misc_feature (109)..(109): Xaa is any aa, unknown, or other
  misc_feature (124)..(124): Xaa is any aa, unknown, or other
  misc_feature (129)..(129): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIXGXDQYWSNIRCPXGTRAEQLEERLEEGXAPAPXSARKTTSNCPPLPVADQTTRFASKPKVPGGISGFRAPRQSQRF

SEQ ID NO: 79280 - DNA, 1073 bp, Zea mays
  misc_feature: Ceres CLONE 1564296
  misc_feature: Encodes the peptide sequence at SEQ ID NO. 79281
ctccccgcggtggcggccgctctagaactagtggatcccccgggctgcaggaattcgtctcacccctagaaaaaatcagattgggagactcacttcactcactcgggagtcgggtcctcctcgactcagctcctccacaaacaaagccaccaccatcccaacccaaacacatcggccgaccacgggcgccgccatgtccaccgctgacgcggcgagcccggccctggcgccggactgggacgcgccggcgggcgaaggcctggccctggcccagttcgccgcgggctgcttctggagcgtggagctggtgtaccagcgcctcccaggcgtggcgcgcacggaggtggggtactcgcaagggccacgccacgcccccacctaccgggacgtctgcggcaacggcacggggcacgcccgagtggtcccgcgtgcactacgaccccaaagccctgcccctacgaggtcctccctcaacgttcttcggggccaaagcaaaaaccccacccacgctcaaaaaaaaagggaaaaccaccctcgggaacccatataccggggcggggcatttttcttaatacacggggaataacaaggaagaaccctggggcccccaaattccctggggttgcaaaaaaaaaagggagggggggggggaccccaattcctccccacaaggtgcctgtcccgggcgcaaaagggttttctccccgcgcgcgagaggagttccccccccccggtttcctccttaaaagagggggggggcaacccccaccaaaaaagggggggggagaaaatccccccccccgggtgtagggggggggaaaaacaaaacccacccctttgttgggagaaaccaaaaaaaaccccgcgaaaaaaaacagggggccaccacacaaatgggttatacaccccccccccccccccccttataatatgggtgcgcccccctctcttttttttttctcccccgcctcctctaataaaacaagcggggaggaaatttttcctttaagcgggaaaaattttcttgtgtgggggggtcacacaccgcgggggaaaacaaaacaaaaaaaaaa

SEQ ID NO: 79281 - protein, 130 aa, Zea mays
  misc_feature: Ceres CLONE 1564296
  misc_feature (24)..(123): Pfam Name: PMSR Pfam Description: Peptide methionine sulfoxide reductase
  misc_feature: SWISSPROT Homolog: EC 1.8.4.11 Peptide-methionine-(S)-S-oxide reductase
MSTADAASPALAPDWDAPAGEGLALAQFAAGCFWSVELVYQRLPGVARTEVGYSQGPRHAPTYRDVCGNGTGHARVVPRALRPQSPAPTRSSLNVLRGQSKNPTHAQKKRENHPREPIYRGGAFFLIHGE

SEQ ID NO: 79282 - DNA, 623 bp, Zea mays
  misc_feature: Ceres CLONE 1564297
  misc_feature: Encodes the peptide sequence at SEQ ID NO. 79283
  misc_feature (223)..(223): n is a, c, t, g, unknown, or other
ggagctccccgcggtggcggccgctctagaactagtggatcccccgggctgcaggaattcgtctcacccctagaaaaaaccagcaagacctaacaaacccacttctgactgaccactgtgccgcgccgtggtcaccggacggacacacagaacgacgatggccgcgtcggcgctgcaccagaccaccagcttcctcgggcaggccctggtctcccgcgccggnccggggcgtcgaatgccggcggccgcatcaccatgcgccgcaccgtcaagagcgtttcccccagagcatatgggtacggcccctgaatcgccccaaagtatctttgggcccctttcctccgaaacaaaaacccccgtccttaccttgaaaccggcgaagtttccccccgggggaaaataaccggggggggggaaaaaccccgcggggggccttctttgggggcccaaaccccgggagaaaatttttccggcggcaaaaaaccggggaaacccttgggggaggggggatacccccccctcccccccggggggggggggaaaaattttttgggggggccccccccctgggggggccccccccccttttttttctccccccccggggaaaaaaactctttctg

SEQ ID NO: 79283 - protein, 81 aa, Zea mays
  misc_feature: Ceres CLONE 1564297
MAASALHQTTSFLGQALVSRAGPGRRMPAAASPCAAPSRAFPPEHMGTAPESPQSIFGPLSSETKTPVLTLKPAKFPPGGK

SEQ ID NO: 79284 - DNA, 909 bp, Zea mays
  misc_feature: Ceres CLONE 1564298
  misc_feature (857)..(857): n is a, c, t, g, unknown, or other
  misc_feature (895)..(895): n is a, c, t, g, unknown, or other
  misc_feature (896)..(896): n is a, c, t, g, unknown, or other
gctggagctccccgcggtggcggccgctctagaactagtggatcccccgggctgcaggaattcgtctcacccctagaaaaatgcctccacgacgattcggcacaaacggagcaactgcacgctcagcctcatcctgcgacctccctctccacgaaaatggttgcaggtggttgctccgcctggccccacctgctcctcaccacactgtcgacgtcttccttcccatgccactgcctttttccttcccatgctgtcgtcgtcgctgcacacctgttaggcgtgttccgcctctcctctctatagctgggcagctgagcttctctccccttggcttcacatccgctagcgagccgtgcctccaccgtcgcctgctcggaccggtgggacccagctcccccacgtggtctcgtcccatccattagcccggatctcacgtcccgctccctctgaggacccaatcgtcttcctccttcgccgtcgccgggaactcgtctccatgcttcactttctcaaggtgagcctagggtttcttctctgccgcggaatgcatggatgacccggcgtggatggcgccccccaatctccatgccccagcgcgcgctccggcaaacgggaggcgaggccatccgcgcgcgatggcgctggacctcgtgcggcgacctcgtggtgacgccgaagacggcggccaaagacaaggcgtcctgctccgtgcccatgccgccccaagtcaccccccgacgagggtgtgcgcagtgggcacgcaagttcatggaccagcctatccaggagacggaagcccgacgtctgggcccgttctcaccgccatctcccaggaagcccggcttcggcccctaggnttctccccttggtcctgccggccccttaagccctaccnntaaaactgaatat

SEQ ID NO: 79285 - DNA, 912 bp, Zea mays
  misc_feature: Ceres CLONE 1564299
  misc_feature: Encodes the peptide sequence at SEQ ID NO. 79286
  misc_feature (875)..(875): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (884)..(884): n is a, c, t, g, unknown, or other
ccccgcggtggcggccgctctagaactagtggatcccccgggctgcaggaattcgtctcacccctagaaaaaccctccgatcgtcgtcgacgacgcatccaccccaacccttctccgcgaaatagccgtcgccgcagctccggctatgtcaatcttcgagtacaacgggtccgccgtggtggcgatggtggggaagaactgcttcgcgattgccagcgaccggcggctcggcgtgcagcttcagaccatcgcaacagacttccagcgggtgttcaagatccacgacaagctctacatcggcctctcagggctcgccaccgacgcccagacgctgtaccagcggttggtcttcaggcacaagctgtatcagctgcgcgaggagagggacatgaagcccgagacatttgccagccttgtctctgcgctcctctacgagaagagattcgggccatatttctgccagccagtcattgctggacttggagatgacaacgtaccattcatttgtaccatggactgcctcggtgcaaaggagctggccaaggattttgttgtttctggaacagcatcagaatctttgtatggtgcttgtgaatccatgtacaagccggacatgcaacctgatgaactcttcgagactatatccaaagctctgaattcatcagtagatcgtgactgccttagcggatggggtggctatgtgctgattgtgaccccgactgaggtgagggagcatgtgataaagagcaggatggactaaatatggccactagaattattagctggttcccatgcttagaacaatgttgtgttggtatccgggagtacattgtatcatcacgttggtatgagaaagaaactttgatttcaaaaantnnnntttngcataacgagaaaacttttttataaaaa

SEQ ID NO: 79286 - protein, 204 aa, Zea mays
  misc_feature: Ceres CLONE 1564299
  misc_feature (5)..(189): Pfam Name: Proteasome Pfam Description: Proteasome A-type and B-type
  misc_feature: SWISSPROT Homolog: EC 3.4.25.1 Proteasome endopeptidase complex
MSIFEYNGSAVVAMVGKNCFAIASDRRLGVQLQTIATDFQRVFKIHDKLYIGLSGLATDAQTLYQRLVFRHKLYQLREERDMKPETFASLVSALLYEKRFGPYFCQPVIAGLGDDNVPFICTMDCLGAKELAKDFVVSGTASESLYGACESMYKPDMQPDELFETISKALNSSVDRDCLSGWGGYVLIVTPTEVREHVIKSRMD

SEQ ID NO: 79287 - DNA, 929 bp, Zea mays
  misc_feature: Ceres CLONE 1564300
  misc_feature: Encodes the peptide sequence at SEQ ID NO. 79288
  misc_feature (407)..(407): n is a, c, t, g, unknown, or other
  misc_feature (849)..(849): n is a, c, t, g, unknown, or other
  misc_feature (850)..(850): n is a, c, t, g, unknown, or other
tggagctccccgcggtggcggccgctctagaactagtggatcccccgggctgcaggaattcgtctcacccctagaaaaaacccccacgtctcaactttatagccgccccctccccaccgccgcggccgccacgcgcagcagcaacccggtagcaggagcgcagccagcaagctcagccccccagccctactgccaccgcgccgaacgccatggccgagccggcagagcaccgtccagcggaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctaccggtttcgacaggaggggaactagtgnaaagagcgcggcacaggcactgtgaagctgctcaagcacaaagacaccgccaagggtccgcctcgtcatgcgtcaggcgaagaacgcttaggatctgcgccaaccatctcgtgggtggcgacgactaaaatgcaggacccccccggggagcgaacaagtcggggcttgtggcaccccctggaattttccccaagggggagctaaaagaggaaattgtgggctacccgtttttggaatcgccaaaaattttcaaaaaattcagggaccctttttaaaaaaatccttaaaaccccgggaaaagcggggggaaaaaaaaaaataggaacccccccccccgcccccttttaatttgcccaaaaatttaaaggggggggacccccccggggggaaaaaactaacaaaaggggccgtcccctcccctccattaaaaggggtgttaaanngggggggtgttgggaaaaaaagcgggggaaaagggcccctcctttttttttttttttttggaggagggctcccccccac

SEQ ID NO: 79288 - protein, 64 aa, Zea mays
  misc_feature: Ceres CLONE 1564300
MAEPAEHRPAEEEEAAAAGEDEDTGAQVAPIVKLEEVAVTTGEEDEDALLDMKAKLYRFRQEGN

SEQ ID NO: 79289 - DNA, 936 bp, Zea mays
  misc_feature: Ceres CLONE 1564303
  misc_feature: Encodes the peptide sequence at SEQ ID NO. 79290
  misc_feature (648)..(648): n is a, c, t, g, unknown, or other
  misc_feature (649)..(649): n is a, c, t, g, unknown, or other
  misc_feature (783)..(783): n is a, c, t, g, unknown, or other
ctccccgcggtggcggccgctctagaactagtggatcccccgggctgcaggaattcgtctcacccctagaaaaaggccagccccatatcatgggggacgctccctcgccattctccatccgaacaaccttcaaagatctaataaaacccatagaaacttctctcgtttctctctccttggccccgggtagcgaacccttatcagtcgctctcgttggctcggagcagcgatgcgcaccgcctgcctccgccccaaccccgccattggtataaaagcctcccctccgcctccctccttccgccactgctaggtccagccacacccgcgctcgccccggccaccgccgccgcgctctcacggtcccacctctccgtggcatgagaagatggccgcgtgctccaggggactcgcgtggccgccgttcgatctgatcacggcgaggggggcggcgtcctggccgcgccggcgtgccgcgatccggtgctgctgcgccggagcagacgcacagccgcagaggcgactctcgagggcggccgcggtcgcgcccgagcgcgccgagtagtggcgcatcgacgggaataagccgtccgccgcggcaccgggacggcggcgctacagcctcaccgccatgcccccgctccctttccnntgcactcgctctagaagacagtcaagcaaccggactttctaccgcggtgcactccgagggggtcggctcctcaatcccgtgataccccgccaagaaagaactggtattgctagtgagaaagaaggggaatcaanctgctggacgaagccgtcaagagtctggaataatgaagatgaagcactggtacagggagattggagagatttgggcaaaacgggtacgctgccccttggcataatggtaggacagaccatgatggtccccgaatggaaagaaactgtgggaga

SEQ ID NO: 79290 - protein, 58 aa, Zea mays
  misc_feature: Ceres CLONE 1564303
MAACSRGLAWPPFDLITARGAASWPRRRAAIRCCCAGADAQPQRRLSRAAAVAPERAE

SEQ ID NO: 79291 - DNA, 1222 bp, Zea mays
  misc_feature: Ceres CLONE 1564305
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (1222)..(1222): n is a, c, t, g, unknown, or other
tgtgatatttgtcgctgtcaccacacacggtctcctgcatgcccacaaaannntttttcttttttttttataactggagctccccgcggtggcggccgctctagaatagtggatcccccgggctgcaggaattcgtctcacccctagaaaaagtgttcggcagaaagaagttgcaacaactcgcccgtccaactggagcgcttcttgttttgtggattacaaatagggagaaactgcgggcatttgttgagaaaaaactgcttccttcttggggagtggaagattccaccgtgttttattggcttaaggtgaaacctgatggctctctaattggtgatttagacttgttccatcacaggccctatgagtgcttcctccttggctacataaatggtaatgcaaatgctaagcaagggtcaaatttcaagttgttagaaagaagccaagtaatcatgagtgtccccggtgctcactcaaggaaacctccccttgagcaattactttcagaatatattccaggtcctaaaaccttcaagatgcatcgagcttttttgccaaagagtttgtttcccaagatggaccttcttgtgggaaatggagccgccttcattttccaggagaaccattgtactttctcgggaggaaaattggttcgtttaggccatagagccagggatattaaggtatggtgggatttcttgattggcaaccttgcccaccctaaaagggcaaactggggttttttggcaaaatatgacaatttggttaaccccttggatggttttcttttcagggccctttttttcctctccccagggcgggaaattgtataaaaaattggccccccctatttcttctccaagttaacataatattttttggccccattcctggccctaaatttgtcctcgaaataggcccctaccccctcttcttgttgtgtgtggtcccctcctcccgtctttctcccaaagcaaaccttgttaatgtgggtgaaactaaaagttccctccagttttttggaggccaataaaagcctgagaggggttttaggaccaaaaaccccaaattttttattggggggtcaacccggtgaggtgtggaaaacaaccctcaatgattaattgtgttgggaaccaatacatattttcctctcgactattgacctgttcctaggcgtccctcttggagaaaatccattttcaattttgcaccgcccctn

SEQ ID NO: 79292 - DNA, 878 bp, Zea mays
  misc_feature: Ceres CLONE 1564306
  misc_feature: Encodes the peptide sequence at SEQ ID NO. 79293
ctggagctccccgcggtggcggccgctctagaactagtggatcccccgggctgcaggaattcgtctcacccctagaaaaatttttttcttgtgtactgtaatcgtccgactatgttttgtgagattttcatacaaaggttgaatgtgatatcacatattttatggtctaaaaacaaaacaagcaacgaccacgctcgatgctaccccattcgccctctcatgagacagactgcgcgagatcaatgaggagctgctgcgccacctcgccaaagacaccaactggccgcgggccgactgccgctccttccacgactgccggccagcgtttatgcagacaggaccaactactgctgcatcagggtctgcttatgcagaatttgggaagacaaaggtcattgtatcgctttttggaccaagggaaagtaagaaagcaatgatgtacagtgacgttggtaggctcaattgcaatgtgagctatacaacctttgccactccagtgcgtggacagggagcagacaacaaagagtattcatcgatgcttcataaagctctggaaggcgcagtaatgctgcacactttcccaaagaccactgttgatgtttttgccttggttcttgagtctggtggcagtgatcttcccatcattatatcatgcgctagtcttgcattggcagatgctggaatcatgatgtatgaccttgttacgtctgtatccgtgtcctgtttcagaaagacatcatcatcgaatcaacctcagacgaagaagcatggcaagacgggaagccttgttggtggcttttcatgcccaccccgcaaaggagatcacgcagcttcaccctcactgggagaagtggaacgaatgggcagcattacacaaa

SEQ ID NO: 79293 - protein, 183 aa, Zea mays
  misc_feature: Ceres CLONE 1564306
  misc_feature (1)..(120): Pfam Name: RNase_PH Pfam Description: 3' exoribonuclease family, domain 1
MQTGPTTAASGSAYAEFGKTKVIVSLFGPRESKKAMMYSDVGRLNCNVSYTTFATPVRGQGADNKEYSSMLHKALEGAVMLHTFPKTTVDVFALVLESGGSDLPIIISCASLALADAGIMMYDLVTSVSVSCFRKTSSSNQPQTKKHGKTGSLVGGFSCPPRKGDHAASPSLGEVERMGSITQ

SEQ ID NO: 79294 - DNA, 925 bp, Zea mays
  misc_feature: Ceres CLONE 1564309
  misc_feature: Encodes the peptide sequence at SEQ ID NO. 79295
  misc_feature (810)..(810): n is a, c, t, g, unknown, or other
  misc_feature (818)..(818): n is a, c, t, g, unknown, or other
  misc_feature (819)..(819): n is a, c, t, g, unknown, or other
  misc_feature (831)..(831): n is a, c, t, g, unknown, or other
  misc_feature (925)..(925): n is a, c, t, g, unknown, or other
ctccccgcggtggcggccgctctagaactagtggatcccccgggctgcaggaattcgtctcacccctagaaaaaacgccgctgctccaagaaaccaccgccgagcccaaccgcacaagcgcgcgaggcaggagagagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacattatcatgcaatgcctgggtgccatctgtggagctggagtggtgaagggcttcccagcagggactttacatgggcaacggtggtggcgccaatgttgtcgcacctggctacacccaagggtgatggccttggcgctgagattgtggcaccttcatcctagtctacaccgtcttctcggccacgatgccaagagaaatgcagggactcccatgttcctatcctgccccactgcnattggggnntcgcgtgttccntggtccacttgccaccatcccattactggcactgcatcacccagctaggagcctggcgctgcatcatctaaaaaggatcagcctgggacaacan

SEQ ID NO: 79295 - protein, 238 aa, Zea mays
  misc_feature: Ceres CLONE 1564309
  misc_feature (47)..(228): Pfam Name: MIP Pfam Description: Major intrinsic protein
  misc_feature (219)..(219): Xaa is any aa, unknown, or other
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFPAGTLHGQRWWRQCCRTWLHPRVMALALRLWHLHPSLHRLLGHDAKRNAGTPMFLSCPTAIGXSRVPWSTCHHPITGTASPS

SEQ ID NO: 79296 - DNA, 881 bp, Zea mays
  misc_feature: Ceres CLONE 1564313
  misc_feature: Encodes the peptide sequence at SEQ ID NO. 79297
  misc_feature (386)..(386): n is a, c, t, g, unknown, or other
ggagctccccgcggtggcggccgctctagaactagtggatcccccgggctgcaggaattcgtctcacccctagaaaaaatcgcgcacatctcctgatcctcgttcctctccgccccgcttgcgccgcgcctccgcccccgtctcctgtgagatcagctccggcggcacgcggatatgactacttcaaggcgtcttgctgacaggaagagtgcaaagttccagaagaacatcacaaagaggggttctgtgcctgagaccacggtgaaaaagagcaatgactaccctgttggacctatagttcttggattcttcatttttgtggtcattggatcatccttgatccagataatcacgacagcgactagcggtgggctggtctgaattcnctgagctaacactagaaattatctgttcgtgagctgggcagcagtatctgtgttgtgtagcaaactcgttcatggatatgtagcgcgaacgtcactactggtccggttggcattatcaaaagagttaaactgatgttgaaacctgcaaagcctgaaattttaagagtatgggaaaaaccttaatttaaaaaaaaaaaaaaaaaaaaacttttttttcctttccgcccggtcaaccaaattaaccccccccccgggaaaggttttcccccctggggaaacccaaaatggtgtcggcccctcccgggttttgggggcccgggggggcccccctcccatttggggggggcgcgtttttttttcttttgggcaaaccctttttataaaaaatttttgtccccccaaaaaaaaatatttttaaaaaacggccccccccgagaaaaagggggccccctcccccccccccgcgggaaaaaaaccccctcctttgtgggaagg

SEQ ID NO: 79297 - protein, 68 aa, Zea mays
  misc_feature: Ceres CLONE 1564313
  misc_feature (1)..(64): Pfam Name: RAMP4 Pfam Description: Ribosome associated membrane protein RAMP4
MTTSRRLADRKSAKFQKNITKRGSVPETTVKKSNDYPVGPIVLGFFIFVVIGSSLIQIITTATSGGLV

SEQ ID NO: 79298 - DNA, 833 bp, Zea mays
  misc_feature: Ceres CLONE 1564314
  misc_feature: Translation starting site: 262
  misc_feature (459)..(459): n is a, c, t, g, unknown, or other
  misc_feature (480)..(480): n is a, c, t, g, unknown, or other
  misc_feature (481)..(481): n is a, c, t, g, unknown, or other
  misc_feature (487)..(487): n is a, c, t, g, unknown, or other
  misc_feature (488)..(488): n is a, c, t, g, unknown, or other
  misc_feature (495)..(495): n is a, c, t, g, unknown, or other
  misc_feature (497)..(497): n is a, c, t, g, unknown, or other
  misc_feature (498)..(498): n is a, c, t, g, unknown, or other
ctccccgcggtggcggccgctctagaactagtggatcccccgggctgcaggaattcgtctcacccctagaaaaaagacccccgcccacgaccacacgcaggcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccgtccggccggctccatacccgcggctaccgctgccgtcgtcgtcatcctcgtcaggctacaggcactccaagtccgtctccgtgaagacgctcgccctgttcggcaaatccaaggtcaagaccgcgccngcgaaagaagctgctgcgccnnagcccnnagcgaangnntgagatgggtatctcggcacgtccgggcgggatcggttttcaccaagagaacgagctgttcgtcggccgcgtttgcatgcttgggcttttgcgcatcgctacttggagagggcatttaccggggaaaggccatccttgccccagcttaaccctcaagacgggcattccccatctacaaagggggagcccctccctcccgggttcttaaaccccctttacccccccctgggggcccctttgggggcctttggggggaaaccgggggcccttttttttttaaaaaaggaggtcccccgggcctttaaaaaagggggcgttattcaaaacctggggga

SEQ ID NO: 79299 - DNA, 914 bp, Zea mays
  misc_feature: Ceres CLONE 1564318
  misc_feature: Encodes the peptide sequence at SEQ ID NO. 79300
tggagctccccgcggtggcggccgctctagaactagtggatcccccgggctgcaggaattcgtctcacccctagaaaaaactcgccgcctcctccccactgcctcgtgtggccgtcgtctcccgttcggaacgccaagcccccctccggcgaaatggcccccaagcgaggtggcagggcgcctgtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaggagaggcttctgaagagggcccaagctgagaatgaaggaaaaactgttgagtcgaagaaaccaattgttgtgaagtatggccttaaccatgtgacttacctcattgagcagaacaaggctcagcttgttgtcatcgctcatgacgtggatccgattgaactggttgtgtggcttccagccctgtgcaggaagatggaggtcccttactgcattgttaaaggaaggctcgccttggatcgatgttcacaagaagatgcatcagtcttgtgtctcacactgtcaagaacgaggataagctgagttcagcaagatcttggtagctattaggcaaacttcacgacaagtccatgaggtcaggaaaaatgggggagtggcatcatgggtatccagtcgcaggcaagacaaggcccgggaaagctgctcacaaagaggctgcgcaacggatgacc

SEQ ID NO: 79300 - protein, 203 aa, Zea mays
  misc_feature: Ceres CLONE 1564318
  misc_feature (113)..(204): Pfam Name: Ribosomal_L7Ae Pfam Description: Ribosomal protein L7Ae/L30e/S12e/Gadd45 family
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVESKKPIVVKYGLNHVTYLIEQNKAQLVVIAHDVDPIELVVWLPALCRKMEVPYCIVKGRLALDRCSQEDASVLCLTLSRTRIS

SEQ ID NO: 79301 - DNA, 811 bp, Zea mays
  misc_feature: Ceres CLONE 1564319
  misc_feature: Encodes the peptide sequence at SEQ ID NO. 79302
  misc_feature (525)..(525): n is a, c, t, g, unknown, or other
  misc_feature (593)..(593): n is a, c, t, g, unknown, or other
ctacccgcggtggcggccgctctagaactagtggatcccccgggctgcaggaattcgtctcacccctagaaaaagcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgcccggcggcggcncgtggctgggcgggcagctgttctcgggccatggtggtgcgcaagccgggcgcacctgttccctgacnaagctgggcgtggcgtacaacgaggcccaaggactacgtgggtcatcaagcaacgccgcggtttttcaagtccaagggtcagaaacttgcttcctgggcggcccaaacgtcaaggctgttcaaacccccggggcctggaaggacctcaccttcaggggaagggggcgtttgggggggtttttcacaaaatggggggcccctgggtcaataaaccccaa

SEQ ID NO: 79302 - protein, 223 aa, Zea mays
  misc_feature: Ceres CLONE 1564319
  misc_feature (64)..(212): Pfam Name: Thi4 Pfam Description: Thi4 family
  misc_feature (129)..(129): Xaa is any aa, unknown, or other
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGXWLGGQLFSGHGGAQAGRTCSLTKLGVAYNEAQGLRGSSSNAAVFQVQGSETCFLGGPNVKAVQTPGAWKDLTFRGRGRLGGFFTKWGAPGSINP

SEQ ID NO: 79303 - DNA, 929 bp, Zea mays
  misc_feature: Ceres CLONE 1564322
  misc_feature: Translation starting site: 159
ctccccgcggtggcggccgctctagaactagtggatcccccgggctgcaggaattcgtctcacccctagaaaaactcctctcttgcgccgccgctggcccagcgcggccgccgtgctccttctccactcgtgcttcccaagctgcttcgccggaagcaatgcgagggccctgccccggtggaggcgtctcggcgtcttttgccccgagcttcaacggctcccgcgccatgatctggccggcaacagtaaattgcacgagacggatccgcatttcattcatccaaacagccaaaacggggccgttccgcgcaggcgacagggctacgggaggaatttgctatgctagccaggcggttgaattgctgcccactttgtaccctgaaatcgtggtccgagacgcacggctcgaggactgctgggaagtggctgacactcactgcagctcgttctttcctggttacaagttcccgttggaccttgttctccggattgatcgttacattgctctcctctctggattttcagttccacccggctgcatgaggacttgccttgtggccgtcaattctaattctgtaaatagtagtttcaacatcgagtgtggagatgctacagatgccaactttgagaaaacaatctcagtagaagctccgtagctggcattcttacacttgatacagtggcagactatcttccgagaaggggacccctgaagcagagaaggacaggtattgcgtatatagcaaacgtcgcggtgcggaaggagagcgacggaaagggatcgcgaagatgttggtcccagaacagaagctcgggcaagagctggggatgccggtcgatggcactgcactgcgacgtaacaacgtggccgcgctacgcctgttcagaaacaaagcttcaagtgcatacgattgccggaaggagctaaa

SEQ ID NO: 79304 - DNA, 973 bp, Zea mays
  misc_feature: Ceres CLONE 1564324
  misc_feature: Encodes the peptide sequence at SEQ ID NO. 79305
ctccccgcggtggcggccgctctagaactagtggatcccccgggctgcaggaattcgtctcacccctagaaaaattttttctagatccgtccctgtttgccgctgtgtttagctctcttccccgcaaggatccatcgatcggtcggacaggataagacatgggtcagattttgggtttagttcaggttgatcagtcaactgtagccatcaaagaaaattttggcaagttcaacgaggtcctggagcctggttgccacttcctgccctggtgcatagggcaacagattgctggttacctctccttgcgtgtgcgccagctggatgtccgctgcgaaacaaacacaaaagacaatgtctttggcactgttgttgcatctgttcaatatcgcgctcttgctcacaaggcatctgacgccttctacaagctgagcaacaccacagaacaaatccagtcatacgtatttgatgtcatcagagctactgttccaaagctgggcttggaccatgcctttgagcaaaagaatgagatcgcaaaaactgtggacaaggagccttaaaaggcgatgtctaccttatggctatcagatacgggcaaacactaattgttgatatctgacccggaggaccgcgtctagatcaccattgaaccaaatcatttgtgctgcttcgatgaagggtggccgccaatgataaagcttaagcctaaaaaaaaactcctaaccagaaaccccagggaaagggggaaacccagttcctggcttggcggggggtttgccaaggagcgcccccccctttgttaaaggcctaaaaggaacatttttttccttttcttataaaggttacaatccccctggcaaaaaaatacattgatattagtcctggcccccccccgctttttaaaacatgtggagattttggggcccccccgaaacctccttaggattatttcccccctccccgatatttctcaaga

SEQ ID NO: 79305 - protein, 132 aa, Zea mays
  misc_feature: Ceres CLONE 1564324
  misc_feature (8)..(130): Pfam Name: Band_7 Pfam Description: SPFH domain / Band 7 family
MGQILGLVQVDQSTVAIKENFGKFNEVLEPGCHFLPWCIGQQIAGYLSLRVRQLDVRCETNTKDNVFGTVVASVQYRALAHKASDAFYKLSNTTEQIQSYVFDVIRATVPKLGLDHAFEQKNEIAKTVDKEP

SEQ ID NO: 79306 - DNA, 856 bp, Zea mays
  misc_feature: Ceres CLONE 1564325
  misc_feature: Encodes the peptide sequence at SEQ ID NO. 79307
  misc_feature (562)..(562): n is a, c, t, g, unknown, or other
  misc_feature (577)..(577): n is a, c, t, g, unknown, or other
  misc_feature (610)..(610): n is a, c, t, g, unknown, or other
  misc_feature (614)..(614): n is a, c, t, g, unknown, or other
  misc_feature (692)..(692): n is a, c, t, g, unknown, or other
  misc_feature (782)..(782): n is a, c, t, g, unknown, or other
  misc_feature (829)..(829): n is a, c, t, g, unknown, or other
ctggagctccccgcggtggcggccgctctagaactagtggatcccccgggctgcaggaattcgtctcacccctagaaaaactccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggaagcgcatcccgtggttcgaggccggcgcggacccgagcgccatcgcgcccttctccttcgggtcgctgctgggcacgcactctgctgatgggggngtgggtgagtcaaancccggtggggtgactttcttcacccgaactcangggncgtggagtggggccacgccgtggtcgcgcacccctgagaacttcccaactttcaccggcgaagcaggctaccccgggncgcaagttctcgaccggttcggcctcgccggaaccgttaagggaaggggtttaaaatcccccgacttaaaaaatttcaaagcgggtcagnactgggcgaaaaatagccccccgcatcgccctgtcttggcagctccnacttctttactttaagggcggggagcg

SEQ ID NO: 79307 - protein, 233 aa, Zea mays
  misc_feature: Ceres CLONE 1564325
  misc_feature (54)..(214): Pfam Name: Chloroa_b-bind Pfam Description: Chlorophyll A-B binding protein
  misc_feature (145)..(145): Xaa is any aa, unknown, or other
  misc_feature (156)..(156): Xaa is any aa, unknown, or other
  misc_feature (158)..(158): Xaa is any aa, unknown, or other
  misc_feature (184)..(184): Xaa is any aa, unknown, or other
  misc_feature (214)..(214): Xaa is any aa, unknown, or other
MALAPTSAAVLKTPFLGARRALAKPAPRRALVIAAAAAAKKSWIPAIKSDAEIVNPPWLDGSLPGDFGFDPLGLGKDPAFLKWYREAELIHGRWAMAAVLGIFVGQAWKRIPWFEAGADPSAIAPFSFGSLLGTHSADGGVGESXPGGVTFFTRTXGXWSGATPWSRTPENFPTFTGEAGYPGXQVLDRFGLAGTVKGRGLKSPDLKNFKAGQXWAKNSPPHRPVLAAPTSLL

SEQ ID NO: 79308 - DNA, 911 bp, Zea mays
  misc_feature: Ceres CLONE 1564327
  misc_feature: Encodes the peptide sequence at SEQ ID NO. 79309
  misc_feature (379)..(379): n is a, c, t, g, unknown, or other
ccccgcggtggcggccgctctagaactagtggatcccccgggctgcaggaattcgtctcacccctagaaaaactcggttcctcccctttcgccctacttgcttcccacgccagggcccgagctccgagctagggtttcctctctcgccgccgccgccgccgccgccgccgacggagaagaggagtaggtgaagccgagttattagcgccaggggaggaacatggggacgccggagacgtcgcgggagccatgcccggaccggatcctggacgacgtcggcggcgcgttcgggatgggcgccgtcggcggctcggccttccacttcatcaagggcatctacaactcccccaacgggatgcgcatgtccgggggcgcgcangccgtgcgcatgaacgccccgcgcgtggggggcagcttcgccgtctggggcggcctcttctcaaccttcgactgcgccatggtctatgcgcgccagaaggaggatccctggaactccattatcgcgggcgccgccacgggtgggtttctctctatgcgccacggcatgagggcggcgggccggtccccgctcatgggcggtgtcctcctgggcctcatcgaaggcgccggacttatgctcaaccgcgtcctccccaaaccgccgcttgccggagagggatccccactttccgggggctggggggaaaaccctttccgggcctgccccaagaggcgccgggcgggggacctcccgaaggggcgagccccacagaaccgggggggtgtttggggggaacatttgccggcacgatgtaaaaaaaaatcccccgcgggggagcggaaatcctggggagctcgaccgcccacaatcccggacctccggtgtggtaaaaagaggaaaggggggctgatgccccgttgtccttccggcc

SEQ ID NO: 79309 - protein, 230 aa, Zea mays
  misc_feature: Ceres CLONE 1564327
  misc_feature (4)..(133): Pfam Name: Tim17 Pfam Description: Tim17/Tim22/Tim23 family
  misc_feature (53)..(53): Xaa is any aa, unknown, or other
MGTPETSREPCPDRILDDVGGAFGMGAVGGSAFHFIKGIYNSPNGMRMSGGAXAVRMNAPRVGGSFAVWGGLFSTFDCAMVYARQKEDPWNSIIAGAATGGFLSMRHGMRAAGRSPLMGGVLLGLIEGAGLMLNRVLPKPPLAGEGSPLSGGWGENPFRACPKRRRAGDLPKGRAPQNRGGVWGEHLPARCKKKSPAGERKSWGARPPTIPDLRCGKKRKGGLMPRCPSG

SEQ ID NO: 79310 - DNA, 940 bp, Zea mays
  misc_feature: Ceres CLONE 1564328
  misc_feature: SWISSPROT Homolog: EC 1.1.1.82 Malate dehydrogenase (NADP(+))
  misc_feature (766)..(766): n is a, c, t, g, unknown, or other
  misc_feature (780)..(780): n is a, c, t, g, unknown, or other
  misc_feature (874)..(874): n is a, c, t, g, unknown, or other
ctccccgcggtggcggccgctctagaactagtggatcccccgggctgcaggaattcgtctcacccctagaaaaaagaaaaacgtttcaagccctcgaaggtgtagctatggaactggaggactcgctgtatccactgctgagggaagtcagcattggcatagatccttacgtagtctttcaagatgtagattgggcccttcttattggcgctaagccccgaggtcccggcatggagcgagctgcgctactggatatcaatggccaaatctttgctgaccaggggaaagcacttaatgcggtcgcctcgcggaacgcgaaagtcttagttgttggaaatccctgtaacactaatggcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaaccattcgacgactcaggttcctgacttcttgaatgccaaaattgatggaagaccagtgaaagaagtcattaaggataccaagtggttaagaggaagagttcaccctcacagttcaaaaagcgtggaggtgtgctcatccctaaatggggcagatcatcagctgcatcgaccgctgtttcgatagtggatgctattagatccctcgtactcctaccccagaaggtgactggttttctacaggggtttatacgactggaaatccntatgcatagcaaangatatcgtggtcagcatgcatgcagatcgaagggtgatggtgatacgaactagctagtgatgtgttgatggacgattttctctgggaacgattnaaagagcaagctgatttgctggtgagaagatgcgtgccatctaccagaaagggaaaatgcatttgg

SEQ ID NO: 79311 - DNA, 836 bp, Zea mays
  misc_feature: Ceres CLONE 1564329
  misc_feature: Encodes the peptide sequence at SEQ ID NO. 79312
  misc_feature (597)..(597): n is a, c, t, g, unknown, or other
  misc_feature (659)..(659): n is a, c, t, g, unknown, or other
ctccccgcggtggcggccgctctagaactagtggatcccccgggctgcaggaattcgtctcacccctagaaaaagccctcttccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagccctgcatgaccatgttgcacttacgcaccctgaccttgacaggagactgangagttcattgcagatgtgcttggggtcgaggtgtttaggcagactattgctgggaatatccnttgtggggaggtactgcggcttctctaacagggggtggttttgggtcatccccaatacatcccgttgaagaaccttggacgagctctccacggcttcctccaagttcctctttgtccccaggaaactgttgaacacagggaaacgaggggcttttgtcttccgggcctacaaattaa

SEQ ID NO: 79312 - protein, 168 aa, Zea mays
  misc_feature: Ceres CLONE 1564329
  misc_feature (3)..(169): Pfam Name: eIF-6 Pfam Description: eIF-6 family
  misc_feature (126)..(126): Xaa is any aa, unknown, or other
  misc_feature (147)..(147): Xaa is any aa, unknown, or other
MATRIQFENNCEIGVFSKLTNAYCLVAIGGSENFYSAFEAELADAIPVVKTSIGGTRIIGRLCVGNKNGLLLPHTTTDQELQHLRNCLPDQVVVQRIDERLSALGNCIALHDHVALTHPDLDRRLXSSLQMCLGSRCLGRLLLGISXVGRYCGFSNRGWFWVIPNTSR

SEQ ID NO: 79313 - DNA, 937 bp, Zea mays
  misc_feature: Ceres CLONE 1564331
  misc_feature: Encodes the peptide sequence at SEQ ID NO. 79314
  misc_feature (684)..(684): n is a, c, t, g, unknown, or other
  misc_feature (891)..(891): n is a, c, t, g, unknown, or other
ctggagctccccgcggtggcggccgctctagaactagtggatcccccgggctgcaggaattcgtctcacccctagaaaaatagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacgactgggaaccgtgtctttggtgcccctcaaggagctttggatggtggcctggatattctcacagcgagaagaggtttgctggntttcagaagatgacaagcagctggatgctgatatccatcgcaagtacatctatggtggccatgttgctgactacatgaaggacctcgctgaagaggagccagaagagtaccagtctcacctcagtgagtactttaagaagggaaatgaggctgacgacatgtaagctcttgtacaagaagtccatgctgccatccgttgctgatccntcttgtgggtcagtccacccaggcagcccccaaaggagcccatgag

SEQ ID NO: 79314 - protein, 185 aa, Zea mays
  misc_feature: Ceres CLONE 1564331
  misc_feature (27)..(173): Pfam Name: Ribosomal_L18p Pfam Description: Ribosomal L18p/L5e family
  misc_feature (182)..(182): Xaa is any aa, unknown, or other
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGAPQGALDGGLDILTARRGLLXFRR

SEQ ID NO: 79315 - DNA, 910 bp, Zea mays
  misc_feature: Ceres CLONE 1564332
  misc_feature: Encodes the peptide sequence at SEQ ID NO. 79316
  misc_feature (910)..(910): n is a, c, t, g, unknown, or other
ctggagctccccgcggtggcggccgctctagaactagtggatcccccgggctgcaggaattcgtctcacccctagaaaaaatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcaagcccggccagcccctcgacttcgccgacctcttcaaggagggcgacctcatcgacgtctccggcaactccatcgagaaagggtttcaagggggcatcaaagaggaccaacttcaaccgccggcttgataacccaccgtttccaaaaccacccggcagctgggttccattcgaaacggggacaaaccccggcctcctttttaaagggaaaaaaaaaccctgggaggaagggggggagaccaaaaaccaaaattcgggaagcctaaaaattctcgagaaatgaaaaaaaccctcgcgggggctccctgaataaagaggggcccgtgccccagggaaaccccn

SEQ ID NO: 79316 - protein, 178 aa, Zea mays
  misc_feature: Ceres CLONE 1564332
  misc_feature (51)..(175): Pfam Name: Ribosomal_L3 Pfam Description: Ribosomal protein L3
MAMAAVGVGGAVAFLLPQRRQGAVPWSGGRRRAPVAVRASYEAGVGVMATKVGMMTYFDPETGKPVPVTVVGFREGGNVVTQVKTAATDGYDAVQVGYHGVREDKLTRPELGHLGKAGAPPLRHLQEFRLTAVDAFKPGQPLDFADLFKEGDLIDVSGNSIEKGFQGGIKEDQLQPPA

SEQ ID NO: 79317 - DNA, 924 bp, Zea mays
  misc_feature: Ceres CLONE 1564335
  misc_feature: Encodes the peptide sequence at SEQ ID NO. 79318
  misc_feature (796)..(796): n is a, c, t, g, unknown, or other
  misc_feature (808)..(808): n is a, c, t, g, unknown, or other
  misc_feature (818)..(818): n is a, c, t, g, unknown, or other
  misc_feature (819)..(819): n is a, c, t, g, unknown, or other
  misc_feature (858)..(858): n is a, c, t, g, unknown, or other
  misc_feature (914)..(914): n is a, c, t, g, unknown, or other
  misc_feature (915)..(915): n is a, c, t, g, unknown, or other
ctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtgattcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcagcttcgacccgctcggcctcgccgacgaccctgaggccttcgcggagctcaaggtgaaggagctcaagacggccgccctcgcatgntctccatgttcnggggtctcgnntcagccatcgtcaccggcaaggcccgctcgagaactcgncgaccactcggcgacccgtcacaacacgcatggcctattgcacacttgtgccgcanngggaggggt

SEQ ID NO: 79318 - protein, 129 aa, Zea mays
  misc_feature: Ceres CLONE 1564335
  misc_feature (64)..(128): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAV

SEQ ID NO: 79319 - DNA, 917 bp, Zea mays
  misc_feature: Ceres CLONE 1564337
  misc_feature: Encodes the peptide sequence at SEQ ID NO. 79320
  misc_feature (853)..(853): n is a, c, t, g, unknown, or other
  misc_feature (905)..(905): n is a, c, t, g, unknown, or other
  misc_feature (908)..(908): n is a, c, t, g, unknown, or other
ctggagctccccgcggtggcggccgctctagaactagtggatcccccgggctgcaggaattcgtctcacccctagaaaaaaaaacgacccccgcaaccaaagacctctccccttctatctatctactatatatcgatccacccatccctcgcagctccaaagcattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgaggccaagctcaaggtcaagttctacctcccgcccttcctccccatcgtccccgtcgtcggcgactactgggtgctctacgtcgacgatgactaccagtacgcgctcgtcggcgagccgcgccgcaagaacctctggatcctgtgcaggaagacgagcatcgacgaggacgtgtacaacccagctggtggagcgggccaaggaggaaggctacgacgtgagcaagctgcacaggacgccgcaggacgacccgcccgcggagagcgacgccgcgccaccgacaccaagggggtgtgggtgggtcaagtcgctcttcgggaaaatgactgccgtcancgcacgcgcgcgtgctccggtactgtgctttgcagtgcacaaataaacaggncgnagtgagtga

SEQ ID NO: 79320 - protein, 220 aa, Zea mays
  misc_feature: Ceres CLONE 1564337
  misc_feature (24)..(167): Pfam Name: Lipocalin_2 Pfam Description: Lipocalin-like domain
  misc_feature (203)..(203): Xaa is any aa, unknown, or other
MAAEEGEKAKSGGGGQQMTVVRGLDVARYMGRWYEIASFPSFFQPRDGRDTRATYRLLEDGATVHVLNETWSKGKRDYIEGTAYKADPGSDEAKLKVKFYLPPFLPIVPVVGDYWVLYVDDDYQYALVGEPRRKNLWILCRKTSIDEDVYNPAGGAGQGGRLRREQAAQDAAGRPARGERRRATDTKGVWVGQVALRENDCRXRTRACSGTVLCSAQINR

SEQ ID NO: 79321 - DNA, 958 bp, Zea mays
  misc_feature: Ceres CLONE 1564348
  misc_feature: Encodes the peptide sequence at SEQ ID NO. 79322
  misc_feature (726)..(726): n is a, c, t, g, unknown, or other
  misc_feature (732)..(732): n is a, c, t, g, unknown, or other
  misc_feature (733)..(733): n is a, c, t, g, unknown, or other
  misc_feature (780)..(780): n is a, c, t, g, unknown, or other
  misc_feature (846)..(846): n is a, c, t, g, unknown, or other
ctccccgcggtggcggccgctctagaactagtggatcccccgggctgcaggaattcgtctcacccctagaaaaaaaacccatccctcccgcgagatctctcaccggagtcaccgccccccagatccgcctcccctcgccggcgcgctcgcgtgttttccgctcgtccgccgccatgtcgcacaaccacggcgacacgatcctgctccacccctcgtcggcgcagtccgacatggacgagatcgagagcctcatccacgccgcgccatctccggccaccgttctccccgcgcggccaccgtctccgacgcgggcctccattcccgtatcctcctctccggcgttggcgccggcgcccgtccccacgaagccgcctctccccgccgcctccattccgatctccgtctctgtctcccccgttctaacgtccgtctccgttcccatcggcgctgacgggtttggacctccacccaacacgctcacagagccggtatgggacaccgtaaagcgagacttagcacgcatcgtcagcaatctcaagctcgtcgtcttccccaatccctaccgcgaggaccccggcaaggcgctcagggactgggacctgtggggtcccttcttcttcatcgtcttccttggcctcacgctctcctggtcagcttccgttaagaagtctgaagtatttgctgttgcatttgctgtcctggcagctggggctataattctgaccntgaatnngtctgctctgggtggacacatcatcttctcccaaagcctagtcctcntggggtatgcctgtttcacctggacgttggtgctctactttgcatgctgaaagacaacgtgatacntaggatggcgtggtaacatcacatgggcatggagctctgggctgcctatcattcatgatgctgctgttaccccaggagaaagcctggccctaatcctgtctcctcaggaaat

SEQ ID NO: 79322 - protein, 218 aa, Zea mays
  misc_feature: Ceres CLONE 1564348
  misc_feature (110)..(218): Pfam Name: Yip1 Pfam Description: Yip1 domain
  misc_feature (185)..(185): Xaa is any aa, unknown, or other
  misc_feature (187)..(187): Xaa is any aa, unknown, or other
  misc_feature (203)..(203): Xaa is any aa, unknown, or other
MSHNHGDTILLHPSSAQSDMDEIESLIHAAPSPATVLPARPPSPTRASIPVSSSPALAPAPVPTKPPLPAASIPISVSVSPVLTSVSVPIGADGFGPPPNTLTEPVWDTVKRDLARIVSNLKLVVFPNPYREDPGKALRDWDLWGPFFFIVFLGLTLSWSASVKKSEVFAVAFAVLAAGAIILTXNXSALGGHIIFSQSLVLXGYACFTWTLVLYFAC

SEQ ID NO: 79323 - DNA, 827 bp, Zea mays
  misc_feature: Ceres CLONE 1564349
  misc_feature (678)..(678): n is a, c, t, g, unknown, or other
  misc_feature (728)..(728): n is a, c, t, g, unknown, or other
  misc_feature (729)..(729): n is a, c, t, g, unknown, or other
tggagctccccgcggtggcggccgctctagaactagtggatcccccgggctgcaggaattcgtctcacccctagaaaaaccctgagcagctcatcagtggcaaggaggatgccgctaacaatttcgcccgtggccactacacaattggcaaggagattgttgatctgtgccttgaccgtatccgcaagcttgctgacaactgcaccggcctccagggcttcctggtcttcaatgccgttggtggtggcaccggctctggccttggttctctcctccttgagcgcctgtctgtggagtacggcaagaaatccaagctgggcttcactgtgtacccatctccccaggtgtcaacctctgttgtggagccttacaacagcgtcctctccactcactcactcctggagcacactgatgtctctatcctgctcgacaacgaggccatctatgacatctgcaggcgctccctcgacattgagaggcccaactactccaacctgaatcgccttgtgtctcaggtgatctcatctctgactgcttccctgaggttcgatggtgccctcaatgtggatgtgaacgagttccagaccaacctggttccttacccgaggatccacttcatgctctcctcctacgcaccggtgatctcttctgcgaaggccttccacgagcagctgtctngtggcggagatcacccagcagcgcgttcgaagccggcttcccatgatggnntcaagtgcgacccacgggcacgggcaagtacaatggccttggcttgccctgaagtaacccgccgggccaacctggttgcccccaaggacctttgaacc

SEQ ID NO: 79324 - DNA, 805 bp, Zea mays
  misc_feature: Ceres CLONE 1564351
  misc_feature: Translation starting site: 118
  misc_feature: SWISSPROT Homolog: EC 2.1.1.146 (Iso)eugenol O-methyltransferase
  misc_feature (355)..(355): n is a, c, t, g, unknown, or other
tggagctccccgcggtggcggccgctctagaactagtggatcccccgggctgcaggaattcgtctcacccctagaaaaaagcgcacacacatacacaagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgcctgctgcggctcctcgccngcgtcgggcgtgttcaccgtcgacaagcagagcacggaggaggagcggtaccgcatcagccccgtgtcctacctcctggtggacggcatccctcacgaggaccacatgaaccacaccgctctggtgctcacctgcacctcgacgcgctacatcgaggcggggataggggctggcggagtggttcaagagggacgtggtcacgtcaccgttcgaggagctgcacggggcgactctgttccacgagagcatggggagcctcgacgcagatttccacgacatggcgagcgaggcccttgacgccaaccgacacttcggcatcgagatagctatgccgggagttcaagggacttgttccaaggggatccagtccatgacctactgctgcgggaactttcggggattgacaagggtggcaagggccattgtccaaacccttccacccataaaaag

SEQ ID NO: 79325 - DNA, 926 bp, Zea mays
  misc_feature: Ceres CLONE 1564353
  misc_feature: Encodes the peptide sequence at SEQ ID NO. 79326
  misc_feature (618)..(618): n is a, c, t, g, unknown, or other
ctccccgcggtggcggccgctctagaactagtggatcccccgggctgcaggaattcgtctcacccctagaaaaactcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaaccgtgtctttggtgccctcaaggnagctttggatgggggcctggatattctcacagcgagaagaagtttgctggattcaagaagatgacaagcagttggatgctgatacccaccgcaggtacatctatgggtgccatgttgctgactacatgaaagaccttgctgaagagagccagaaagtaccagagccacttcagtgcgtcatttaagaagggagttgaggctgaagaaattgagccctgtacagaaggtcatgctgccatcgtgctgatcctttcggtggtagtcaacaagcgccccaatagagcatagaagtcaaccccagagctgac

SEQ ID NO: 79326 - protein, 207 aa, Zea mays
  misc_feature: Ceres CLONE 1564353
  misc_feature (27)..(156): Pfam Name: Ribosomal_L18p Pfam Description: Ribosomal L18p/L5e family
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDKEYEGNVEATGEDFSVEPADERRPFRALLDVGLIRTTTGKPCLWCPQGSFGWGPGYSHSEKKFAGFKKMTSSWMLIPTAGTSMGAMLLTT

SEQ ID NO: 79327 - DNA, 847 bp, Zea mays
  misc_feature: Ceres CLONE 1564354
  misc_feature: Encodes the peptide sequence at SEQ ID NO. 79328
  misc_feature (639)..(639): n is a, c, t, g, unknown, or other
  misc_feature (684)..(684): n is a, c, t, g, unknown, or other
  misc_feature (692)..(692): n is a, c, t, g, unknown, or other
  misc_feature (751)..(751): n is a, c, t, g, unknown, or other
  misc_feature (811)..(811): n is a, c, t, g, unknown, or other
ggagctccccgcggtggcggccgctctagaactagtggatcccccgggctgcaggaattcgtctcacccctagaaaaagcgtctctctgtaaaccacagtccacagccaccaagatcgccgcgctctctccaacatctcctgaccaaagcgaatccagcatcaccggggtccaggaggcagcatggctgacgaccagcagccaccggcgcaacggtactggttcccgtactggacctcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccagaggcgctggcggtggtgtccctgatccacctgcccagccgcagcccacgcggctgtccagcaggccatcgccgtcgccttcccgcgctcagccactgtcgcccattagagagcccaacgcttcaccggcaccggttgccaaagagcacaagcagccttctcctcttcatcataccgagcatggtgttcctaagcaaaagacatcaccgttccgcaagagaaaacatccatgaaccgcttgtagcatccaagacacaaacaaagaccccngaaaaggaaaaggacagggaaagggaaaaggagaagagaaggaanggcaccancctgccaaggaaaaagataaggggaagaaagccagggggaaggaaaaggaaaagataangagaaggggggtcctaaggataaaaaagacaggggtccccaggggaaaaggaaaagattnggggagggggggcgcccccttcccaggggctcaggg

SEQ ID NO: 79328 - protein, 139 aa, Zea mays
  misc_feature: Ceres CLONE 1564354
MADDQQPPAQRYWFPYWTSPAPRPVARPQLSRRETRPAPSPPATASPSRRPSHPQQAATPASRGAGGGVPDPPAQPQPTRLSSRPSPSPSRAQPLSPIREPNASPAPVAKEHKQPSPLHHTEHGVPKQKTSPFRKRKHP

SEQ ID NO: 79329 - DNA, 883 bp, Zea mays
  misc_feature: Ceres CLONE 1564356
  misc_feature: Translation starting site: 203
  misc_feature: SWISSPROT Homolog: EC 2.4.1.207 Xyloglucan:xyloglucosyl transferase
  misc_feature (771)..(771): n is a, c, t, g, unknown, or other
  misc_feature (827)..(827): n is a, c, t, g, unknown, or other
ctggagctccccgcggtggcggccgctctagaactagtggatcccccgggctgcaggaattcgtctcacccctagaaaaagtcgtcgtcgcatcgcacgcaccatcgtcctgccgatcgatcgcagccagccagtcttgctgagagacgaactgaagcctgaagtgaaccgatcgatcgatcgatcgagcgagcgagctcccatgaaggcgttgattctggcggcggtgctgctgctgcagcacgggggagccgcgagcgccggcggcaacttctaccaggacgtggacatcacctggggcgacggccgcggcaagatcctcgacaacggccagctcctgacgctgtccatggacaggtcctccggctcgggcttccagtccaaggcccagtacctctacggccgcttcgacatgcagctcaagctcgtcccgggggactccgccggcaccgtcgccaccttctatctttcgtcgcagggttcgcagcacgacgagatcgacttcgagttcctggggaacgcgagcggggagccgtacacggtgcacacgaacgtgtacagccaggggaagggcgggcgggagcagcagttcccggatgtggttcgaccccacggcggccttccacgcctactccgtgctgtggaaccccgcccacgtcgtcttctacgtggacggcgtccccatcccggagttccggcgtcgcggcgacgggaccgtgcccgttcccgacgtcgcaccccatgcgggggtaacgccagcgtgtgggacgncgaagagtgcccccccccgcggggggggccgcgtccggaccgactgggtcaagggncccctttcttcgggtttatacccgcgggacccccccccgcccgggttgcacccgcc

SEQ ID NO: 79330 - DNA, 855 bp, Zea mays
  misc_feature: Ceres CLONE 1564358
  misc_feature: Translation starting site: 477
  misc_feature (432)..(432): n is a, c, t, g, unknown, or other
  misc_feature (443)..(443): n is a, c, t, g, unknown, or other
  misc_feature (447)..(447): n is a, c, t, g, unknown, or other
  misc_feature (472)..(472): n is a, c, t, g, unknown, or other
  misc_feature (788)..(788): n is a, c, t, g, unknown, or other
ctccccgcggtggcggccgctctagaactagtggatcccccgggctgcaggaattcgtctcacccctagaaaaaaattccacccctcgccgccatctccgtctctctctctctcccgcaaccaagcagttcaactcacacccgaagcggcgccgctagggtttgctccgacagccgcgaaacctagtccttactgcgccctcccacagaggccgtcattcactaatctagctgctacgcttcgcttcccgctccgattgggagctagggtttagcttatctccgagctcagcttcgggtcgcggcacgcggcatggcggggtacggggaagagaaccagaacgccatgaacgggtacgaggaggaagaggaggaagaagaggttgaagaagtcgaggaggtgtacgaagaggaggaggagggggacgggagnaggggaagganaccnaagggggcaaccccccgaggcagcnagcgatggcggccgagacgagaggtgtcgatggaggccggggcctagcggaggccgttgggaatgttgatgccggaggcgaggatgagagggatgcagattctagcggcggtgacgcttcggggaaggttttcgtagggggtgtagcctgggagacaactgaagaaacttcacaaagcattttcagaagtatggagctataactgattctgtgatcatgaaggacaagcatactaggatgcctcgtggatttggatttgttacattttccgatccgtctgtgcttgacagggttctagaggatgaacatgtcatanattaagggacggttgaagtcaaaagactgttcaaaaggctgtcgtcaaagatggcctaagacaaaaa

SEQ ID NO: 79331 - DNA, 798 bp, Zea mays
  misc_feature: Ceres CLONE 1564360
  misc_feature: Encodes the peptide sequence at SEQ ID NO. 79332
  misc_feature (644)..(644): n is a, c, t, g, unknown, or other
  misc_feature (665)..(665): n is a, c, t, g, unknown, or other
  misc_feature (668)..(668): n is a, c, t, g, unknown, or other
  misc_feature (674)..(674): n is a, c, t, g, unknown, or other
ggagctccccgcggtggcggccgctctagaactagtggatcccccgggctgcaggaattcgtctcacccctagaaaaaaaaccttaaccaaatcccccctcccctcgcttccacaccttccgcctcgtctccctctctctctgtctctctctctctctcacacacacacacgcatcaggtcgggacgggaggggaggtctcgtgcgcgcccggctttcctctcctctcctcgccgcacgacgcgcgcgcggtcccggtcgccgatggccaaggcacgcaggccgccgttcgccgccgccgagcggttcctcggcttcccccgcggcgggccctcgccgggggccgtggcgccggcgcccgccgccctcgacgacctgccggacctcgccgaggccgacgtctggtactcggctgccgacccgggtagcccgtatcccgcggcgtcccgacatgcggcggcggagggcaggagcgcaggccagcgcggcccgcggcgcggcgtgcagggcggcctgagccgggcgttcggggacgggtcccgggtccgggtccgggcggcaggcggcggcgtcggcgcccgtcgagggtggccgcgtgggcggcccgcttctccgtgccggacgcggagccgacgctgctgttcnagatggagatggggaaccacnacnacgacnagggggaagggggacccccgggtggggtgcctccgcacgtgtaccttgcccgggccccggccccgggccttcggtgggtgaaggggccccggccgaaaccttaaggggccgggaaaattttccc

SEQ ID NO: 79332 - protein, 163 aa, Zea mays
  misc_feature: Ceres CLONE 1564360
MAKARRPPFAAAERFLGFPRGGPSPGAVAPAPAALDDLPDLAEADVWYSAADPGSPYPAASRHAAAEGRSAGQRGPRRGVQGGLSRAFGDGSRVRVRAAGGGVGARRGWPRGRPASPCRTRSRRCCSRWRWGTTTTTRGKGDPRVGCLRTCTLPGPRPRAFGG

SEQ ID NO: 79333 - DNA, 960 bp, Zea mays
  misc_feature: Ceres CLONE 1564362
  misc_feature: Encodes the peptide sequence at SEQ ID NO. 79334
  misc_feature (960)..(960): n is a, c, t, g, unknown, or other
acccgcggtggcggccgctctagaactagtggatcccccgggctgcaggaattcgtctcacccctagaaaaagcacaacacgagagctacctacgactgctcctcatctccagtgtgctgacgagacagagagaccctgagagagcgccatggccagcctccaagtcactcctacttcggcgttcactgagtggaaccagctgaagctcgaaggcctgtacctgttccacacgcgcctgggctcaggcgccaaccaagctcgggtcatagacaacaaggcgccgattggcatcggtgccaccgtagtgaacaactggacagtgtatgacgggccagggccgaacgcaaacctggctgaccgtgcacacggcttgcttttcctagccggctacccccccaactccttcagcctagtgttcgtggatcacaggttcaccgggcccacgcttgaagggacctgaatagtaggtgaacccgggcagtgggctattgttggaggcaccggcccggctagccatggaaaaccgggtcttccgcaacaagttccatgagcagagaagcgaagggaacatgataagactctccatgccagctttcttgtccggggctgcggacccaaaaaagagccgggccgccaaaagtgggcccttggggggggagccgccgggttccccggggggaaacaccgcgtgatcccccgagactggaaaaaacttccccggatcctcctggggatacgccatggaccacgattggcttccccctacgggcgacaccgccggccaaacacagttttgggggacaacttgggcgggttccgggggcgaaacactgaacggggataactaacccgcgtaaccccatgtgacctacgaacctgtgccgggtaacaatgcgttctgcagaaggtcttactgacaaaatccccactattgttttgttcggatcccgtcgaccccn

SEQ ID NO: 79334 - protein, 103 aa, Zea mays
  misc_feature: Ceres CLONE 1564362
MASLQVTPTSAFTEWNQLKLEGLYLFHTRLGSGANQARVIDNKAPIGIGATVVNNWTVYDGPGPNANLADRAHGLLFLAGYPPNSFSLVFVDHRFTGPTLEGT

SEQ ID NO: 79335 - DNA, 1289 bp, Zea mays
  misc_feature: Ceres CLONE 1564365
  misc_feature: Encodes the peptide sequence at SEQ ID NO. 79336
  misc_feature (69)..(69): n is a, c, t, g, unknown, or other
  misc_feature (887)..(887): n is a, c, t, g, unknown, or other
  misc_feature (1226)..(1226): n is a, c, t, g, unknown, or other
cttcgattacccgtgctcttctccccggtctacaattttttttcctttctctgtttgttaaatttttgntggactccccgcggtggcggccgctctagaactagtggatcccccgggctgcaggaattcgtctcacccctagaaaaactttttcctagggtttcgtcgcttccagccggcgccgcgtccgcctcgccaagcgcagcatccgccgcagcacatcgctctcttgatctcagccatggcggaggtggagcagcaacaggacacgccgaagctcttcaaccgctggaccttcgatgatgtcgaggggaacgacatctcgctgaacgactacctcgctgtgaacgcgacgaagcacgcgatgtacctgccgcacaccgcggggcgctactccaagaagcggttccgcaaggcgcagtggccgatcgttgggcgccttacaaagttcctgatgatgcagggcccccccaacagcaagaaggctatgggctgtccgcgtcatcaagcagtcccctggagatttttcacctggttcaccggatgccaagctccctccaaggtcgtccttccaacgcgattcttggatcatgggccccccgtggagggatggccaccccgtattggggtttccccctggggggtttgtgtagaaaaggtatggccccctggaataattctcacaccctctggagaggaggggggggaaaaccagggggccgtcctaaaccctcccgtcgacaaccctgtgggtggcccaaggggaataaagtggcctttgttcggagagataccttcgcttaaacacccacttgtcccgcgcgaattagcgccctcttgggctggaatattgaagagtcgggagaattcaaaacaccctgtgcccnaccagggggggggtcacttaacccaaaataatttgtttcgcgcacccaacttctattgagaaaaaaggggagtcgcgataatctttgttatcgcgctggttgtggcaacaaggtgcccacaccctcgtttagaaacacggagaccctttggagatgcctcgggagaggggccttttgttgcgtgctggtggtaaatctcatttgtatggtgtgagcggagcgccgctccctaaattcgggagtcgcctgcgcttattaacacactggcttattgtggcattgtttcttttcgacagcgtatctttgtggggcgtgttgctggttattccgagttgggancctctacagatactaccccgtcaatatatacgataggtatacgctcgcggacaggcacggcgg

SEQ ID NO: 79336 - protein, 234 aa, Zea mays
  misc_feature: Ceres CLONE 1564365
  misc_feature (216)..(216): Xaa is any aa, unknown, or other
MAEVEQQQDTPKLFNRWTFDDVEGNDISLNDYLAVNATKHAMYLPHTAGRYSKKRFRKAQWPIVGRLTKFLMMQGPPNSKKAMGCPRHQAVPWRFFTWFTGCQAPSKVVLPTRFLDHGPPVEGWPPRIGVSPWGVCVEKVWPPGIILTPSGEEGGENQGAVLNPPVDNPVGGPRGIKWPLFGEIPSLKHPLVPRELAPSWAGILKSRENSKHPVPXQGGGHLTQNNLFRAPNFY

SEQ ID NO: 79337 - DNA, 890 bp, Zea mays
  misc_feature: Ceres CLONE 1564366
  misc_feature: Encodes the peptide sequence at SEQ ID NO. 79338
  misc_feature (712)..(712): n is a, c, t, g, unknown, or other
  misc_feature (752)..(752): n is a, c, t, g, unknown, or other
  misc_feature (796)..(796): n is a, c, t, g, unknown, or other
  misc_feature (835)..(835): n is a, c, t, g, unknown, or other
  misc_feature (836)..(836): n is a, c, t, g, unknown, or other
  misc_feature (845)..(845): n is a, c, t, g, unknown, or other
  misc_feature (882)..(882): n is a, c, t, g, unknown, or other
ctccccgcggtggcggccgctctagaactagtggatcccccgggctgcaggaattcgtctcacccctagaaaaaacacacacggtcgacgccatctcctgattcgtcttcgtctagaacgtcagaattcaccaaatcagccctcgcgtttctcccttcccccggctcccggcgtctctgcgctgcggccgtacggcgatgcggtggctatcgaggctgctctctcaagccgtcgccgccaggagggcctccgcggcggcgaggtccaacactagtctcgtcaagggaggatcccacgggttcgctagtggcggcagggatgggtcaccggaggtgcctcgggagtggttgcggaagctgtgggtagacgagctgaagaagcagaaggaagccgcgaggagatggggcgtcggctcatcattagaggttgcaggagcgaccgaggaggcaccgtcaaggagctatcagtacgaatacagcggctctaaccccgtggaggccaaactggctccgcttcttgcaagagctaacctcgtcattgccagggatattgagtgggcaaacatcatgtttgcttttgagcaggagagcaggtatatcataatggacccactctttccacaatctccagtaggttttattcgagagaaaagcaacatcatctttagacagctactcagaacaagacggccatttgttgcagaaataactgnatgctatgggtaaacgagatatttaaggttcgccgggcanttttggtggatcaacagctcatttttatgtagaagtgaatgatnaaggaagatagggtgtagtccacagggcgtttggcaccnntttggcggnaggaatttatgactttgtactttagggaaataatgcnaatttgca

SEQ ID NO: 79338 - protein, 175 aa, Zea mays
  misc_feature: Ceres CLONE 1564366
  misc_feature (172)..(172): Xaa is any aa, unknown, or other
MRWLSRLLSQAVAARRASAAARSNTSLVKGGSHGFASGGRDGSPEVPREWLRKLWVDELKKQKEAARRWGVGSSLEVAGATEEAPSRSYQYEYSGSNPVEAKLAPLLARANLVIARDIEWANIMFAFEQESRYIIMDPLFPQSPVGFIREKSNIIFRQLLRTRRPFVAEITXCYG

SEQ ID NO: 79339 - DNA, 1333 bp, Zea mays
  misc_feature: Ceres CLONE 1564368
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (1020)..(1020): n is a, c, t, g, unknown, or other
  misc_feature (1160)..(1160): n is a, c, t, g, unknown, or other
  misc_feature (1329)..(1329): n is a, c, t, g, unknown, or other
tttccgcttccctgtcttgttctgctgtgttgctgttgctgtgctggggtgattgttnnnttccattttggactgcccgcggtggcggccgctcttgaatagtggatcccccgggctgcaggaattcgtctcacccctagaaaaactgagttcctaccctttcgccctacttggttcccacgcctgggcccgagctccgagctagggtttcctctctcgacgacgccgccgccgccgccgccgacggagaagaggagtaggtgaagccgagttattagcgccaggggaggaacacggggacgcaggagacttcgcgggagccatgacgggaccagatcctggaccacgccggcggagctttcctgatgggcgccgactgtcggtacggctcttccacctcaccaagggcgtctacagctcacccaacgggatgcgcgtgttggggggcgcgcaagcaatgcacacgaactccccacgcgtgtggggcaggttaggaggtatggcgagacctctttctcaaccttgatactgcggatttggtcttttgctgcaccgggaaggaagcaatccccctggaatctcccattataggcagcgccgccgcccgcagtgacggggtcttccctcctatgacgcccgtgccgagatggggggggcccggagggcccattgtcctcccccgcctcattggggggctgtcgtcccttgcctgagtgcgctacaattgtaaggggccgcccctgggcgttttatttcgcgtccgaacgaggtggtatcctcggcgcaattgcgaagcgtaggactcgggccggcgccgatatgggaatcatctccacccccacatgttcacgggacggggctcccattgtgggggacagtaacatataccccgcaccgttacctcccacggtgggcgcatttttgcaccctccccgcgtggtctccccactcgaccggggtgtaagtagtggagagtatttctgcgccaggcgagaattaccgtgaggctatgacacctcntctatctccggagtgaaaccacgattttttaatctccgttgcgttgggggatggctaatatctcgtttctgtggcggttggctagcgcgatctaggaatatgacgatactgtgtttggcccctcgggcctgggggtcaantatccgtggccgttctccgtgtgggatgtgggcgccgcggttctaggtcagtggtgagctcttccgtggttccctctattcgagagcggacacgactaagttgttatagataacatatgatcgcgtacgtaggtcgcgcctgtgcctatctaatattactgcgcgacantgtc

SEQ ID NO: 79340 - DNA, 824 bp, Zea mays
  misc_feature: Ceres CLONE 1564370
  misc_feature: Encodes the peptide sequence at SEQ ID NO. 79341
  misc_feature (545)..(545): n is a, c, t, g, unknown, or other
  misc_feature (572)..(572): n is a, c, t, g, unknown, or other
  misc_feature (661)..(661): n is a, c, t, g, unknown, or other
  misc_feature (672)..(672): n is a, c, t, g, unknown, or other
  misc_feature (728)..(728): n is a, c, t, g, unknown, or other
ctccccgcggtggcggccgctctagaactagtggatcccccgggctgcaggaattcgtctcacccctagaaaaaagccatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagncgcgagaagaagcaccacccactctcngctgaccgtagtaccggccggcgcgcgaccgagagctagctagctccggcgcacacaacacacacctgtttaattctgtactgcatgcntgtgtaaattngatgggtcaccaataatgagtccttctccggacttgtgtagctgcttgcttggggnaagtgaaagttgtaaaactaggaaaaaaaggtgggttttggccttggggctactccaaaaaaggggtttccgggaccccctttcgttttcccggag

SEQ ID NO: 79341 - protein, 142 aa, Zea mays
  misc_feature: Ceres CLONE 1564370
  misc_feature (41)..(120): Pfam Name: ABA_WDS Pfam Description: ABA/WDS induced protein
  misc_feature (121)..(121): Xaa is any aa, unknown, or other
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGAGGYVFHEHHEKKKDHKDAEEAXREKKHHPLSADRSTGRRATES

SEQ ID NO: 79342 - DNA, 814 bp, Zea mays
  misc_feature: Ceres CLONE 1564371
  misc_feature (552)..(552): n is a, c, t, g, unknown, or other
tggagctcaccgcggtggcggccgctctagaactagtggatcccccgggctgcaggaattcgtctcacccctagaaaaactctcgatcacgatcagtgggctgtcgtgacgtcgctctcctctcgatcgattggatcctccaacgaggctggggaaagcgccgcccagatggccgaacgccagcggcgatcactccagctctgagcataagtggaggctccgtgaagtcagtacgtcctatctggcagtggcagcacaccgcaccatggaatggctgacctggacaacggtgtgttgtttattactgctgtgcacctcgctgttcttgcacacggtcagagggcattcgcttcgtgattgatacagaagagtgcttactcgataacgtgaaggatgacggggatacagtccatgtatcttctcatgatcatcaagggtgacaccatgtggcattccctcgaatagggtgatgatcgtgcgtatgacgatacatatgacgcatcgagtccatgcatgctgagactatagtaagtataagatttgatgtctagntaaaaataggagtcgacatcgcttcagcttcgctaataagtcttctgtacccgaaactgacaattcccccggggatgtttggccatatttcattctcccaggcaaattgcccaaaaaaaaagcaattaagccccgcgtttttccaggattttaaagtcaattttggggggaggggcttttttttaaaaaggccccctttttaaaaacgcccccccggtaagggggaaaacccttatcgggaaggcgtggggaccaaattttt

SEQ ID NO: 79343 - DNA, 852 bp, Zea mays
  misc_feature: Ceres CLONE 1564375
  misc_feature: Encodes the peptide sequence at SEQ ID NO. 79344
  misc_feature (668)..(668): n is a, c, t, g, unknown, or other
gctggagctccccgcggtggcggccgctctagaactagtggatcccccgggctgcaggaattcgtctcacccctagaaaaagaccaagccaccagtctgcagcacgaaagcttccccccccccctctcttatcctgatggttgggtcatatggccagcatcaataatcctcctacgaattcccctcacggacgggccaaaacccacacctttcccccgtctacagattctcaaacccggcgaactccaggcagggctcacgtctccgatcccgctcccggattctctttgccgccacgaggagacggcgctccagtccaggccttcagcagctccctctccgtgtgtatctgatctggggattctttgcttgagaaactgctagcatgggcgcggtgcttggacggcatgcacactcacaaacgaagttcccatggttccaatctggaggtaaagatggtctacgctatgcaacacagagcatcgcaatggaacctcttctgaaatcgatcgatagcattatcatgagagttccccaaaatagactagagtttcataaaatgcaagactatcttcgaacagctttgatgaagattctaatgacgaaatatataaagatgaactgacacattgttttcacaagctggaaatctcattcacaaaggatgnacatatgtgatctctattgaagcttgcgatatcaatgaagatatggtcatgaaagtacacgaatgcattagtcattccgtagcgtgtcaatcgtcatcatgaagcagctgtctcttagcaaagatgacatgggactacggaaatcttgggcaacttccagacctgggtctgagcgttggtcttc

SEQ ID NO: 79344 - protein, 79 aa, Zea mays
  misc_feature: Ceres CLONE 1564375
MGAVLGRHAHSQTKFPWFQSGGKDGLRYATQSIAMEPLLKSIDSIIMRVPQNRLEFHKMQDYLRTALMKILMTKYIKMN

SEQ ID NO: 79345 - DNA, 855 bp, Zea mays
  misc_feature: Ceres CLONE 1564376
  misc_feature: Encodes the peptide sequence at SEQ ID NO. 79346
  misc_feature (541)..(541): n is a, c, t, g, unknown, or other
  misc_feature (640)..(640): n is a, c, t, g, unknown, or other
ggagctccccgcggtggcggccgctctagaactagtggatcccccgggctgcaggaattcgtctcacccctagaaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaangatggccagacccgtgaacatgctctccttgcgttcaccctggagtgaagcagatgatttgctgctgcaacagatggatgcaacactcccaaaactccnaagcacgttatgaagagattgtgaaggaagtctcatctacctcaagaaagtggggtacaccctgaatagaatgccttttgtcccatttctggggtttgagggtgaaacatgaatgaaaaggtcaccaaccttgaatggtacaaaagcccacccctgctttaaggtttttgaccaaataaccgaacccaaaaggctttcaaaaaagcccctggttt

SEQ ID NO: 79346 - protein, 144 aa, Zea mays
  misc_feature: Ceres CLONE 1564376
  misc_feature (5)..(145): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (129)..(129): Xaa is any aa, unknown, or other
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISXDGQTREHALLAFTLE

SEQ ID NO: 79347 - DNA, 892 bp, Zea mays
  misc_feature: Ceres CLONE 1564378
  misc_feature: Encodes the peptide sequence at SEQ ID NO. 79348
  misc_feature (288)..(288): n is a, c, t, g, unknown, or other
  misc_feature (784)..(784): n is a, c, t, g, unknown, or other
ctccccgcggtggcggccgctctagaactagtggatcccccgggctgcaggaattcgtctcacccctagaaaaagttccacgcgtccactgtccacccacacgcaaggtcgcaggtcgcaacccgcgggcggaggggcaggcacaggaccgttgcgttgctgccgccgccagcacgagatcgaggagggatcccccgctctcacgccgctccaggtcgagggccgagcgagatggtgaacaccttcttcctcttctgcgggtgcgtggaccaggccagcgtggcggtnggtggagaagtggggccgcttcctccgcctcgccgacccgggcctccacttcttcaaccccctcgccggggagtgcgtcgcgggctccctcaccacacgcgtccagtccctcgacgtccgcgtcgagaccaagaccaaggataatgtcttcgtccaactgatctgcacaatccagtaccgtgttgtcaaggaaaatgcagatgatgctttctatgagttgcagaatccccagcagcaaatccaggcctacgtctttgatgttgttcgggccatagtgccgagaatgaatctggacgatctctttgagcagaagaacgatgtggccaaagctgtattggaggagcttgaaaaagtgatgccagaatatggttacagcattgagcacatttctcatgggtgatatcaatccctgaccctgcctgtcgttaggcaatgaacgacataaatgcagccccaaagcttcaactgggcagggtttcaagggagaagccgaagnaatccttatggtggagaaagcggaagcaaatgcaaaagcgaaattcctttctgggggcgggatcgctaaacagcggcagcgaataccgacgggccttaaagaaactcc

SEQ ID NO: 79348 - protein, 38 aa, Zea mays
  misc_feature: Ceres CLONE 1564378
MNLDDLFEQKNDVAKAVLEELEKVMPEYGYSIEHISHG

SEQ ID NO: 79349 - DNA, 908 bp, Zea mays
  misc_feature: Ceres CLONE 1564381
  misc_feature: Encodes the peptide sequence at SEQ ID NO. 79350
ctccccgcggtggcggccgctctagaactagtggatcccccgggctgcaggaattcgtctcacccctagaaaaagatcagctcgcttcgtgacttctctctcctctcgatcgattgcttcctccaccgaggcgggggaaagcgccgcccagatcgccgtaggcaagcggcgatcactccagctttgagcataagggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcgctttgtgatcgatagagaagagtgcttctcgcataacgtggagtatgagggggatactgtccatgtatccttcgtcgtcatcaaggctgacaccccgtggcattacagcgaagaaggcgttgatcttgtggttaaggatcctaatggcgctcaagtccgtgattctcgagataagactagtgataagtttgagttcatagttcagaagagaggcgtccatcgcttctgcttcacgaataaatccccgtaccacgaaactatagacttcgacgtgcatgttggccatttttcatacttcgagcagcatgccaaagatgagcattttgcaccacttttcgagcaaatagccaagttagatgaggcactttacaatatccagtttgaacagcactggctagaggcccaaactgacccgtcagcatattgaacgagaacatgagcagggaggcagtcccacaggcactcttcgagtcggcggcactgatcgtgggcagcgtcatccaggtctatctcctggcgcggctcttcgagcgcaagctggggacgtctagggtataaggctcactggtatccaactctc

SEQ ID NO: 79350 - protein, 169 aa, Zea mays
  misc_feature: Ceres CLONE 1564381
  misc_feature (58)..(121): Pfam Name: EMP24_GP25L Pfam Description: emp24/gp25L/p24 family/GOLD
MEWLSWRTVCCLSVLCTVLFLRPVEGIRFVIDREECFSHNVEYEGDTVHVSFVVIKADTPWHYSEEGVDLVVKDPNGAQVRDSRDKTSDKFEFIVQKRGVHRFCFTNKSPYHETIDFDVHVGHFSYFEQHAKDEHFAPLFEQIAKLDEALYNIQFEQHWLEAQTDPSAY

SEQ ID NO: 79351 - DNA, 939 bp, Zea mays
  misc_feature: Ceres CLONE 1564382
  misc_feature: Encodes the peptide sequence at SEQ ID NO. 79352
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (468)..(468): n is a, c, t, g, unknown, or other
  misc_feature (471)..(471): n is a, c, t, g, unknown, or other
acccgcggtggcggccgctctagaactagtggatcccccgggctgcaggaattcgtctcacccctagaaaaacccgtgccattgccattcacctccagccaggctacggaaccttatcaccaaaatcctcgtcccctacccgaggcgagcatcatggcggccgcgctcttctccagctcgctctcgccccgcttcctcgccctatcctccccgaagccggccgcgcccgcggccacagccttcctccccttcaggctgccgccgcgcgctgtctcggcgccgggtaggcgggtcttcgagcccgtggccgtcgcggtgtcgtcggagtacaagacggagggcgcggagcaggagggggaggatgggatcgagnnnagtctcgaggggactgaagctgtcgtcggcaacctaccgttcagcgtcgacagcgcgcagctcgcagggcttcttcaagcaaggccggctccntcnaaaatggtccaggttgttttttgaacaaattgactgggacgggaccccggggatttggaattcgggacaaatggctttccgcccaaaaaaaccaaaattttgttttccaagaattttaaggggttttgcctttttcaggggaacaacctttagagggaaaacttggggggccccccccccccctggaagagaaaaccccccccaaaaacccccccggggggtgtggggtttggcccccccccccctttttttttatttcccccaaaagagggttttcggggggggaccacttgggggggggggggttaacaccccccctcttggaaaaaccactttttatgagaggaaagggggaagtgtttttttttaaaaacccctctccaacaaaaaaaaacccccccggggggggggggtgttgtttttttaccaaggggggcgccccaagaaagagaaatggtggcttttcca

SEQ ID NO: 79352 - protein, 113 aa, Zea mays
  misc_feature: Ceres CLONE 1564382
  misc_feature (74)..(74): Xaa is any aa, unknown, or other
MAAALFSSSLSPRFLALSSPKPAAPAATAFLPFRLPPRAVSAPGRRVFEPVAVAVSSEYKTEGAEQEGEDGIEXSLEGTEAVVGNLPFSVDSAQLAGLLQARPAPSKMVQVVF

SEQ ID NO: 79353 - DNA, 997 bp, Zea mays
  misc_feature: Ceres CLONE 1564384
  misc_feature: Encodes the peptide sequence at SEQ ID NO. 79354
  misc_feature (458)..(458): n is a, c, t, g, unknown, or other
  misc_feature (459)..(459): n is a, c, t, g, unknown, or other
acccgcggtggcggccgctctagaactagtggatcccccgggctgcaggaattcgtctcacccctagaaaagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttctgcttcgaccccctgggcctggccacggtgccggagaacttcgagcggttcatggagtcggaagtgtaccactgccggtgggccatgctggccgtgccgggggtgctggtgccnngagcgctggggctgggcaactgggtgaagcccatgattgggctggctgtccccggggtcatgccacgtacctggggccccccggtgcctggggggacctgcccaacatccctgggggcgaagttctgggcattccccttcccaaagaaccagggcaccctgggaaaggacccccaaaaaaaaaataacccgggggggccctttaaaccccttggttttccctgggaacccccccagcccgaggaaaaaaccccagggaaaaaaaaaggggcccccccccagtggggcccttcgggtgtttcggcccataaatggggggtaaccgggggccccggtccccataaaaattttggcccccctttgggaacccgggggaaaaaaacgggagaaaaaatctccccctgtattccccccccaaaaaattttgtgttgttattaaaaaaaaaaaaaaaaacccccccgccccgcggaagagaaaaaaaaaacaaaagaggggtgtgtggtcctcccccccccgggttgttttccttttaaaagaa

SEQ ID NO: 79354 - protein, 286 aa, Zea mays
  misc_feature: Ceres CLONE 1564384
  misc_feature (58)..(205): Pfam Name: Chloroa_b-bind Pfam Description: Chlorophyll A-B binding protein
  misc_feature (110)..(110): Xaa is any aa, unknown, or other
MAMASSSSGLRSCSALGVPSLLAPSTSSSSRSGRLPFCAHATTSGRVTMSAEWMPGQPRPAHLDGSSPGDFCFDPLGLATVPENFERFMESEVYHCRWAMLAVPGVLVPXALGLGNWVKPMIGLAVPGVMPRTWGPPVPGGTCPTSLGAKFWAFPFPKNQGTLGKDPQKKNNPGGPFKPLGFPWEPPQPEEKTPGKKKGAPPQWGPSGVSAHKWGVTGGPGPHKNFGPPLGTRGKKTGEKISPCIPPPKNFVLLLKKKKKTPPPRGREKKNKRGVCGPPPPGLFSF

SEQ ID NO: 79355 - DNA, 962 bp, Zea mays
  misc_feature: Ceres CLONE 1564385
  misc_feature (158)..(158): n is a, c, t, g, unknown, or other
  misc_feature (614)..(614): n is a, c, t, g, unknown, or other
tggagctccccgcggtggcggccgctctagaactagtggatcccccgggctgcaggaattcgtctcacccctagaaaaactctagcggcccgcacaaagccgccggagcgccgcgccaccatgtaccggcttttccgccgcagcttctccatggctgnccgaggagttccgccgtccgtccggccctcttttcctttttcaaccccccttccaacttcaatgtcctccaaccccgcgcaaactttggcgggaaaaacctgtaccccccccatctataaagggcgggggcccaaaatctcccttttttccccccccccggggagaaaggggtaatcaaaaaagcggcccttccccccccaaaaaagatttcctcccccccccccccctttaaaaaaaattggggggggcccccccctttttcccccccaaaaaataaaaaaaattttttttttttttggttaaaaaacaaacaccgggggggccccccccccccccctttttttgtgggggggggaagaaaaactcaccctcataccccggcgggggggggggtccccctttattatttaacagagaacgtggtgtgggggccgcccgcccccccccctctctcntaataaaaataaaaaaacgtctcgcggggcaagacgacatctcttccccctattctgggtggggtgggcgcggccacccaccacacttctctctgtaaaaagaaaagaagaaacataccctccctctctttgttgctcttccccccccccccacctcccttaaacacaaaataatttttttcgttgtgtgagagaagaaagaattgtccctctcctcttcatgacctccacaagagggagagttttattctctcccctccttcctccaatgataagtagagtgcgtggtgtgtgagggaccccttttattacttccagaggggccttctccggtagagatatatatta

SEQ ID NO: 79356 - DNA, 940 bp, Zea mays
  misc_feature: Ceres CLONE 1564386
  misc_feature: Translation starting site: 146
  misc_feature (863)..(863): n is a, c, t, g, unknown, or other
ctccccgcggtggcggccgctctagaactagtggatcccccgggctgcaggaattcgtctcacccctagaaaaagtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggctacgggaccgtgggcgggcccaacggccacgccatcgctcccgccacagacaccaagtccaccgccgtcgagaccaccgtcgagagggtgatcttcgacttccggttcctggcactcctcgccgtcgccgggtcactcgccggctccgtcctgtgcttcctcaatggctgtgtcttcatcaaaagagcgtaccaggtttactggtcgagctgtgtcaagggggttcatacggggcagatggtcctcaaggtcgtcgaggcccatcgatgtgtatcttgctggaacagtcatgctgatattttggggatgggtctctacggcctcttcatcagcaacgctccccgcgggtgttcctcctgaatccgaccgtgccctcaacggctcgtcgttgttcgggaatgtcgcttttgaggaacgcccgaagtggatgaacatcacctcgctgacgagctcagacaaaggtggggcacgtcatcgtgatgattctacctggtgaaaagttcgaaaagaacagatggggacgataccacggggctggacctcntcagctaccgatttggatcttctgtcgtcagctctctctaatcctgcaaatcttaaagggcgacctggagaaggaca

SEQ ID NO: 79357 - DNA, 728 bp, Zea mays
  misc_feature: Ceres CLONE 1564389
  misc_feature: Encodes the peptide sequence at SEQ ID NO. 79358
  misc_feature (342)..(342): n is a, c, t, g, unknown, or other
aaagctggagctccccgcggtggcggccgctctagaactagtggatcccccgggctgcaggaattcgtctcacccctagaaaaagcgctaggcgcacgagcgcgaacacgaacacgaacaccataacgcggcggccatggtgggcggcggcggcgacccaaggccggaggacgagcccttctccgacggagacgccacggagtcggacaccgacgagtctcctccgcaggggattagtgctcgccgccccggcgccaccactaacccgatcctgactcgcctcgcggtgtcgcggaacccgagcccgctggccgcggccaccgcggcccccggggtgtgccntcctccgccttcgccctgggagtccgcccgcgggatcccctcgtcggcgcccgtttgtcgggataacggtaaacccccctggtccatgagggaagggtttttaaagggatcatttttcccggaaggctgccttccgtcctgctaaagataatttggcctggccccttggctggggcggtaacaaagggttttggggtaagacccctggcgttcttttttgccaaaaaaacctccccctggggaaaaaagaaaagggaatggggttttcccaaattgcccccgggaaagtggggccccaggggccttttttttttccccccttgggggcccccctttgtgcgccccctttgtaagacctctttttttcccccagggggggggtgccg

SEQ ID NO: 79358 - protein, 116 aa, Zea mays
  misc_feature: Ceres CLONE 1564389
  misc_feature (69)..(69): Xaa is any aa, unknown, or other
MVGGGGDPRPEDEPFSDGDATESDTDESPPQGISARRPGATTNPILTRLAVSRNPSPLAAATAAPGVCXPPPSPWESARGIPSSAPVCRDNGKPPWSMREGFLKGSFFPEGCLPSC

SEQ ID NO: 79359 - DNA, 954 bp, Zea mays
  misc_feature: Ceres CLONE 1564391
  misc_feature: Encodes the peptide sequence at SEQ ID NO. 79360
  misc_feature (749)..(749): n is a, c, t, g, unknown, or other
  misc_feature (905)..(905): n is a, c, t, g, unknown, or other
  misc_feature (906)..(906): n is a, c, t, g, unknown, or other
  misc_feature (908)..(908): n is a, c, t, g, unknown, or other
ctccccgcggtggcggccgctctagaactagtggatcccccgggctgcaggaattcgtctcacccctagaaaaaagcagctcatcagataggcaaacaccaagaagctaagctagcgcgccatgcagacgccgaccatgtcgacgtccatggccaccacggcgccagcgaagccccccgcgccgccgcggcaatgctgcaggtacctcctcctcccctccaccggccaccgccggagcgtggcggcatggtctgccaaaaagaagaacccgtggctggacccgttcgacgatgggcccgacgaggagttcgattaccagggcatgttctccggcgggaagcaggaggaagacccgcggccgcccgaggaccctgagaacccgtacgggttcctgaggttcccgcagggctacaacccggagctggacagcctcgcctccaaggtccgcggcgacgtgcggcgcgcgtgctgcgtcgtgtcgggcggcgtgtacgaaaacgtgcttttcttccccgtcgtgcagatgctcaaggaccggtaccccggcgtgctggtggacgtggtggcgtcggccaggggcaagcaggtgtacgagatgtgcaagaacgtcaggtacgctaacgtctatgaccccgacgacgactggccggagcccgccgaatacacgcacatgctcggcgtcctaaagaataggtactatgatctgatcatctccacgaggctggcggggatcgggcacgctctctccnttttcatgtcgtcggcgcgcgacaaggtcggctacttttaccccaacgtcaacagcgtcggcgcgggcctctttcctcacgagatggtcaggcggcgactaacacctgcgcgacggcggtacacatgtataagacttgctggaatggatcggccgnncngggaaaacgtcccagcagcgacaaagcgctggggggtcatctcaaa

SEQ ID NO: 79360 - protein, 272 aa, Zea mays
  misc_feature: Ceres CLONE 1564391
  misc_feature (205)..(205): Xaa is any aa, unknown, or other
  misc_feature (257)..(257): Xaa is any aa, unknown, or other
  misc_feature (258)..(258): Xaa is any aa, unknown, or other
MSTSMATTAPAKPPAPPRQCCRYLLLPSTGHRRSVAAWSAKKKNPWLDPFDDGPDEEFDYQGMFSGGKQEEDPRPPEDPENPYGFLRFPQGYNPELDSLASKVRGDVRRACCVVSGGVYENVLFFPVVQMLKDRYPGVLVDVVASARGKQVYEMCKNVRYANVYDPDDDWPEPAEYTHMLGVLKNRYYDLIISTRLAGIGHALSXFMSSARDKVGYFYPNVNSVGAGLFPHEMVRRRLTPARRRYTCIRLAGMDRPXXENVPAATKRWGVIS

SEQ ID NO: 79361 - DNA, 912 bp, Zea mays
  misc_feature: Ceres CLONE 1564393
  misc_feature: Encodes the peptide sequence at SEQ ID NO. 79362
  misc_feature (635)..(635): n is a, c, t, g, unknown, or other
  misc_feature (803)..(803): n is a, c, t, g, unknown, or other
  misc_feature (804)..(804): n is a, c, t, g, unknown, or other
  misc_feature (813)..(813): n is a, c, t, g, unknown, or other
  misc_feature (846)..(846): n is a, c, t, g, unknown, or other
  misc_feature (854)..(854): n is a, c, t, g, unknown, or other
  misc_feature (855)..(855): n is a, c, t, g, unknown, or other
acccgcggtggcggccgctctagaactagtggatcccccgggctgcaggaattcgtctcacccctagaaaaagaccgatagaacacgaccttaggggttcagatcggatcggaagcttccataagtttccatcgggcgtcgccggtatggcgatccgcaaggggtcttcgtacgccgtcgcggcacttctcgcgctcgcctctgtcgccgccgtcgcaggggaggtcttcttccaggagaagttcgaagatggctgggaaagtaggtgggtcaagtctgagtggaagaaggatgagaacatggctggtgaatggaaccacacctcgggaaaatggaatggagatgccgaggacaaaggtattcaaacctccgaggattacaggttctatgccatttcagccgaataccctgagttcagcaacaaggataagaccctggtgctgcagttctctgtgaagcacgagcagaagcttgactgcggcggtggctacgtcaaattgctgggtggtgatgtagaccagaagaaatttggtggagacacatcttacagcattatgtttggaccagatatctgtgggtacagcaccaagaaggttcacactatcctgaccaaggatggcaagaaccacttgatncagaaggatgtgccttgtgagactgatcagttgactcatgtttacactttgatcatccgtcctgatgcaacatacagcattctcattgataatggaagagaagcaactggcagcatctacgagcattggggatatcttcccccctagaaatcaaggacccagagctannaagctggangactgggatgacaaggagtacattcttgacccntgagacanngagcagagggctatgatgattttccaaggaaatcctgaccctgatgctaagagctga

SEQ ID NO: 79362 - protein, 211 aa, Zea mays
  misc_feature: Ceres CLONE 1564393
  misc_feature (27)..(212): Pfam Name: Calreticulin Pfam Description: Calreticulin family
  misc_feature (163)..(163): Xaa is any aa, unknown, or other
MAIRKGSSYAVAALLALASVAAVAGEVFFQEKFEDGWESRWVKSEWKKDENMAGEWNHTSGKWNGDAEDKGIQTSEDYRFYAISAEYPEFSNKDKTLVLQFSVKHEQKLDCGGGYVKLLGGDVDQKKFGGDTSYSIMFGPDICGYSTKKVHTILTKDGKNHLXQKDVPCETDQLTHVYTLIIRPDATYSILIDNGREATGSIYEHWGYLPP

SEQ ID NO: 79363 - DNA, 682 bp, Zea mays
  misc_feature: Ceres CLONE 1564395
  misc_feature (169)..(169): n is a, c, t, g, unknown, or other
  misc_feature (531)..(531): n is a, c, t, g, unknown, or other
  misc_feature (534)..(534): n is a, c, t, g, unknown, or other
agctcccgcgggcggccgctctaactgtggatcccccgggctgcaggaattcgtctcacccctagaaaaatcttctcgaccagatccggaagttctgtgggtagaggactagagactgcagatcgagggtctggcagcgggccgtggcagttgggtgattacgaccaanaaaaaatgggccctccttttgaaaaatttgggacaacccctccaggcccgcccccggaaccgggcttggccccctcccaaaacacccctggggttccccccccccttaaaaaattggggttcccccccgggaaccccctcgggtttttttgcccccccccccccgttttttctgaaacaagaaaaaacccccccgggaaaggggcccccccccccctttttttaaaaaccccccccccccggggggggcaccctttttttttccccaaaaaaaaaaggggggggaaaaaaaaaaacccccccccccgggggggttttttttggcggggggggggggaaaccaaccccccccccccccaattnttntttttttttttttttccccccccccccggtttgtttttttttttttttaaaaaaaaaaaaaaaaaaaaaatttctccctccccccccccccccccccaaaaaaaaaggggggggggggggcccccccccccccccccccgggaagaaa

SEQ ID NO: 79364 - DNA, 840 bp, Zea mays
  misc_feature: Ceres CLONE 1564396
  misc_feature: Encodes the peptide sequence at SEQ ID NO. 79365
ctggagctccccgcggtggcggccgctctagaactagtggatcccccgggctgcaggaattcgtctcacccctagaaaaagcgacaccagcatcgacagctccatcgattcatccaccgctatctctctctctttcaactgcgagggaaaccgagctcaaagtggcaaccatcaatggatattatggccgcttaatgcgagaaacaaggagcagtacgggaacaaccatcacgggctcgggctgagcctcagcctcagcctcggcgacgccaccgaggctacggtcgaggtcaagcccccgccatcgccgcggcagcagcagcagcgagctatcagtgtcgcgcacatcaactcactcaccacgccgcattggtggaagtgcaacatccctggtctcttcatcgagacgacgatggatccatctctggagacgaacagactcagcagcagctcggtgtcgttgcgcaatgccacgagatgccgttcctgacgggggtggacgtgaaccaggcccctgcctgggagacaaggaggggtatctgcaacaaggagcaaccagaaccctgtggcggcgtattcctggacaacaggaaggttttctagaaacttaacggggaaaactccaccttccagaaataacaggctaaaaggggccaaaccaacccctgaaaacggagggggggaccaaaacaaagaattcccgcggggggtcccgcaaaaaatttccccctttcaaaggacaggtccccccctctccttaaaaggggttcaagggaggtaaaaaacctccacccccaaattaaaaaggggggcccccgaaaaaaccctacaccaaaaggc

SEQ ID NO: 79365 - protein, 41 aa, Zea mays
  misc_feature: Ceres CLONE 1564396
MPFLTGVDVNQAPAWETRRGICNKEQPEPCGGVFLDNRKVF

SEQ ID NO: 79366 - DNA, 866 bp, Zea mays
  misc_feature: Ceres CLONE 1564398
  misc_feature: Encodes the peptide sequence at SEQ ID NO. 79367
  misc_feature (768)..(768): n is a, c, t, g, unknown, or other
  misc_feature (771)..(771): n is a, c, t, g, unknown, or other
  misc_feature (866)..(866): n is a, c, t, g, unknown, or other
ggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaaccccgaggcctcgccgagctcaaggtgaaggagctcagacngcngccctcgcattgttttcatgttcggctttcttcgtcaggccatcgtcaccgggcaggggccgctcgagaaactcgctgaccacatcgctgacccn

SEQ ID NO: 79367 - protein, 239 aa, Zea mays
  misc_feature: Ceres CLONE 1564398
  misc_feature (61)..(213): Pfam Name: Chloroa_b-bind Pfam Description: Chlorophyll A-B binding protein
  misc_feature (213)..(213): Xaa is any aa, unknown, or other
  misc_feature (214)..(214): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFDPLGLADEPRGLAELKVKELRXXPSHCFHVRLSSSGHRHRAGAARETR

SEQ ID NO: 79368 - DNA, 862 bp, Zea mays
  misc_feature: Ceres CLONE 1564399
  misc_feature: Translation starting site: 246
  misc_feature (744)..(744): n is a, c, t, g, unknown, or other
  misc_feature (753)..(753): n is a, c, t, g, unknown, or other
  misc_feature (773)..(773): n is a, c, t, g, unknown, or other
  misc_feature (781)..(781): n is a, c, t, g, unknown, or other
ctggagctccccgcggtggcggccgctctagaactagtggatcccccgggctgcaggaattcgtctcacccctagaaaaagcgggcgcgcgtccctgtttcgctcgtgccgttgcgctgcgccaagcctccccacctctctcgtctcttctccacccgccgccctcgtgggagtgaaaccctagctagggttctgcccgccgccgccttcgatcaagacgccagcagccttagcgcgagcccgccatggacacaggacgcaagcgcgtcgcgccggggggcgccaacggcgcgggcggcccgaagcgcgcgagagaatcggagacaactcaaatgggtgtaggaagcaaaaccaagccgtgcaccaaatttttcagcactgcgggttgtccctttggttcaaattgccattttctccataacttccctggtggctacctggcggtttcaaagatgaccaacttgggtgggccacctgttccggctcccccaggaaggatgcctatggggacctggtggtcctgatgggccaccttcacctgctctgaagactcgcttgtgtaacaagtacaacactgcagaaggatgtaaatgggggagcaaatgccactttgctcatggagagagggagcttggaaagcccctgcagatggacaactcgatgggagctcctccaatgggtccagggcccaaacggtcacttcatgcccacctcaaatgctatccccagatatggttcctcacntccacattncggtgcttcggccacagccnaagatcangtgtcgatgcatcccctttgctgcgccatccattgggggaagagtggtatccacacaaagccctattatcccggatggact

SEQ ID NO: 79369 - DNA, 902 bp, Zea mays
  misc_feature: Ceres CLONE 1564401
  misc_feature: Encodes the peptide sequence at SEQ ID NO. 79370
  misc_feature (454)..(454): n is a, c, t, g, unknown, or other
  misc_feature (564)..(564): n is a, c, t, g, unknown, or other
ggagctccccgcggtggcggccgctctagaactagtggatcccccgggctgcaggaattcgtctcacccctagaaaaaagcaggcacagacagcagcatcgatcggatcggagcagcacagcgcgcgtcaccgcaagctcaagtgtcttcttccttgcttgcttgcctgcttacctctcagttccccactcacgtctcttgccgtacgtacgtgcgtccaacacaccaggtgaaaatgggctcggagacggagacggtcaacgtggaaggcatcccgttcccggcggagatcaccgtcggcaaccctctctccctcctaggcacaggcatcacggacatcgagatccacttcctgcagatcaagtacaacgccatcggagtctatctccacaacgccggcggcggcgacagcaccacgctgctgggccacctcggggcctggaagggcaagacngcggaagagctccctagcgacgccgcccttctgggcccgcgctggtgggcggcccccgtccagaagcttgttccgcgtcgtggtcatcaaggagaatcaggggctccaantacggcctgcagcttgaaaagtccgttcggaaaccgctttgccgccgccaaactttacgaagaaccaacaaaaaaaaagcccctcaaaaaagtcccccaaattctttccaatccaagttatttaaaggcgggggccccgggggacacctttccaatttcccgagaacggggcttcccttcccccggagacccggggggaaaaaacccttttccaaagggggaaagggggaacccccgattcccgggggaaaaagaaaaaacccccggggaaaaaaaaaaaaatggtatcctcggggagaaaccccggggggtcccccaaaaaatttcgaagggggggc

SEQ ID NO: 79370 - protein, 222 aa, Zea mays
  misc_feature: Ceres CLONE 1564401
  misc_feature: SWISSPROT Homolog: EC 5.5.1.6 Chalcone isomerase
  misc_feature (110)..(110): Xaa is any aa, unknown, or other
MGSETETVNVEGIPFPAEITVGNPLSLLGTGITDIEIHFLQIKYNAIGVYLHNAGGGDSTTLLGHLGAWKGKTAEELPSDAALLGPRWWAAPVQKLVPRRGHQGESGAPXTACSLKSPFGNRFAAAKLYEEPTKKKPLKKVPQILSNPSYLKAGAPGDTFPISRERGFPSPGDPGGKNPFPKGERGNPRFPGEKEKTPGEKKKNGILGEKPRGVPQKISKGG

SEQ ID NO: 79371 - DNA, 859 bp, Zea mays
  misc_feature: Ceres CLONE 1564402
  misc_feature: Translation starting site: 205
  misc_feature: SWISSPROT Homolog: EC 1.3.1.33 Protochlorophyllide reductase
  misc_feature (421)..(421): n is a, c, t, g, unknown, or other
  misc_feature (726)..(726): n is a, c, t, g, unknown, or other
  misc_feature (730)..(730): n is a, c, t, g, unknown, or other
  misc_feature (736)..(736): n is a, c, t, g, unknown, or other
  misc_feature (739)..(739): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
ctggagctccccgcggtggcggccgctctagaactagtggatcccccgggctgcaggaattcgtctcacccctagaaaaaatccccccgcggagaggagaggaagaagaacccagccaaatcctcagtcctcaggcagtcaggctgctcgcagctcgtgccgtccactctcccccgaggcagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtgacccccngcgtcgccgtctggcaaagagaccctccgcaagggcacggcggtcatcaccggcgcgtcgtccggcctcggcctcgccacggcgaaagacctggcggagacaagcaaatggcacgtcatcatggcctgccgcgaactcctcaaagagtcacgcgccgcaaaagcggcggcatggacaagacagcttcaccgtcgtgcaccttgacctccctccctggacagcgtcccgcagtccgtcaggaccgtgcccagctggagatgccatccaacctggtgtctgccaacccgccgtgtacccagccaccnccanaggagnctncttaaccgccgaaggtttccaaagaacgtcggcgtcaacaacctgggcaccttctcctcnnnngccggagctccttaaaggaactcgaattgctcgatacccctttaagcgcctatcatc

SEQ ID NO: 79372 - DNA, 854 bp, Zea mays
  misc_feature: Ceres CLONE 1564403
  misc_feature: Encodes the peptide sequence at SEQ ID NO. 79373
  misc_feature (714)..(714): n is a, c, t, g, unknown, or other
  misc_feature (771)..(771): n is a, c, t, g, unknown, or other
tggagctcaccgcggtggcggccgctctagaactagtggatcccccgggctgcaggaattcgtctcacccctagaaaaacctttgtcctgtctcctcccacccttgcctccgagtcacctcctcccttggtctccgccgtcgctgcctccttgccggaaccctaaatggaccccggcgccggcgcacactactccgtccgtaccgcggaggaggttttccgcgacttccgcggccgccgcgcgggcatgatcaaggccctcaccaacgatgtggagaagttctaccagctgtgtgaccccgaaaaggaaaacttgtgcctttatggctaccccaacgaaacatgggaagtaactttgccagcagaggaagttcctccagagatccctgaaccagctttgggtataaactttgctagggatggcatgaatgagaaggattggttagcgctagttgctgtccacagtgattcctggttactagcagttgcattctactttgcagcccggtttgggtttgacaaagaggccagacggcggctcttcaacatgataaataacttgcccacgatatttgaagtagtgactggggttgcaaataaacaaaacaaggagaagggccccaatagtaccagcaaaagcaacaaaacaagttcaaaaatgacatcaagacccgagtctcattccaaggcgacaaaagtggcagtgccccctaangatgacgatgatgagagcggtgaagaatatgaggaggaagagcgtaataaccccttnatgtggatcctgtggaacaatgacggcaaggacgaattctggatctgtttgtgaaagttgtgagcgtggtacccatgggaagt

SEQ ID NO: 79373 - protein, 219 aa, Zea mays
  misc_feature: Ceres CLONE 1564403
  misc_feature (183)..(183): Xaa is any aa, unknown, or other
  misc_feature (202)..(202): Xaa is any aa, unknown, or other
MDPGAGAHYSVRTAEEVFRDFRGRRAGMIKALTNDVEKFYQLCDPEKENLCLYGYPNETWEVTLPAEEVPPEIPEPALGINFARDGMNEKDWLALVAVHSDSWLLAVAFYFAARFGFDKEARRRLFNMINNLPTIFEVVTGVANKQNKEKGPNSTSKSNKTSSKMTSRPESHSKATKVAVPPXDDDDESGEEYEEEERNNPXMWILWNNDGKDEFWICL

SEQ ID NO: 79374 - DNA, 872 bp, Zea mays
  misc_feature: Ceres CLONE 1564407
  misc_feature: Encodes the peptide sequence at SEQ ID NO. 79375
  misc_feature (812)..(812): n is a, c, t, g, unknown, or other
ggagctccccgcggtggcggccgctctagaactagtggatcccccgggctgcaggaattcgtctcacccctagaaaaaaagcaagcacacagcgagcacgcgccggcatccttggcacttggcagcgatctgcttgcttctcccagcgcgcgcggccaagctagtaggggtctaggggatcgatcagatatcaacgccatggccgccgcctccaccacgacgaggaccaactcgcgggtgaactactcgaacgagatccacgacctctccaccgtgcaaagcggctccgtcgtccccaccttgttctacccggacaagtccatcgccgacatcttcccgccgcaccttgggaagaaggagatctcggaggtggtggcgacgttccttctggtgttcgtcacctgcggggcggcgtccatctacggcgaagacaacaggtgcatctcgcagctggagcagtcggtggccggctggctcatcgtcaacgtcatgatgtacgccaccggccacatctccggcgcgcacatgaaccccgccgacacgctctccttcgcatgcttccggcatttcccatggattcacgagccctactactgcgaggcagcagtcacgggagcgatgctgcgcagagttcgtgcttcaggcggtgctccagcccatggacgagatcggcaccaccacgacctcggggtcgcactggtacgggcttcctcatcgagatcctcgatcacctccaacatgaatgtagtgaacctggggcgttcgcaccgaattcaagggagggtgggtggaattagcaaagggttacccgncccgtttaccccggatggccttacatccatcgtttcccagggccggggtttcggcgcaaa

SEQ ID NO: 79375 - protein, 224 aa, Zea mays
  misc_feature: Ceres CLONE 1564407
  misc_feature (44)..(205): Pfam Name: MIP Pfam Description: Major intrinsic protein
  misc_feature (205)..(205): Xaa is any aa, unknown, or other
MAAASTTTRTNSRVNYSNEIHDLSTVQSGSVVPTLFYPDKSIADIFPPHLGKKEISEVVATFLLVFVTCGAASIYGEDNRCISQLEQSVAGWLIVNVMMYATGHISGAHMNPADTLSFACFRHFPWIHEPYYCEAAVTGAMLRRVRASGGAPAHGRDRHHHDLGVALVRASSSRSSITSNMNVVNLGRSHRIQGRVGGISKGLPXPFTPDGLTSIVSQGRGFGA

SEQ ID NO: 79376 - DNA, 857 bp, Zea mays
  misc_feature: Ceres CLONE 1564408
  misc_feature: Encodes the peptide sequence at SEQ ID NO. 79377
ggagctccccgcggtggcggccgctctagaactagtggatcccccgggctgcaggaattcgtctcacccctagaaaaactcgaccgctaaccttaccggtccccaaatgtcgcctctcgtgctgctgctcctcgcgcacctactcgccacggccactgcagcgggagcagcgcggaccagggacgacgggcctcctgctccgtcgtcgtcgtccccgcgggtgccggcgacgacgccgccgtggccggaccagttccacgcggtggtggtgacgaacctgagcgcgcgcggcggcgggctgcagctgatcgacctgtactacgactggccgcgagggcgcgacctgaacatcgtccgcgaccagctgtccggcgagcggcgctggagctggaacgtggagtggagcaacggcaccgccttcctgttcgactccgcgtcctgccgcaccttccagttcgccgtgggcctcctgccgcccgactggaaggcccgcggcgccgcctacctggggcgcgaccgcgtcgacggcttcgactgccacgtctggtccaacttcgtcttcgcccgctactacgaggacgtcgccaccggacgccccgtcagctggaacttcaatgtgctgcagcggcatgtgctgagcttcgagtcgggggcagtgctgcaggactcttttcagtggcaggcgccggcttactgcttcaccacaccaatggcagcagtgccgacgccgccgcatcgtcttcctgagatccgtcgctggggcctcggagtccgggctccactgcagctgacgctgcatgtcatttgcagtcgctctcatcttgatggtgactcaggaagcttttactatagtcaga

SEQ ID NO: 79377 - protein, 250 aa, Zea mays
  misc_feature: Ceres CLONE 1564408
MSPLVLLLLAHLLATATAAGAARTRDDGPPAPSSSSPRVPATTPPWPDQFHAVVVTNLSARGGGLQLIDLYYDWPRGRDLNIVRDQLSGERRWSWNVEWSNGTAFLFDSASCRTFQFAVGLLPPDWKARGAAYLGRDRVDGFDCHVWSNFVFARYYEDVATGRPVSWNFNVLQRHVLSFESGAVLQDSFQWQAPAYCFTTPMAAVPTPPHRLPEIRRWGLGVRAPLQLTLHVICSRSHLDGDSGSFYYSQ

SEQ ID NO: 79378 - DNA, 872 bp, Zea mays
  misc_feature: Ceres CLONE 1564410
  misc_feature: Translation starting site: 115
  misc_feature: SWISSPROT Homolog: EC 2.1.1.146 (Iso)eugenol O-methyltransferase
  misc_feature (700)..(700): n is a, c, t, g, unknown, or other
  misc_feature (766)..(766): n is a, c, t, g, unknown, or other
  misc_feature (851)..(851): n is a, c, t, g, unknown, or other
agctccccgcggtggcggccgctctagaactagtggatcccccgggctgcaggaattcgtctcacccctagaaaaaagcgcacacacatacacaagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagcacggaggaggagcggtaccgcatcagccccgtgtcctacctcctggtggacggcatccctcacgaggaccacatgaaccacaccgctctggtgctcacctgcacctcgacgcgctacatcgaggcggggataggggctggcggagtggttcaagagggacgtggtcacgtcaccgttcgaggagctgcacggggcgactctgttccacgagagcatggggagcctcgacgcagatttccacgacatggcgagcgaggccttggacgcccacgacaacttcggcatcgagatagctatgcgggagttcagggactgnttcgaggggatccagtccatgacctactgctgcggtaaactcggtggatgacaagggtgccagggncattgtcaaagcctcccacccataaaatgcactgtgctggcccctcccaagatcattgccaccaaccgggcgatggacagagatnaactttgtccaaggtgacatt

SEQ ID NO: 79379 - DNA, 633 bp, Zea mays
  misc_feature: Ceres CLONE 1564411
  misc_feature: Encodes the peptide sequence at SEQ ID NO. 79380
  misc_feature (554)..(554): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (564)..(564): n is a, c, t, g, unknown, or other
  misc_feature (565)..(565): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (610)..(610): n is a, c, t, g, unknown, or other
  misc_feature (611)..(611): n is a, c, t, g, unknown, or other
  misc_feature (613)..(613): n is a, c, t, g, unknown, or other
  misc_feature (614)..(614): n is a, c, t, g, unknown, or other
ctccccgcggtggcggccgctctagaactagtggatcccccgggctgcaggaattcgtctcacccctagaaaaaccctccatcaaagaaaagggcggcaggccgggggaggggaaggggctgagcatcagagcatgacgtcgggagcggcggcggtgggaagcctcgggcgggagcccgacttggaggagccggagaaaccacaagcccccgggagcccccggggagggcccattcccccaaagtttttagggggtttccggggggtttttggggaaaaataaaaatgtgcccccaaaaatttgttggaaaaaaaaaaaaaaggggggggttctctaagggggggtttttttttcccccccagaaggggggggggggggggggggggtgttttttttttttggaaaaaaaaaaaaaaaaaaccccccccccccccccccccccccccccccccggaggggggggggggggtggggtttttttcccccaccccccccccccccccccccccccggggggggagagaaaaaaaaaaaaaaaaaaaaaaaaaaaaanagannnnncnnttttnnnnnntttttttttttttttcttccccccctctcctcctnnannccgggaggggggggggggg

SEQ ID NO: 79380 - protein, 49 aa, Zea mays
  misc_feature: Ceres CLONE 1564411
MTSGAAAVGSLGREPDLEEPEKPQAPGSPRGGPIPPKFLGGFRGVFGEK

SEQ ID NO: 79381 - DNA, 848 bp, Zea mays
  misc_feature: Ceres CLONE 1564413
  misc_feature: Translation starting site: 238
ggagctccccgcggtggcggccgctctagaactagtggatcccccgggctgcaggaattcgtctcacccctagaaaaaataggaaaagggcaaaagccaaaacgtatggtcgctggaacaacaatggaaacatgagtaccaagccgaggacaccctgatgtatcctgccaacatatgcggccgggacgccctatgcctggctggagaacgcgcacgacatcgcaactcacgtgcgagatgttcggcgtcaacgccgagcgcctgccgatcacgagcaccctgcaggacctcgccaccgcgtgcgtccacgcgtggaagctcgccggcttcgcactaggaagcttggggctcctcatcttgggcgcgatcgaggacgacagccccaagaagctgacctacaacgagatccacagcaaaacctacatgcaggtgaagggtacgggaactcgcgaaccagtggcgcatcatcgacagccgtgtggagtcgttcgcgttcgaggccggcaagtacgagatgaagaagctgtgcctggatccgacatccttgtcgtgctagcagatggcatcgccgagaatggaccgcacgaatatcataatacaagctcatgacaagcctcacgtacactctagagcagatccagggcctgtcgaggtacgatctcaggaagacaagatttcaagagcaggaccgcattgacctagacttcgtcacctacatgtcccggggggccaacacctgccggttcttctttccgtaaatcatcttctcaccccggatagccccaacatttgggggggccgtcgtcggaacaagaaaccggggttcctgggttatggaacccaaggac

SEQ ID NO: 79382 - DNA, 867 bp, Zea mays
  misc_feature: Ceres CLONE 1564414
  misc_feature: Encodes the peptide sequence at SEQ ID NO. 79383
  misc_feature (624)..(624): n is a, c, t, g, unknown, or other
  misc_feature (778)..(778): n is a, c, t, g, unknown, or other
  misc_feature (800)..(800): n is a, c, t, g, unknown, or other
ctggagctccccgcggtggcggccgctctagaactagtggatcccccgggctgcaggaattcgtctcacccctagaaaaactcacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggctgctgctgctcctcctgctggtgccgaggagcccgccgcggccgagcctgtcgccgaggcagaggctgctgcntccgaagagctcgccgcggacgagccggaggctcctgctcctgctcctgctggtccccaggagcccggcgccgaggcggaagctgctgctcctgaggacccgaaaagccagcgagtgagggcgtgcgcacgcagcggcggcggcagggccaggncccaaggggatcggcgtgcgcnccttggcgggtatcctctcgcgcccgtacatgcagtatgaacgggattttgctgtcagtacctacgg

SEQ ID NO: 79383 - protein, 202 aa, Zea mays
  misc_feature: Ceres CLONE 1564414
  misc_feature (183)..(183): Xaa is any aa, unknown, or other
  misc_feature (190)..(190): Xaa is any aa, unknown, or other
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPAVEQEAAAEEEAAAAPPAGAEEPAAAEPVAEAEAAASEELAADEPEAPAPAPAGPQEPGAEAEAAAPEDPKSQRVRACARSGGGRARXQGDRRAXLGGYPLAPVHAV

SEQ ID NO: 79384 - DNA, 1286 bp, Zea mays
  misc_feature: Ceres CLONE 1564416
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (69)..(69): n is a, c, t, g, unknown, or other
tggggggggcccccctctttttttttgtggggtgctatttggcgacccccgaagaaanncnacnncncnaaaactggggctcccccccgtggcggccgctctacaactagtggatccccccggctgcacgaattcgtctcacccctacaaaaagaggcagagaggtgccaacaaaagtcacgtagagaccagccggccggccggactgcatctcgtgctcgacgatgacagccgggaccatgcgtgtgctaggcggggaggtcagcccgtccacagggccggcgcgcctggcgctggatctgccgagcgcgggacaccagctcgtgggaccagccattggggcgcaagaaaaactgagagctacctcacttcaaccccctcaacgggaagatccccgtgcggggcctcggccacggtcgggccagatgggagttcccaggtagatgtgcccgacatcgatgaagagggcgcgacacccccccaccgcgccccaggcatggcgtcctggcttgtcgaaggaccacgccttaacatagggggccaagcgacggcgttttagggaagccccccttcaatccagcgaaagactgtcagatacacggcgtcttgggaaagtccacagctacccacaggggaagccgagcccccggggacaaacacagatcgcggccacgagaggtccccaaaagaagaatccccaatctcccctgcccaaataataactctctttccctgggggaagagaaaggcgagtttatttgccttgaaacgcctccgagtctaataatgggggattgcgaggaaggctccataggatgcctacaatgcgctggtggttgagggagaaaataagaccagagagagcgttcctaaagaagtgctacaacagcagggccgataaccagcgggggatccccgctcaggggggcacacagtcgttctataggcattcaccagagcggcgctcttgcagcatatgtagtccctttagcggagagagaacgcgctcttcctgtgtagaggagccgcccctacgctcgccacttctagtaggggcagcaagaatgtacgacctcaaatactgtcccggataggactgtgacttccttgggtcttatatagaggacggctccgcattgagacgacgcggagggacaagctcctgtgtggggcggacgcgccgacgatctgttggtaggatgaacacacaacaccacgattgcggaggcctgcaaggttcgcgtacacggggttattaagaggagagcaccctcacgacgaggagg

SEQ ID NO: 79385 - DNA, 652 bp, Zea mays
  misc_feature: Ceres CLONE 1564417
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
tccccgcggtggcggccgctcagaatagtggatcccccgggctgcaggattcgtctccccctagaaaaaatcgcaccgcatcatcaccccacgcaggtagggttttccttcctttcggcctcgccgcgtcgatctccgtcaatccaccttcgcccgcccccctacccaaacccctaggggctttccaaggtcccaaggctttgcccgtttgaatggggggccccaaaaaaaaaaaaagttttccccttttttagaaaaaaaaaaaaaagtttttttttttccccaggaaaaaggggggaaaaaaaacccgcccccgggggccccgggggggggggaaaaaaaaaaattcccaaaaggggggccaaaaaaaaaaaaaaaaagggggggaaaagtttccccccccccccaaaaaaaaaaaaaaaaaaaaaagacccccctccccccccccnnnnnngggggggggggaaaaacaaaaaaaaaaaaatataggggggggccccccccccccccccctttttttttttccccgggggaaaaaaaaaaaaaaaaaaaaaaaaaagggggggcccccccccccccccccccccccccttctttttttaaataaaaaaaaacaccccccccccccgaacccagaaagaagggaggaaaa

SEQ ID NO: 79386 - DNA, 852 bp, Zea mays
  misc_feature: Ceres CLONE 1564422
  misc_feature: Encodes the peptide sequence at SEQ ID NO. 79387
  misc_feature (601)..(601): n is a, c, t, g, unknown, or other
  misc_feature (622)..(622): n is a, c, t, g, unknown, or other
agctccccgcggtggcggccgctctagaactagtggatcccccgggctgcaggaattcgtctcacccctagaaaaaacgccgctgctccaagaaaccaccgccgagcccaaccgcacaagcgcgcgaggcaggagagagagagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggtatccagggcatcgcctggtccttcggaggaatgatcttcgcgctcgtctactgcaccgccggcatctccggaggacacatcacccagctgtgacttttcggctgtttctagccagaagctgtccctgactagggcccctctctacattatcatgcaatgcctgggntgccatctgtggagcttgaantggttaaaggcttccaccagggacttttactgggcaaaggtgggtgggccccatgtttgtcccccctggctccccccagggggaatggccttgggcccttaaaatttttggcccctttcatctaagtttaaccggtttttttcacccccccaattcccaaagagaattcccggggactcccccggtgtccttttcttgcccccctgggcacatggggggttcccgggggg

SEQ ID NO: 79387 - protein, 119 aa, Zea mays
  misc_feature: Ceres CLONE 1564422
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHITQL

SEQ ID NO: 79388 - DNA, 849 bp, Zea mays
  misc_feature: Ceres CLONE 1564424
  misc_feature: Encodes the peptide sequence at SEQ ID NO. 79389
  misc_feature (546)..(546): n is a, c, t, g, unknown, or other
  misc_feature (551)..(551): n is a, c, t, g, unknown, or other
  misc_feature (553)..(553): n is a, c, t, g, unknown, or other
  misc_feature (623)..(623): n is a, c, t, g, unknown, or other
  misc_feature (647)..(647): n is a, c, t, g, unknown, or other
acccgcggtggcggccgctctagaactagtggatcccccgggctgcaggaattcgtctcacccctagaaaaaaccccagttcgccgtctacgcgctccgtctcccccaaaccccacctcctcgccggaaccctagcccccgccgacgcggcgccatgagggagatcctccacattcagggcggacagtgcggtaaccagatcggtgcgaagttctgggaggtgatctgcgacgagcacggcatcgaccacaccggcaagtatgccggcgactccgacctccagctcgagcgcatcaacgtctactacaacgaggccagcggcggccgcttcgtcccgcgcgccgtcctcatggaccttgagcccggcaccatggactccgtgcgctcggggcccttcggccagatcttccgccccgacaacttcgtcttcggccagtccggcgccggcaacaactgggccaagggccactacaccgagggcgccgagctaatcgactccgtgctggacgtcgtgcgcaaggagggcgagaattgcgactgcctccnagggntnccagtctgccactcgctgggagggagtactgggtcaggaatgggcaccctgctcatctctagatcagggnagagtacccggatcggatgatgtnaacattctctggtttcccgtcccccaagtgtctgaatctgtagtggagccctacacgcaacgttctcggttcccagcttcttgaaaacccaaaccagtgcatggtgctcaacaacgaggcttctatgaatttggtttccaacgtttaagttttcccccaaaccttgggggatttaacccctttttttgtgaaaagggggggt

SEQ ID NO: 79389 - protein, 162 aa, Zea mays
  misc_feature: Ceres CLONE 1564424
  misc_feature (45)..(162): Pfam Name: Tubulin Pfam Description: Tubulin/FtsZ family, GTPase domain
  misc_feature (131)..(131): Xaa is any aa, unknown, or other
  misc_feature (133)..(133): Xaa is any aa, unknown, or other
  misc_feature (157)..(157): Xaa is any aa, unknown, or other
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRKEGENCDCLXGXPVCHSLGGSTGSGMGTLLISRSGXSTRIG

SEQ ID NO: 79390 - DNA, 877 bp, Zea mays
  misc_feature: Ceres CLONE 1564426
  misc_feature: Encodes the peptide sequence at SEQ ID NO. 79391
  misc_feature (471)..(471): n is a, c, t, g, unknown, or other
ctccccgcggtggcggccgctctagaactagtggatcccccgggctgcaggaattcgtctcacccctagaaaaagccaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggcggttggtcgccgtgcggtccagcgggccggccacgccgccggagatctccgacaaggtgtcggagagcatcaagcaggcggaggagacgtgcgcggacgaccagaagggcgacnccaagtgcgcggcggcgttgggacaaaggtgaaggagctcagcgtcccgggccagccacggccccgcgacagcctcaaagaaaaccaacgcctaccgaccccgcttccagaaagtactggcaaggacaaccccggaactccgaggaagggcccgcattttacgaaaaacttagcttagtcgtaatagctatttaggggccctccaccttgaaagggacaaagggtttgttaccccccttcccaaaagaatggatacttcttcggatgggggcggttaatacctggggaaaagaaacttttttttgttttcaaggccttttttataacccccaaggggtttttttttaacggggggcgcccgcccccacccccccccataggaatatggtgaatacaccaccctggg

SEQ ID NO: 79391 - protein, 99 aa, Zea mays
  misc_feature: Ceres CLONE 1564426
  misc_feature (90)..(90): Xaa is any aa, unknown, or other
MAASTVASLSVPVTTTTFAAAGGGDVLIVVPRRAGAKRVVWFPAAARRGGGRLVAVRSSGPATPPEISDKVSESIKQAEETCADDQKGDXKCAAALGQR

SEQ ID NO: 79392 - DNA, 879 bp, Zea mays
  misc_feature: Ceres CLONE 1564429
  misc_feature: Encodes the peptide sequence at SEQ ID NO. 79393
ctggagctccccgcggtggcggccgctctagaactagtggatcccccgggctgcaggaattcgtctcacccctagaaaaaaccgtagtaccgtaccctcagctagtcagctacctccatccaccagaccagaccataccagaccagaccagaccaatggccctgcgcctaccaatctcatcgtcccacgggctggcctccacgccggcgccaatctccacgacgacgtgccggccggccgtcttggcgacggccgcggcccagaagaggagcctgctgctggcgacggcctccgagacgaggggagtcgcgccggtgaggtccagcgggatcgagacgagcacggtgggtctgggatgtgaggccgtcaccgggcaggtcacggaggtcaacaaggacaccctctggcccatcgtcgaggccgccggcgacaaggtcgtcgtcctcgacatgtacaccgaaatggtgcgggcccttgcaaagggatggcttccgaaattccaggagatgtctgaccaagaacctggatggttgggttcctgaagctcgactggcaccaggacaaccagcccgcttgccaagggagcttgggcataaagggttgtgcccacctttcaaaatcctccagggcggggaagggtctttaaaggaggttaacgggcgcccaagatcggacgaggctggcggcgagccctcggacccagtcagttctgaatggacaaaaaaaccaaagggatccccctaggctcctgtagacccaagaaagaatggatccccgggcccggcaggggtggcaaaaaacctaccgtccttacggcctccttcaaaaattaatgatggatgggggggagtggcaaatatacgggtcaaggttttattc

SEQ ID NO: 79393 - protein, 128 aa, Zea mays
  misc_feature: Ceres CLONE 1564429
MALRLPISSSHGLASTPAPISTTTCRPAVLATAAAQKRSLLLATASETRGVAPVRSSGIETSTVGLGCEAVTGQVTEVNKDTLWPIVEAAGDKVVVLDMYTEMVRALAKGWLPKFQEMSDQEPGWLGS

SEQ ID NO: 79394 - DNA, 877 bp, Zea mays
  misc_feature: Ceres CLONE 1564430
  misc_feature: Encodes the peptide sequence at SEQ ID NO. 79395
  misc_feature (753)..(753): n is a, c, t, g, unknown, or other
  misc_feature (791)..(791): n is a, c, t, g, unknown, or other
agctccccgcggtggcggccgctctagaactagtggatcccccgggctgcaggaattcgtctcacccctagaaaaagcgtctctctgtaaaccacagtccacagccaccaagatcgccgcgctctctccaacatctcctgaccaaagcgaatccagcatcaccggggtccaggaggcagcatggctgacgaccagcagccaccggcgcaacggtactggttcccgtactggacctcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccagaggcgctggcggtggtgtccctgatccacctgcccagccgcagcccacgcggctgtccagcaggccatcgccgtcgccttcccgcgctcagccactgtcgcccattagagagcccaacgcttcaccggcaccggttgccaaagagcacaagcagccttctcctcttcatcataccgagcatggtgttcctaagcaaaaagacatcaccgttccgcaagagaaaaccatccatgaaccgcttgtagcatccaagacacaaacaaagaccccagagaaagaaaaagacaaggaaaagggaaaggagaatgagaaggaaggcagccagctgcacaaggaaaaagataaggagaagaaagacaaggagaaggaaaaggaaaaagataangagaagggaggatcataagataagaaagaccaggatcncaaagagaagaaagaaagaattaagagaagggaggcagccagctacacaggaagcctcagggcgggtgtccgccgacatggtgcac

SEQ ID NO: 79395 - protein, 196 aa, Zea mays
  misc_feature: Ceres CLONE 1564430
  misc_feature (191)..(191): Xaa is any aa, unknown, or other
MADDQQPPAQRYWFPYWTSPAPRPVARPQLSRRETRPAPSPPATASPSRRPSHPQQAATPASRGAGGGVPDPPAQPQPTRLSSRPSPSPSRAQPLSPIREPNASPAPVAKEHKQPSPLHHTEHGVPKQKDITVPQEKTIHEPLVASKTQTKTPEKEKDKEKGKENEKEGSQLHKEKDKEKKDKEKEKEKDXEKGGS

SEQ ID NO: 79396 - DNA, 877 bp, Zea mays
  misc_feature: Ceres CLONE 1564433
  misc_feature: Encodes the peptide sequence at SEQ ID NO. 79397
  misc_feature (660)..(660): n is a, c, t, g, unknown, or other
  misc_feature (745)..(745): n is a, c, t, g, unknown, or other
  misc_feature (809)..(809): n is a, c, t, g, unknown, or other
ctggagctccccgcggtggcggccgctctagaactagtggatcccccgggctgcaggaattcgtctcacccctagaaaaactctcttccacccactgcaaccccaaatctctccttcctcacacacgcgaaggtgagagaccaaagaagaagaagaaggaggagctgctagcgtggaagtgcccaaggcgagagagagacaagctagctaggacggccgcgacaggctagccagccagctgctagctcctgcggacgagccgatggctggcgccgacgtcgacgtcgggacggaactccggctcggcctgccgggaggaggcgccgcggcggccaagaaggacaccatcgacctcaagctgaagctgcctaccgctggcatggaggaggctgctgccgccgccaggccggagccggcagccgagaaggccaagaggcccgccgaggcgccggccgccgatgccgagaagccacctgcacccaaggcacaggccgtgggctggccaccagtccgatcgtaccgcaggaacgccatgaccgtcgtccaggccgtgaggagcaagaaggaagaggaacctgagaagcagcaacagcccgctgctgccaacgccttcgtgaaggtcagcatggacggcgcgccctacctgcgcaaggtggaccntgaagacgtacggcagctacaaggaccctctcgctgcactcaagaatatgttcggcacctttcacgcatctgggaaacagctgancgagggaagaattggttgatccggcgggcgaatccctgaatgaatgtggtcactacttacgaanaaccaagatgggtgactggatgcttggtccggcgacttccccggggggaaaatgtttgtcgaccctct

SEQ ID NO: 79397 - protein, 173 aa, Zea mays
  misc_feature: Ceres CLONE 1564433
  misc_feature (10)..(163): Pfam Name: AUX_IAA Pfam Description: AUX/IAA family
  misc_feature (133)..(133): Xaa is any aa, unknown, or other
  misc_feature (161)..(161): Xaa is any aa, unknown, or other
MAGADVDVGTELRLGLPGGGAAAAKKDTIDLKLKLPTAGMEEAAAAARPEPAAEKAKRPAEAPAADAEKPPAPKAQAVGWPPVRSYRRNAMTVVQAVRSKKEEEPEKQQQPAAANAFVKVSMDGAPYLRKVDXEDVRQLQGPSRCTQEYVRHLSRIWETAXRGKNWLIRRANP

SEQ ID NO: 79398 - DNA, 795 bp, Zea mays
  misc_feature: Ceres CLONE 1564434
  misc_feature: Encodes the peptide sequence at SEQ ID NO. 79399
  misc_feature (634)..(634): n is a, c, t, g, unknown, or other
ctccccgcggtggcggccgctctagaactagtggatcccccgggctgcaggaattcgtctcacccctagaaaaagtccacacgcgaaggcacccagcagcagccgctcccgaactgaggaaccctaccacgcgggcgacggcggtgcgcgaccggtgacgggacagcggcagcgccccctcctccatctgctggtcccaccgcctcctgacgttatccgatactgccaatccccctcttcgccgttgacggagcttaccgaggaaagaagggcagggccatggcgggagccttcgctttccgcctcgtgcctcgcctcgccgcagagccggcggcgagggggaagggtggcggaggaggagccaaccgcgacgccggcagcaggtcgctggtgtcaaagaaaccaaacaagcagcagcatttgtggatcaggaaggagacagctgggtcagggaagaaagctctccgtcttattgatgctgtttcgaagttaccaaatgaaagagaagctatttatggtgcattggacaagtggagtgctttcgaacctggattttctatatagcagcagcaaagctttttggggatgttgaaaaggcgacgaccatggttaaagaataatccggtaacccaantggttgatgagccaaaagaaaggtgctgaacttgacaacatttggaatacctttctggttcgcaatttttttggggataaacggggtaagacaaaaccttaaaccatttttgggaaaaccttgtaataacaaaatttcttaaccccccttcagggggcccc

SEQ ID NO: 79399 - protein, 94 aa, Zea mays
  misc_feature: Ceres CLONE 1564434
MAGAFAFRLVPRLAAEPAARGKGGGGGANRDAGSRSLVSKKPNKQQHLWIRKETAGSGKKALRLIDAVSKLPNEREAIYGALDKWSAFEPGFSI

SEQ ID NO: 79400 - DNA, 852 bp, Zea mays
  misc_feature: Ceres CLONE 1564439
  misc_feature: Encodes the peptide sequence at SEQ ID NO. 79401
aagctggagctccccgcggtggcggccgctctagaactagtggatcccccgggctgcaggaattcgtctcacccctagaaaaagttacctgctgcggagcggagacgacgaccacttccacctcctccccccttccgcacccaatcccatccccctttccaaattccaatttccagcaggccgcccgcgatgcccaagccggcgacggcgaaccggcgccggaagcgcggcggcggcgaggggggcgccgccgatgaacaggccagcagcaagaggaggcccgccaccagcgtgctcacctccctggacgtcaacgacgccccgcgcccggagctccccctcttccagctgagccggcctcgccagcaggcggaacaggacgacgaagaggaggaggtgaccggtgggggcggaggaggaggagcggggtcgttgttgtcatccgcggtcaacggccacgggcagagcccgcaccagcagcggcggctgtgggtcaaggaccggtcgcgcgcgtggtgggagcagtgcagcagcgccgactacccggaggcggacttccggtccgccttccggatggggcgcgccaccttcgcgatgctgtgcgacgcgctgggcgcggccgtggccaaggaggacaccgcgctccgcgccgccatccccgtccggcagcgcgtggcggtgttgccctgtggcggctcgccacgggggagccgctccgcctcgtgtccaagcgcttcggcctcggcatctccacctgccacaagctgggtcctggaggtctgcgccgccatccgggggctcctgatgccgcgcttcctccgctgccccgatgacgccgccgccgaggcgttt

SEQ ID NO: 79401 - protein, 221 aa, Zea mays
  misc_feature: Ceres CLONE 1564439
MPKPATANRRRKRGGGEGGAADEQASSKRRPATSVLTSLDVNDAPRPELPLFQLSRPRQQAEQDDEEEEVTGGGGGGGAGSLLSSAVNGHGQSPHQQRRLWVKDRSRAWWEQCSSADYPEADFRSAFRMGRATFAMLCDALGAAVAKEDTALRAAIPVRQRVAVLPCGGSPRGSRSASCPSASASASPPATSWVLEVCAAIRGLLMPRFLRCPDDAAAEAF

SEQ ID NO: 79402 - DNA, 882 bp, Zea mays
  misc_feature: Ceres CLONE 1564441
  misc_feature: Encodes the peptide sequence at SEQ ID NO. 79403
  misc_feature (525)..(525): n is a, c, t, g, unknown, or other
  misc_feature (527)..(527): n is a, c, t, g, unknown, or other
  misc_feature (542)..(542): n is a, c, t, g, unknown, or other
  misc_feature (544)..(544): n is a, c, t, g, unknown, or other
  misc_feature (554)..(554): n is a, c, t, g, unknown, or other
  misc_feature (560)..(560): n is a, c, t, g, unknown, or other
  misc_feature (584)..(584): n is a, c, t, g, unknown, or other
  misc_feature (649)..(649): n is a, c, t, g, unknown, or other
  misc_feature (656)..(656): n is a, c, t, g, unknown, or other
  misc_feature (672)..(672): n is a, c, t, g, unknown, or other
ctggagctccccgcggtggcggccgctctagaactagtggatcccccgggctgcaggaattcgtctcacccctagaaaaagccgcctctccccactccctctcgtcgccgtcctctcccgttcgcaacgccacgctccccaccgccgaaatggccccgaagcgaggtggcagggcaccggtgccggccaagaagaagacggataaagtgacgaaccctctgttcgagaaaaggccgaagcagttcggcatcggcggcgcgttgcctcccaagaaggacctgcaccgattcgtcaagtggcccaaggtcgtgcgcatccagcgccagcgtcgcatcctcaagcagcgcctcaaggtgcctccggcgctcaaccagttcacccgcaccctcgacaagaacctcgctaccaacctgttcaagatgcttcttaagtaccggcccgaagacaaggctgttaagaaggagaggcttctgaagagggccaggctgagaatgaaggaaaaactgttgaatctagaaaccattngntgtgaagtatggccntnaccatgtganctaccntcatgagcagaacaggctcagctncgtgtcatcgctcatgatgtggatccgattgaaactgttgttgggcttccagccctgtgcagaangaatgangtccatactgcattgntaaagggaaagctccccttgggatcaatcgttcccagaaaactggatcagtctggtgtcttgaccctgtcaaaaaccaggacaaacttttgattctcccaaaacttgggggggtttaagggcgacttccaaggccaatttttaaaaaccggaaaaaatgggggaagggggcaattggggctccaaattcggggccaaaacaaagggcgga

SEQ ID NO: 79403 - protein, 138 aa, Zea mays
  misc_feature: Ceres CLONE 1564441
  misc_feature (126)..(126): Xaa is any aa, unknown, or other
  misc_feature (132)..(132): Xaa is any aa, unknown, or other
  misc_feature (135)..(135): Xaa is any aa, unknown, or other
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAVKKERLLKRARLRMKEKLLNLETIXCEVWPXPCXLPS

SEQ ID NO: 79404 - DNA, 728 bp, Zea mays
  misc_feature: Ceres CLONE 1564447
  misc_feature: Encodes the peptide sequence at SEQ ID NO. 79405
  misc_feature (390)..(390): n is a, c, t, g, unknown, or other
  misc_feature (532)..(532): n is a, c, t, g, unknown, or other
  misc_feature (533)..(533): n is a, c, t, g, unknown, or other
  misc_feature (551)..(551): n is a, c, t, g, unknown, or other
  misc_feature (552)..(552): n is a, c, t, g, unknown, or other
  misc_feature (557)..(557): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (578)..(578): n is a, c, t, g, unknown, or other
  misc_feature (579)..(579): n is a, c, t, g, unknown, or other
  misc_feature (584)..(584): n is a, c, t, g, unknown, or other
  misc_feature (650)..(650): n is a, c, t, g, unknown, or other
  misc_feature (651)..(651): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
ctggagctccccgcggtggcggccgctctagaactagtggatcccccgggctgcaggaattcgtctcacccctagaaaaagtcccgtcccgttacggttcgtctctccacccctagttccccaaaccggggcatcgattcatcgaaccctgcccggagacgcgagcaatcatagacaggcatggcgatcgctcggaccggcgtgtacgtcgacgactacctcgagtactcgagcaccctggccggcgacctgcaaaggattctctccaccatgcgcgagctcgatgacagggcacatggcattatgggtcagaccaaagaacagataaagtatattctaggagtatcatcccatgggtatgacaggtcaaacatgggatgatgatgagtncggagaggatgaagaaggacattgaagctagccagggaacaaaaagggggcctttaaaaaaaattttttttccccccgccagaaaaaataattatttttttttgggggcggcccccccccccccgtattttttttattctgnngggagaggaaagaggagnnaaacncataaaaaatatnnnnaaagnnaaacnccccccgtccccctattttaaaaaaaaaaggaaacccccccccccccccccccccccctaatcccnnaaaaaaaaaaaaaaaaaggtgggggggggggggggggggggggggcggggnnnnaaaaaaaaaaaaaaaaaacaaaa

SEQ ID NO: 79405 - protein, 66 aa, Zea mays
  misc_feature: Ceres CLONE 1564447
MAIARTGVYVDDYLEYSSTLAGDLQRILSTMRELDDRAHGIMGQTKEQIKYILGVSSHGYDRSNMG

SEQ ID NO: 79406 - DNA, 811 bp, Zea mays
  misc_feature: Ceres CLONE 1564449
  misc_feature: Translation starting site: 211
  misc_feature (548)..(548): n is a, c, t, g, unknown, or other
ctggagctccccgcggtggcggccgctctagaactagtggatcccccgggctgcaggaattcgtctcacccctagaaaaggcggataacgcgcgtcggccgtgcaggcaggcaggcaggcagccagccaaggagccaaggaggcgaagcggccgccgtgccgaggaaacagtcgcccagacggccgcgccggttctgagatgctggagcgatgcagaattcgaagggcggcgccggcggcatgggcatgaacatggtgaccacggtgatggccttctcggtcagcgccttcttcgtgctcttcgtcttcaccaggctgctctgcgcgcgcctccacctgtccagggccgccgccgccgccgccgcccagggctacaacgtggagcgcgggactcacggcctggagccgtccgtggtgacgaccttccccaccgtcaagctcggcgacggcggccagcaaccgccgccggtgcaggaggaatcgcagtgcaccgtgtgcctggaggagtacgaggccaagggacgtggtgcgcgtgctgcccgcctgcngccacgccttccacgcggcctgcatcgacgcctggctgaggcagcaccccacctgccccgtctgccgcgccttcctgcgcgcccaggaacggctgccgcgccacgcccggtcgactacagccttccttcgtcgcgggcgcccaactccccaaccacccgttccagcaaggttcccggggtctctcgttcggggcggttcacccccagggcgagttggaaccccccggaaaaaaacccgaaaaacttgggggggggggcgggag

SEQ ID NO: 79407 - DNA, 871 bp, Zea mays
  misc_feature: Ceres CLONE 1564450
  misc_feature: Encodes the peptide sequence at SEQ ID NO. 79408
  misc_feature (806)..(806): n is a, c, t, g, unknown, or other
ctggagctccccgcggtggcggccgctctagaactagtggatcccccgggctgcaggaattcgtctcacccctagaaaaacttgagaaaggcagattacaggaagatgaagctcgtcgaatcttccagcagatcatatctggcgtcgaatactgccatagaaacatggttgtccaccgtgacctaaagccggaaaacttgttacttgattcaaagtataatgtaaaacttgcggattttggtctgagcaatgtcatgcatgatggccattttctgaagactagctgtgggagtccgaactatgctgctccagaggtaatatctggtaaactatatgctggacctgaggtcgatgtatggagttgcggggtgattctttatgctcttctttgtggaactcttccatttgatgatgagaatattcccaatctgttcaaaaaaattaagggaggtatctacacacttccaagtcatttgtctgctttggccagggatttgatcccacgaatgcttgttgttgagcctatgaagagaatcacaattagggaaattcgggagcatcaatggttccagattcgccttccacgttacttggcagtgcctccaccagatacgacacaacaagccaaaatgattgatgaagatacacttcgagatgttgttaatatgggatttaacaagaaccatgtgtgtgaatcactgtgcagcagacttcaaaatgaggcaactgttgcatattatttactattgggacaatcggtttagagcaactagtggctatcttgggggcagattatcaagaatcantggacaggaatttaaatcagctggcgtcatctgaaatcatctagttctgggtacgaaggaatatt

SEQ ID NO: 79408 - protein, 253 aa, Zea mays
  misc_feature: Ceres CLONE 1564450
  misc_feature (4)..(189): Pfam Name: Pkinase Pfam Description: Protein kinase domain
  misc_feature: SWISSPROT Homolog: EC 2.7.11.1 Non-specific serine/threonine protein kinase
GAPRGGGRSRTSGSPGLQEFVSPLEKLEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVEPMKRITIREIREHQWFQIRLPRYLAVPPPDTTQQAKMIDEDTLRDVVNMGFNKNHVCESLCSRLQNEATVAYYLLLGQSV

SEQ ID NO: 79409 - DNA, 870 bp, Zea mays
  misc_feature: Ceres CLONE 1564453
  misc_feature: Translation starting site: 478
  misc_feature (622)..(622): n is a, c, t, g, unknown, or other
  misc_feature (768)..(768): n is a, c, t, g, unknown, or other
ctggagctccccgcggtggcggccgctctagaactagtggatcccccgggctgcaggaattcgtctcacccctagaaaaagcacggttctgcctcccgctcccacccgcgacatcctcccactcattcccaccgctccctctcacgcccgcgcatggatgtccgccgtcccctcgcccccagatctcgcgcacgcccacgatctcgtgcacgcccacgcgtgaacccagccccagttatgcccgcgccgagccctcacccacggatccgaggatctcctacccctctgcgccggatctgctcctcccttcgcccgagattgccgtcatcaatggaagtgccgaggatccgccggatcgcgccctcctcccctctgcgccggatccgtccgctcccccatctgtattggcagtgagggatgcggcgacctgtagtgcgacggcgtcagctcgctgcccgcttccccacgaaaaccctaatggtgtcccgcctccttcacctctgtcgcctgattacacctcacttcaccgctgcttccttctccaccgccatcagcccgaccttgcatgtctccgcgctcgtcaacatgaccctgtggctcaccctcgtcaaggcctttcccntggcaatgctctgcgcgaccacctcgacgtcgaccagatgcccccactagctatccctacaggcgacgccaaacagcttcacggcggtgggagtaggtccccacccggtcggccaggatgcaaaggctcaggaaaggaagcctccnacttaaaactggaagggtttcaacctcccgcgaacctcaagatttcagggggctagggccttcccaatttgggcaaaaaagtccctttctgtttggaaaccc

SEQ ID NO: 79410 - DNA, 765 bp, Zea mays
  misc_feature: Ceres CLONE 1564455
  misc_feature: Translation starting site: 163
  misc_feature (544)..(544): n is a, c, t, g, unknown, or other
  misc_feature (613)..(613): n is a, c, t, g, unknown, or other
ctggagctccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctggggctgcgtgttcccggagatcctggctaagaacggcgtcaagttcggcgagggcggtgtggttcanggccggcgcgcagatcttctcggagggcgggctggactacctgggggacccccaacctggtgcacgccncagagcatcctgggccatctgggcgttgccaggttggtgctcatgggcctttcgtccaaggggttaaccggggttgggggggggggccccccttcgggggaaagggtcttccaaaaaagggggaaacccccggggggggggccccttttaaa

SEQ ID NO: 79411 - DNA, 855 bp, Zea mays
  misc_feature: Ceres CLONE 1564456
  misc_feature: Encodes the peptide sequence at SEQ ID NO. 79412
  misc_feature (559)..(559): n is a, c, t, g, unknown, or other
  misc_feature (680)..(680): n is a, c, t, g, unknown, or other
  misc_feature (713)..(713): n is a, c, t, g, unknown, or other
ctggagctccccgcggtggcggccgctctagaactagtggatcccccgggctgcaggaattcgtctcacccctagaaaaacccacgtcgccgtgctcgttttgcgcgtccaccagcccgccccccaaccccacccagcgcgacgaagccggggggcgatcgctccagcgccgccggcgacctcgccccgggagccgccggcggtaccccgctctctgtcccgcctcaacgaaccctcaggtccaagtagttcgtttcgtgagttatccaaagttgcgccgcaaagatgagtactgctaatcgctaccaacacatcaagtcaactaagcctgttgtaggcaaagcaagaaaattgaaggatctcatgataaaaagtgacaataggatatgtgctgactgtggtgcacctgatcccaaatgggcatctgctaatattggagtgtttctttgcttaaaatgtggagatgttcatagggcacttggacctgacatctcaaaggttttatctgtaactttggatgattggtctgatagtgatatcgactccatggttgaggttnggtggaaactcatatgcaaattcaatttatgaggcttttcttccaaaagatcacccaaaacccaaaccagattcaacgatggaatataggacaaaatttataagaagctagtatgagacancagatttttttgagccaagtttgcgcatttcantcagatcatcttttaaatctacactttcctgtgaagagtgtagatagcattttctctagcacttcaaggaaaggatgtctttgagaatcaagagaattttgttggaagagttgaatatcccactgggtcaaggcccccaact

SEQ ID NO: 79412 - protein, 101 aa, Zea mays
  misc_feature: Ceres CLONE 1564456
  misc_feature (21)..(102): Pfam Name: ArfGap Pfam Description: Putative GTPase activating protein for Arf
  misc_feature (92)..(92): Xaa is any aa, unknown, or other
MSTANRYQHIKSTKPVVGKARKLKDLMIKSDNRICADCGAPDPKWASANIGVFLCLKCGDVHRALGPDISKVLSVTLDDWSDSDIDSMVEVXWKLICKFNL

SEQ ID NO: 79413 - DNA, 856 bp, Zea mays
  misc_feature: Ceres CLONE 1564457
  misc_feature: Encodes the peptide sequence at SEQ ID NO. 79414
ctggagctccccgcggtggcggccgctctagaactagtggatcccccgggctgcaggaattcgtctcacccctagaaaaaagccatccccttttgctgcaaatctttccctgaattgtgggtctccgacaatggcggcgctcgctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgctggaccgatcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacacatccccatcaacctggtggtggccgtgaatcgcggaggtcatcctcgtcggcggcgccagttactaccggatcaccaacggactggaccttgagggacagctgcaccccggtggccccttcgaccccttgggcctggccagcgacccccgaccaggcgcccatcctcaaagggtgaaggagatcaagaaacggccggctgggccattgtcctccatgttc

SEQ ID NO: 79414 - protein, 177 aa, Zea mays
  misc_feature: Ceres CLONE 1564457
  misc_feature (83)..(178): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLNYFGNTSPSTWWWP

SEQ ID NO: 79415 - DNA, 772 bp, Zea mays
  misc_feature: Ceres CLONE 1564461
  misc_feature: Translation starting site: 220
  misc_feature (529)..(529): n is a, c, t, g, unknown, or other
  misc_feature (536)..(536): n is a, c, t, g, unknown, or other
  misc_feature (549)..(549): n is a, c, t, g, unknown, or other
ggagctccccgcggtggcggccgctctagaactagtggatcccccgggctgcaggaattcgtctcacccctagaaaaaagggttcgcggatcccccacgacacctataagcaccaaccctagcccaaaaccccgcttccacttcacagcctctccgcctccgctcctcgcgccgccgccgcgtctcctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctgttgatcaccgccgcaagaacnaatcccntgagggactgcangccaaatgtcagaggcttaagacatacaaggccaagctgggtatcttccccaggcgtgcacacaaggttaaaggctggtgactctactccagaggagctggccaccgctacccaggtccagggtgactacatgccatttactcgtgggtaagaaacgttcaatttgaaggttgtgaaggtcacaaaatgagatgaagtccttttgctgccttatggccagctc

SEQ ID NO: 79416 - DNA, 688 bp, Zea mays
  misc_feature: Ceres CLONE 1564463
  misc_feature: Encodes the peptide sequence at SEQ ID NO. 79417
  misc_feature (199)..(199): n is a, c, t, g, unknown, or other
  misc_feature (274)..(274): n is a, c, t, g, unknown, or other
  misc_feature (277)..(277): n is a, c, t, g, unknown, or other
  misc_feature (278)..(278): n is a, c, t, g, unknown, or other
tggagctccccgcggtggcggccgctctagaactagtggatcccccgggctgcaggaattcgtctcacccctagaaaaaacacacacactgaccgacacagcagctccgctcgtcgatcagctctcggctgaccactcatcgccagtgggtgcctgccgaccaggtctcgccgccgccaccgccgcggtagagaggggnagggagagggggaaaaaactggcccagatcgagaggtacagcacgaaaaagagaggcaagagagataggggaccnggnnagggcggcgggcccgggggcccaagaaccgaggggctcgtgcgcaggaagctgatgaggctcctgtcgctcgtccccttcggctgccgtgctggaaccatcgacgacgcgccgccgcccgtggaacacgctgcccgccgccgccgcgaggagggccccggaggaggagggccaacaaaagccccccaacctgctgggggccttgctgccgggtggccccccaaacaaggggccccccctcgcttcgggggaaatttttggggaggggagtaacagcaagcaggcccccgaaccccccttcaaagggttccgggaaagggggggggcgtccctggggggaacctccccccccgggggggggtttttccccccccgggggggcaaaaggggggggggaaaaaaacaaataac

SEQ ID NO: 79417 - protein, 72 aa, Zea mays
  misc_feature: Ceres CLONE 1564463
MRLLSLVPFGCRAGTIDDAPPPVEHAARRRREEGPGGGGPTKAPQPAGGLAAGWPPKQGAPPRFGGNFWGGE

SEQ ID NO: 79418 - DNA, 840 bp, Zea mays
  misc_feature: Ceres CLONE 1564468
  misc_feature: Encodes the peptide sequence at SEQ ID NO. 79419
  misc_feature (685)..(685): n is a, c, t, g, unknown, or other
  misc_feature (748)..(748): n is a, c, t, g, unknown, or other
aagctggagctccccgcggtggcggccgctctagaactagtggatcccccgggctgcaggaattcgtctcacccctagaaaaaatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgaccctcttcaggagggcgacctcatcgacgtctccggcaactccatcggcaagggggtcccaggtggcatcaagaagcacaactcnagcgcgggctgatgacgcacggttccagagcacgggcagctgggtccatcggagccggacacncccggccgcgtgtacaaggggaagagatcccgggaaggatgggaggaaccagaccagatcgggagctcaggatcgtcagatcgaaaccaccc

SEQ ID NO: 79419 - protein, 177 aa, Zea mays
  misc_feature: Ceres CLONE 1564468
  misc_feature (51)..(178): Pfam Name: Ribosomal_L3 Pfam Description: Ribosomal protein L3
MAMAAVGVGGAVAFLLPQRRQGAVPWSGGRRRAPVAVRASYEAGVGVMATKVGMMTYFDPETGKPVPVTVVGFREGGNVVTQVKTAATDGYDAVQVGYHGVREDKLTRPELGHLGKAGAPPLRHLQEFRLTAVDAFEPGQPLDFADPLQEGDLIDVSGNSIGKGVPGGIKKHNSSAG

SEQ ID NO: 79420 - DNA, 868 bp, Zea mays
  misc_feature: Ceres CLONE 1564469
  misc_feature: Encodes the peptide sequence at SEQ ID NO. 79421
  misc_feature (702)..(702): n is a, c, t, g, unknown, or other
  misc_feature (739)..(739): n is a, c, t, g, unknown, or other
  misc_feature (780)..(780): n is a, c, t, g, unknown, or other
  misc_feature (786)..(786): n is a, c, t, g, unknown, or other
  misc_feature (805)..(805): n is a, c, t, g, unknown, or other
  misc_feature (806)..(806): n is a, c, t, g, unknown, or other
ctggagctccccgcggtggcggccgctctagaactagtggatcccccgggctgcaggaattcgtctcacccctagaaaaactcacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggctgctgctgctcctcctgctggtgccgaggagcccgccgcggccgagcctgtcgccgaggcagaggctgctgctcccgaggagctcgccgcggacgagccggaggctcctgctcctgctcctgctggtccccagaagccggccgccgaggcngaggctgctgctcctgaggagcccgagaagccagccnagtgaggccgtgcgcacgcagcggcggcggcagggccaggncccaanggggatcggcgtgcccccnnttggcggggtatccctctcgcgcgcggtacatggcagtattaacaccggatttttgctgttc

SEQ ID NO: 79421 - protein, 169 aa, Zea mays
  misc_feature: Ceres CLONE 1564469
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPAVEQEAAAEEEAAAAPPAGAEEPAAAEPVAEAEAAAPEELAADEPEAPAPAPAGPQKPAAEAEAAAPEEPEKPA

SEQ ID NO: 79422 - DNA, 867 bp, Zea mays
  misc_feature: Ceres CLONE 1564474
  misc_feature: Translation starting site: 186
  misc_feature (539)..(539): n is a, c, t, g, unknown, or other
  misc_feature (752)..(752): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (841)..(841): n is a, c, t, g, unknown, or other
  misc_feature (852)..(852): n is a, c, t, g, unknown, or other
ggagctccccgcggtggcggccgctctagaactagtggatcccccgggctgcaggaattcgtctcacccctagaaaaactctcctcccaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctggggcgcggtgggcgccatcgccccggagatcttcggcaagatggncatcatccccccggagaccgcgctgccgtggtttaagacaggcgtcatcccgcccgcgggcacctacaactactggggcgactcctacacggctcttcttctttaaaatggggctcatggggcttcgccgagaaccgcccgcctccaggaatgggtaaaccccgggctcctcggggcaaacataactttctcgggccttccaaaagattcttntcggggtcggggaagaccctaattactcctggggggggccccgctataacacactactgtttgtgggcgagaacgcgnnnagggggagnaagagaggccntgcccagagggggac

SEQ ID NO: 79423 - DNA, 857 bp, Zea mays
  misc_feature: Ceres CLONE 1564476
  misc_feature: Translation starting site: 235
  misc_feature (597)..(597): n is a, c, t, g, unknown, or other
  misc_feature (645)..(645): n is a, c, t, g, unknown, or other
  misc_feature (654)..(654): n is a, c, t, g, unknown, or other
  misc_feature (766)..(766): n is a, c, t, g, unknown, or other
  misc_feature (767)..(767): n is a, c, t, g, unknown, or other
  misc_feature (821)..(821): n is a, c, t, g, unknown, or other
ctccccgcggtggcggccgctctagaactagtggatcccccgggctgcaggaattcgtctcacccctagaaaaagcccctgtggtgtggactcctgcactgtgctccttcgtctcctcctcccctgcctgccaccaactgccaaggtgccaagcaagtgcagataccttccctgcctcacaaacaacgccatcagggtcttcaaccagggcaggttctcttctttcattcagctatgggcaacctgtgctgctgtgttcaagttgaccagtcgactgtggccatcagggagcagtttggcaagtttgacagcgtgcttgagccaggatgccactgcatgccttggttcgccggcaagcgtgtagctgggcatctcacactcaggctgcagcaactggatgtgcgctgtgagacaaaaacaaaggacaatgtttttgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaangacgagatcgcaagggcggtggaggaagagcttgagaaagccatgtcnggctatggnctttgagatcgtgcagactctcattgtggacatcgagccagacgagcatgtgaagcgcgcaatgaacgagatcaacgcagctgcgaggctcagggcggctgcaaacgagaanngcgaggccgaaaagatcgtgcagatcaagcgccgcgaagggggaggcaaaaccnaagtacctgtccgggctgggcattgcgcgcagccgc

SEQ ID NO: 79424 - DNA, 846 bp, Zea mays
  misc_feature: Ceres CLONE 1564477
  misc_feature: Encodes the peptide sequence at SEQ ID NO. 79425
  misc_feature (575)..(575): n is a, c, t, g, unknown, or other
  misc_feature (648)..(648): n is a, c, t, g, unknown, or other
  misc_feature (658)..(658): n is a, c, t, g, unknown, or other
ctggagctccccgcggtggcggccgctctagaactagtggatcccccgggctgcaggaattcgtctcacccctagaaaaaatctgcaccaccacagaacacagattcgcgagcccaagaccaagagcaagagaagaagagctcagctgctgctgccggtgccggtgccggtgccgggcggagtttaacatcgggccgcagccagctcaacacagttaagcaagcttctcctactcctagcttagccaatagccatggcgctggctagccaggtcgccgctaaccagccgccgccgctctcctcccccgcccgccgcctcccaagagccagcagcaacgctctgctgctgctccagccggcggccgcggtcctcggcggccggaccgccctgaggcttcggcctggcggcgcgcggagggccctggacgccgtcgtcgtcgcgcgggcgtcgtctgaggcggagaccgccgaggcgggcggcggcggcggcggagcggaggaggagcggccgtacgaggagtacgaggtgacgatcgagaagccgtacgggctcaagttcatcaaggggcgcgacngcggcacgtacgtggaaggctatcagctcggcgccggcgccgacctgactggtccagtcgaagtggggcgacnaggtgctggncacaagctccgtctcgggggaggagatctggccgggcgcggggtacgggccagaccatgtactgcatccgccagaaggatcggccctctcttactgagattgaaagggagttttgggaaaatgggagaggcccccggcaactttcccgaaaagggaaatcattcggtttcaaaggggaattccgggat

SEQ ID NO: 79425 - protein, 197 aa, Zea mays
  misc_feature: Ceres CLONE 1564477
  misc_feature (108)..(108): Xaa is any aa, unknown, or other
  misc_feature (132)..(132): Xaa is any aa, unknown, or other
MALASQVAANQPPPLSSPARRLPRASSNALLLLQPAAAVLGGRTALRLRPGGARRALDAVVVARASSEAETAEAGGGGGGAEEERPYEEYEVTIEKPYGLKFIKGRDXGTYVEGYQLGAGADLTGPVEVGRXGAGHKLRLGGGDLAGRGVRARPCTASARRIGPLLLRLKGSFGKMGEAPGNFPEKGNHSVSKGNSG

SEQ ID NO: 79426 - DNA, 772 bp, Zea mays
  misc_feature: Ceres CLONE 1564478
  misc_feature: Encodes the peptide sequence at SEQ ID NO. 79427
  misc_feature (556)..(556): n is a, c, t, g, unknown, or other
ctccccgcggtggcggccgctctagaactagtggatcccccgggctgcaggaattcgtctcacccctagaaaaaagacccccgcccacgaccacacgcaggcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccgtccggccggctccatacccgcggctaccgctgccgtcgtcgtcatcctcgtcaggctacaggcactccaagtccgtctccgtgaagacgctcgccctgttcggcaaatccaaggtcaagaccgcgccggcgaagaaggctgctgcgcccaagccaagccgaaggttgaggatggtatcttcggcacgtccgggcgggatcgggtttcaccaggagaacgagctgntcgtcgggcgcgttgccatgcttggcttttgcgcatcgctactgggagaggcattaccgggaaagggcatcctttgcccagctgaacctcgagaccggcatcccccatctacgaggccgagccccccccccccgggtcttcatccctcttaaccctcccttggggcccatggggctttttggggaacggggcccgctttctttcaacaaggagggc

SEQ ID NO: 79427 - protein, 148 aa, Zea mays
  misc_feature: Ceres CLONE 1564478
  misc_feature (99)..(99): Xaa is any aa, unknown, or other
MAAQSMLMSTSVNGGRALPSLQAVRPAPYPRLPLPSSSSSSGYRHSKSVSVKTLALFGKSKVKTAPAKKAAAPKPSRRLRMVSSARPGGIGFHQENELXVGRVAMLGFCASLLGEALPGKGILCPAEPRDRHPPSTRPSPPPPGLHPS

SEQ ID NO: 79428 - DNA, 862 bp, Zea mays
  misc_feature: Ceres CLONE 1564481
  misc_feature: Translation starting site: 159
  misc_feature (728)..(728): n is a, c, t, g, unknown, or other
ctggagctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggaagctggaggtgatccactcccggtgggcgatgctgggcgcgccgggctgcgtgttcccggagatcctggccaagaacggcgtcaagttcggcgaaggcggtgtggttcaaggccggcgcgcagatcttcttcggaaggcgggctggactacctggggaaccccaacctggtgcacgcacagagcatcctgggccatctgggcggtgccaggtggtgctcatgggcttcgtcgagggctacccgcgtcggcgggcggcccgctcggggaagggctccgacaagtggtaccccggcgggnccttccacccgcctggcctcgccgaacaaccgggacaccgccgcccagctcagggtgaaagagtcaagaaacgcccccctggcattgttcctccaggttcggttctttcttggaaggcaatctcccccgggagg

SEQ ID NO: 79429 - DNA, 900 bp, Zea mays
  misc_feature: Ceres CLONE 1564482
  misc_feature (270)..(270): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (282)..(282): n is a, c, t, g, unknown, or other
  misc_feature (283)..(283): n is a, c, t, g, unknown, or other
  misc_feature (285)..(285): n is a, c, t, g, unknown, or other
  misc_feature (289)..(289): n is a, c, t, g, unknown, or other
  misc_feature (290)..(290): n is a, c, t, g, unknown, or other
  misc_feature (309)..(309): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (323)..(323): n is a, c, t, g, unknown, or other
  misc_feature (356)..(356): n is a, c, t, g, unknown, or other
  misc_feature (357)..(357): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (384)..(384): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (457)..(457): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (509)..(509): n is a, c, t, g, unknown, or other
  misc_feature (514)..(514): n is a, c, t, g, unknown, or other
  misc_feature (515)..(515): n is a, c, t, g, unknown, or other
  misc_feature (523)..(523): n is a, c, t, g, unknown, or other
  misc_feature (524)..(524): n is a, c, t, g, unknown, or other
  misc_feature (526)..(526): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (600)..(600): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (614)..(614): n is a, c, t, g, unknown, or other
  misc_feature (628)..(628): n is a, c, t, g, unknown, or other
  misc_feature (632)..(632): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (652)..(652): n is a, c, t, g, unknown, or other
  misc_feature (654)..(654): n is a, c, t, g, unknown, or other
  misc_feature (662)..(662): n is a, c, t, g, unknown, or other
  misc_feature (663)..(663): n is a, c, t, g, unknown, or other
  misc_feature (668)..(668): n is a, c, t, g, unknown, or other
  misc_feature (674)..(674): n is a, c, t, g, unknown, or other
  misc_feature (685)..(685): n is a, c, t, g, unknown, or other
  misc_feature (691)..(691): n is a, c, t, g, unknown, or other
  misc_feature (696)..(696): n is a, c, t, g, unknown, or other
  misc_feature (700)..(700): n is a, c, t, g, unknown, or other
  misc_feature (713)..(713): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (754)..(754): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (798)..(798): n is a, c, t, g, unknown, or other
  misc_feature (804)..(804): n is a, c, t, g, unknown, or other
  misc_feature (805)..(805): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (824)..(824): n is a, c, t, g, unknown, or other
  misc_feature (829)..(829): n is a, c, t, g, unknown, or other
  misc_feature (837)..(837): n is a, c, t, g, unknown, or other
  misc_feature (838)..(838): n is a, c, t, g, unknown, or other
  misc_feature (841)..(841): n is a, c, t, g, unknown, or other
  misc_feature (842)..(842): n is a, c, t, g, unknown, or other
  misc_feature (847)..(847): n is a, c, t, g, unknown, or other
  misc_feature (848)..(848): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (863)..(863): n is a, c, t, g, unknown, or other
  misc_feature (867)..(867): n is a, c, t, g, unknown, or other
  misc_feature (882)..(882): n is a, c, t, g, unknown, or other
ctggagctccccgcggtggcggccgctctagaactagtggatcccccgggctgcaggaattcgtctcacccctagaaaaatcagccccagccctcggaaacccatcgcaaattcgcaaactaaccccaaaccccaatccaccccatcccctcctcatccactccgggcggccatggcctgctccttctccgccgccatcaccgtctcttccgcccctaccccggccgccagacccctcgctgctgccacgcagtccggtctgcattcggncttttttnnngnngnggcnnttttttttttttttttttncccnnnnnnnnngnggggggggggggttttttttttttttttgtggnnggnnnnnnntnnnnnnnnnntnntttntnnnnnnnnnnnnnnnnnnnnnnnnnnnnnnnnnnnnnnnnnnnnntgttttttttttttgtggtgggggggnggnnnnnnnnnnnnnnnnnnnnnnnnnggggggggggggggggggggggggnggggnngggggggnngngggggnnnnggggnnngnnnnnnnnnnnntttttttttttttttttttnnnnnngggggggggggggggggggnggnnnggnnnnttntttttttttttttntttnttttgttttgnnnggggtgngngggggcgnngccgngggggngggcgggcggngcccgnggggngccngcgcccgcccccncccgccccccccctnnnnnnttgttttttttttnnnnnntncnnnnnnnnnnnnnnnnnnnnnnnnaagtnnnnnnnnngnnngngggggnnggggggnnngnnnnttttnttttnttgttctnntgnncgttnnttggcggcgnnncgncccnccccccgcgcgcggngggggggcgggcggcggc

SEQ ID NO: 79430 - DNA, 896 bp, Zea mays
  misc_feature: Ceres CLONE 1564485
ggagctccccgcggtggcggccgctctagaactagtggatcccccgggctgcaggaattcgtctcacccctagaaaaacctcaggctccatgaaggtaagcctgtcttaatgggcttgattgttgaacctgacttagtacttttatccatgtcacgacattgaaccagacagtcactcatgtccttaggatattaacggtatacatcaacaattcattctattttaattgcttgcaaaacttttttggcccttcaaatgagttccacgcatcaagaagtcaagattccaggaggcctaaaataggagaggagggcgcagcttgattcaatccatgtcaagtcaaaggctgctgcgaaatttgcacatgcaagtagaatttagatggtgaggttttgtctctgttcccatttttataacgactaggtgtttgaattcctaagattaaagtttatgtacattcttatttgtaattagatctctgttaggcatctaactgaataaatgatctcctaaagaattgacagattccatcactgagcagcccttcaccccggtggctgcggtgtcgcactggctgacacctgctcgcagttgcattacaagttttactgactatgtattttcaggtctattcaatttcggttctaatgcttctgacagcagttgtatcagtcctcttgttcagcttacatgtatccctcgcatccttccttggatccacataagagtaagtaataattttgttgcatctcctctgctgatcagagctttcaactcatgacagaatatgtactaaacttcaggttggagactatctcagtgtacctacactcagtaggaaaacttcaccccactgcaacagggtttataaaaggtttgctatcaggaaaaacaa

SEQ ID NO: 79431 - DNA, 849 bp, Zea mays
  misc_feature: Ceres CLONE 1564486
  misc_feature: Translation starting site: 150
  misc_feature (441)..(441): n is a, c, t, g, unknown, or other
ctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagnctggaggtgatccactcccgctgggccatgctgggcgcgctcggctgcgtcttcccggagctgctcgcccgcaacggcgtcaagttcggcgaaggccgtgtggttcaaggccgggctcccagatcttcagcgagggtggaactggactaccctcgggaaacccgagcctcattcacgcgcagaagcattcctcgccaatctggggcctgcccagggccgtgcctccatggggccccccgtccaaaggggtaaccccaaattcccccgggggggcccctttttggggaaaggggttttaaaccccccttttatcccggggggggagtttttaaacccctttgggggctttccccaaaaaaccccaggagggcttctttgagaatccacgggggggaaaggggccccaaa

SEQ ID NO: 79432 - DNA, 839 bp, Zea mays
  misc_feature: Ceres CLONE 1564487
  misc_feature: Encodes the peptide sequence at SEQ ID NO. 79433
  misc_feature (763)..(763): n is a, c, t, g, unknown, or other
  misc_feature (814)..(814): n is a, c, t, g, unknown, or other
ctccccgcggtggcggccgctctagaactagtggatcccccgggctgcaggaattcgtctcacccctagaaaaaatcccctggccctctccttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatcgtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggatggaatgctgaagaactccagcagtcggagaagaacctggaatctggtctgcatagggtgctccaacaaaggaatcacagttctggaacagatncatgacctccaacgtaggatacgcagctggcagaggagaacatgcactgangaaatcagtatccagataccccagc

SEQ ID NO: 79433 - protein, 148 aa, Zea mays
  misc_feature: Ceres CLONE 1564487
  misc_feature (9)..(59): Pfam Name: SRF-TF Pfam Description: SRF-type transcription factor (DNA-binding and dimerisation domain)
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGWNAEELQQSEKNLESGLHRVLQQRNHSSGTD

SEQ ID NO: 79434 - DNA, 839 bp, Zea mays
  misc_feature: Ceres CLONE 1564493
  misc_feature: Encodes the peptide sequence at SEQ ID NO. 79435
caaagctggagctccccgcggtggcggccgctctagaactagtggatcccccgggctgcaggaattcgtctcacccctagaaaaaaatcccatcccctcaggcctcagtcgtcagtccctcacacactcactatacactgctctgctgcagcaagaaggaagaagctagcgcctccctagctctcgttgtcagcaatggcctgtcctgcgcgtacgagccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtggctgggcgggcagctgttctcggccatggtggtgcgcaggccggcgcacctgttcctggacgagctgggcgtgggctacgacgaggccgaggactacgtggtggtcaagcacgcggcgctgttcacgtccaccgtgatgagccggctcctggcgcggcccaacgtgaagctgttcaacgccgtggcggtggaggacctgatcgtgcggcgggggcgcgtcggcggcgtggtcaccaactgggcgctcgtgtccatgaaccacgacacgcagtcgtgcatggaccccaacgtgatggaggccaaggtggtggtcagctcctgcggccacgacgggcccttcggcgccaccggcgtcaagaggctccaggacatcggcatgatcagcgccgtgccccgggatgaag

SEQ ID NO: 79435 - protein, 165 aa, Zea mays
  misc_feature: Ceres CLONE 1564493
  misc_feature (1)..(163): Pfam Name: Thi4 Pfam Description: Thi4 family
MTRRYMTDMITHADTDVVIVGAGSAGLSCAWLGGQLFSAMVVRRPAHLFLDELGVGYDEAEDYVVVKHAALFTSTVMSRLLARPNVKLFNAVAVEDLIVRRGRVGGVVTNWALVSMNHDTQSCMDPNVMEAKVVVSSCGHDGPFGATGVKRLQDIGMISAVPRDE

SEQ ID NO: 79436 - DNA, 811 bp, Zea mays
  misc_feature: Ceres CLONE 1564494
  misc_feature: Pfam Name: Sec23_trunk Pfam Description: Sec23/Sec24 trunk domain
ctccccgcggtggcggccgctctagaactagtggatcccccgggctgcaggaattcgtctcacccctagaaaaaagttttcccataacaacggtttctccaggcatacagatcctgctgttgtgcagatcgcttttcagtacagcgtgattgaacctgccaaggagacatcaggcgatggatcacaatcatctgcaagttataagttctctctaaagaggcggctgagaataagaacattacagtaccgtccagctaggaatatcagtgaaatttatgacagtgtagatccagaggttgtactgcatatccttgttcataaggttattttagaatgcgtggataagggggttagagaaggcaggcatcaagttcatgcttggctatccctccttgcagcccggtataatcaggttctgagttctgatgtgcgaactccactatcaagcatagacattgacttctcgcagtgcccgcagcttcaaacgatacctcaacttgtttttgcattgttgagaagtcctcttcttcgcttgcatgaagaaggtgtacacccagattacaggatatatctacaatgccttttcagtgcactggagccatcttctttagctaaagctatatatccggttttaatatcgtattcctcgcctgacaagcaagcattcccacgacacactctcagccgtgctgctctaatcatgagcgagagcccaatattttcttctgacacatttacaaaccctattggttactattcctcgactgctgattcttcatttcctttttctccacccccttgaacgttcttc

SEQ ID NO: 79437 - DNA, 828 bp, Zea mays
  misc_feature: Ceres CLONE 1564498
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
nnnttttnccacccctctgatggggtgaagaggagaaaagatatacgggtggatggggagggggtccccggggggggctctcaggaactccccccggtggcagccgctctacatctagtggatcccccgggctgcaggaattcgtctcacccctagaaaaatatgggaagctcagtttgggtggatttttcaatggagctcaagtgatatttgatcagttcctgagtagtgggggaagtcaaaatggctccgcccagactggccttggcgttttgcctttccctctggaaatgaagggtcaaggggcccgaaactttctaagggcaaaaattgggaaaaccctttttcttcccaaatggaaggggatggaaaaacccccttattgttttttaccccaaaaaaggggttcccaaaaccgggggggaaaaacaaaattccccccccgggggccaattttgggaaaggggccccctttaaaggggaaaaaaaaccccccccggggaaaaaaaatattttccccccaggttcttggggggggcccccccccaaaaaaaaccccgggggggaaatctttcgggaaaaaaacccccccttataaaatggggggaaaacccccccccccaaaaaaaaaaaacccctcttttttcccacaaaaaaaaaaggagccccctatatttataaaaaaacccccccttaaaaaaaattttgtgaaaagaaaattttggggggggggggcccccccccccgggggggtttttttcaaaaaaaaagaggggggggggggggaaccccccccttttttggagggggcggtgcttttttttttat

SEQ ID NO: 79438 - DNA, 891 bp, Zea mays
  misc_feature: Ceres CLONE 1564501
  misc_feature: Encodes the peptide sequence at SEQ ID NO. 79439
  misc_feature (453)..(453): n is a, c, t, g, unknown, or other
  misc_feature (459)..(459): n is a, c, t, g, unknown, or other
  misc_feature (646)..(646): n is a, c, t, g, unknown, or other
ggagctccccgcggtggcggccgctctagaactagtggatcccccgggctgcaggaattcgtctcacccctagaaaaagcaggagcggagctccccgccgcttctctctccgccttccgagaggcccgacccctgataccacgctgagggcggtggtattaggagattagcgatggcgaggtggcggccggcggcgctgctggtagtggctctggcggcggttctatcggcggcgtggcgggcggatgcgctatcggttacggtgaccgacaccgagtgcatccacgagttcgtgccctatgagggcgacaccgtgtccgggaacttcgtcgtcgtcgaccacgacatcttctggagctccgaccacccaggaatcgacctcacggtaacgtcaccaggtggcaacactgtgtacacattgaagggaaaatctggtgagaaatttgagttaangctccnagaggtggcatgtataagttctgcttccataacccatatggagcacctgaaactgtttctttctacatccatgtggggcacataccccatggagcacattctggcaaaaagatgagcccttgaaccctttcaatgttaaaattcccggaacttgagggaacccttagaaatccctcccccgccagancaaaggttcccttaaaccccccaaaatttcttccccggccccctttttggaaccccccaaaaggggggtctgttttttaaaaaagggggggaaaacccggggttcccggggggtgtaacccgtgttaagggccccccaaacccccgcccgttttttttaaaaaaaatgtgggggacaaaccaagggggggaggagaaaaaattctctctaagaggggggataggggaaacccccttatatttttg

SEQ ID NO: 79439 - protein, 133 aa, Zea mays
  misc_feature: Ceres CLONE 1564501
  misc_feature (94)..(94): Xaa is any aa, unknown, or other
  misc_feature (96)..(96): Xaa is any aa, unknown, or other
MARWRPAALLVVALAAVLSAAWRADALSVTVTDTECIHEFVPYEGDTVSGNFVVVDHDIFWSSDHPGIDLTVTSPGGNTVYTLKGKSGEKFELXLXEVACISSASITHMEHLKLFLSTSMWGTYPMEHILAKR

SEQ ID NO: 79440 - DNA, 811 bp, Zea mays
  misc_feature: Ceres CLONE 1564504
  misc_feature: Encodes the peptide sequence at SEQ ID NO. 79441
  misc_feature (451)..(451): n is a, c, t, g, unknown, or other
ctggagctccccgcggtggcggccgctctagaactagtggatcccccgggctgcaggaattcgtctcacccctagaaaaaacatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagancatcacccttgaggtggagtcctcagacaccattgacaatgtccaggcaaagatcccaggacaggaggggcatcccactgaccagcaacgtctcatctttgccgggcagcagttggaggatgggaagaccccttgctgacttcaacatccagaagggaagcccccctcccccttggggctggcgtcttaggggtgggaatgcagaatctttgggaaaaaccttttcggcaaaaaccctcccccctgggggggggagtcttcaaaaacccttttgacatggccggggccaaaaatcccgggcaaaggggggggtttccccccggaaacagagggggtttttttttttgcgggggagagggg

SEQ ID NO: 79441 - protein, 133 aa, Zea mays
  misc_feature: Ceres CLONE 1564504
  misc_feature (6)..(74): Pfam Name: ubiquitin Pfam Description: Ubiquitin family
  misc_feature (82)..(133): Pfam Name: ubiquitin Pfam Description: Ubiquitin family
  misc_feature (88)..(88): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKXITLEVESSDTIDNVQAKIPGQEGHPTDQQRLIFAGQQLEDGKTPC

SEQ ID NO: 79442 - DNA, 853 bp, Zea mays
  misc_feature: Ceres CLONE 1564506
  misc_feature: Encodes the peptide sequence at SEQ ID NO. 79443
ctggagctccccgcggtggcggccgctctagaactagtggatcccccgggctgcaggaattcgtctcacccctagaaaaaacactttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgttcccggaagccaagcccgcctcggcggcggcggcggcgagcaggagtgtggtcggggtggacagggactacctgtcctacgacgagccaaagacggtgttcccgggcgaggcgtgcgacgacctcggcggcgagttctgcgaggcgccgtaccaggacggcgtctccagggagctggcgcacgcctgaagaccctgatccatccatgtctgtccaccacgctatgtacgtatgtgtagcagatggtttacatctacgtgttagaccaactccagcagcactccgcatgcggctccggatccctattttgcggagcctagctcactattcatcagtccagcaggctccgcatcgggctccgtaaaacgcacggcctgtacctgcactccccattcccacgcttctctctcctctccgcagctctctgcgtgcgcgcgcggctgctcgcgggccccaggtgtcatagactgcatgccgattgggatgtggagtgttgcctgat

SEQ ID NO: 79443 - protein, 138 aa, Zea mays; identical to SEQ ID NO: 75588
  misc_feature: Ceres CLONE 1564506
  misc_feature (1)..(126): Pfam Name: Lir1 Pfam Description: Light regulated protein Lir1

SEQ ID NO: 79444 - DNA, 878 bp, Zea mays
  misc_feature: Ceres CLONE 1564507
  misc_feature: Encodes the peptide sequence at SEQ ID NO. 79445
aagctggagctccccgcggtggcggccgctctagaactagtggatcccccgggctgcaggaattcgtctcacccctagaaaaagccgaggcgcaacctagcagccgcccacacggcgcgacatccactggcgcaagcgaaatccgcaagggccaacggatcgccggccggcgcgccgccagcctcctggctcggccgtcccgcggctaacgcaggggcggaaaggccggccagccgcccacaccccacggctcatccggccagccaggcggaaacgaccgttcctcagcttgcgcaagatccgtctgggttgtccgccctccattggactacccaaggtgcggcgcatccaccaggtggaagatatctgcgtaagtcaaaacatagaataagagtggactgctatcacctttccataggatggaatccttgtggaagctgacctacttgctcgacccggcatcaattgccctcattgctacagccatttctgtggcctatgcatcagcatcacgagctctggactatggcaaagagatggagagaaacttggatttttcagaggcttccattacattggatcgttcgcaggctctaatgattccccttgcaagctcgtgcagtctgttgctgatgttctacttgttctcgtctgtttcacatctcgtgacagcttttactgctgtggcctcagcattggcactgtttcttttgcctgtcttcacacatcacccatctcaagccaccaatcaatccaatggacccattcatgtccagaatgttgttccaaagtcctttacaccggttggcaggttttgctgaaagctccttcctgcaaaggccacaggccttaggcctggggttggggttccagggcat

SEQ ID NO: 79445 - protein, 133 aa, Zea mays
  misc_feature: Ceres CLONE 1564507
MESLWKLTYLLDPASIALIATAISVAYASASRALDYGKEMERNLDFSEASITLDRSQALMIPLASSCSLLLMFYLFSSVSHLVTAFTAVASALALFLLPVFTHHPSQATNQSNGPIHVQNVVPKSFTPVGRFC

SEQ ID NO: 79446 - DNA, 787 bp, Zea mays
  misc_feature: Ceres CLONE 1564509
  misc_feature: Encodes the peptide sequence at SEQ ID NO. 79447
  misc_feature (688)..(688): n is a, c, t, g, unknown, or other
ctggagctccccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactattcaccgtccacgttccatatggcttcctgcaggatggcactcctccttggcttgctgctgctagtagtagcttcgcccgcgatcgctgatgacgactccggtatctactaccagctgggctcttatgtggccaggagcatactgcgagcagaccagcgctgggtgctgncaagcgaacaccgggcgtctcgccggcgcgcgacttctacataacgggctttcaccgtccttaacgcgacccaccggacgctgcagtgacgggatgcaa

SEQ ID NO: 79447 - protein, 63 aa, Zea mays; identical to SEQ ID NO: 28299
  misc_feature: Ceres CLONE 1564509

SEQ ID NO: 79448 - DNA, 1200 bp, Zea mays
  misc_feature: Ceres CLONE 1564515
  misc_feature: Encodes the peptide sequence at SEQ ID NO. 79449
gccgcacggatgccccccccccttatgtggccgccggtgtggattcgctaatactcgcgtaaataaaaaaaagtggcgctccccgcggtggcggccgctctagaactagtggatcccccgggctgcaggaattcgtctcacccctagaaaaagccggccccgtctcctctcctctcctctcccccgcatccacaggcgcaggccgcagccagccactcgaggatctagtcgtctctctctccccgctctgccgcctcgctgccgcggcttcccgtcggttggaggatgaacgtcacggtcgtgtccctgagcggccgggagctcgtcaagggcggcatccactttaaggactcggccaaggccgcggacctgcaggaggccatccatgccaggactaacaagtattatccttctaggcaggggctcccccctcccccttcagccgggaacaagcggggaagccagtaggtccccccactgcggagggacatccctggctagaatagccgccaagaaaaggggtttctggggtcaccttaccggtggtgcctttcaaaggatattatggggcccagagggtatttgttgaccggacccccttttttcctgcgtatggagaaaccctgggggattcctttccccgattcaatctaacccgccgaggggttaagaatccaccccaaggcgcgggttttagaccacgaaatatcctactatcctttttatataaagagggtgccatcccggggcgccgaaattctgccgtcctggggtttccggagggagccccacagaacgccccccaggtgaactagtcagacaggggatgagggcctcctcgttaattacacggatcttctaaattggtgcgatgtcctccttgatggagaagagcatcacctcgtctttgttaagacaggaccacgcggtctcttattatctctaccacgcaaagagactagttcatacgaggcattgtctccagaaaagagttttctcctgtcgcaggaagaaaagatgggaccccgagcatatcaacctataggcgcgtctcaccgaggcgcgtcctatcggccataggtttcttttattacgacgggggcgagaaacagacacccccgtttgtttcaatcaccccttcggagcgagtaagacaatatgtcttcgcgattattgtaaaagtgaagtctccgccttctc

SEQ ID NO: 79449 - protein, 60 aa, Zea mays
  misc_feature: Ceres CLONE 1564515
MNVTVVSLSGRELVKGGIHFKDSAKAADLQEAIHARTNKYYPSRQGLPPPPSAGNKRGSQ

SEQ ID NO: 79450 - DNA, 817 bp, Zea mays
  misc_feature: Ceres CLONE 1564516
  misc_feature: Encodes the peptide sequence at SEQ ID NO. 79451
ggagctccccgcggtggcggccgctctagaactagtggatcccccgggctgcaggaattcgtctcacccctagaaaaaatacccatccactgaccgcgaagtgcacagagggggggaaggaaggagacaccacccagatcgagttaccgtctgcgaggaggaaggagaagaggctgattcgatcgagcagcatggcgcggcggccacggccgtgtgcccacctgacggccacgctccttctgctcgccgtcgccgcggcggtcgccagagccgccgacggcgacgagaagtgcggcagcccgtgcggtaacccctgcggcgagccgtgcgtgtacgcgagcccgccgccgccgccggtctactacccgccgccgccgccgcccgtgtactcgccaccgccgccgccggagtactacccgccgacgaccccgaccccgaccacgccctactgcccgccgccgccgtcgggcggcggctacgagccgtcgcccggatacacgcccgggtacaacccgacgccgccgtccggctccggctggtacacgccctcgtacaactcgccgccgggcacgctctacccgcaggaccccgggttccggcccaacgccgcgccggcccgcgtcgccgcgccgtggcgcgcggcgctcttcctcgccgacacggcgtcggcggcgctggcccgcgcctgcctgggcttgtgacgcggtcggaggccgccggggatcacgacctccgccgatgggtgtcgcgtcttcatggcgccccgcccgcgccggggcggggagaccgtccagggcgggcctgggcgcgcgggttt

SEQ ID NO: 79451 - protein, 169 aa, Zea mays
  misc_feature: Ceres CLONE 1564516
MARRPRPCAHLTATLLLLAVAAAVARAADGDEKCGSPCGNPCGEPCVYASPPPPPVYYPPPPPPVYSPPPPPEYYPPTTPTPTTPYCPPPPSGGGYEPSPGYTPGYNPTPPSGSGWYTPSYNSPPGTLYPQDPGFRPNAAPARVAAPWRAALFLADTASAALARACLGL

SEQ ID NO: 79452 - DNA, 752 bp, Zea mays
  misc_feature: Ceres CLONE 1564517
  misc_feature: Encodes the peptide sequence at SEQ ID NO. 79453
tccccgcggtggcggccgctctagaactagtggatcccccgggctgcaggaattcgtctcacccctagaaaaagccattagctgtcgctgggacggaaccggaacgtttcgctagccctcgttcccgttcggccttgacaacccaacccgaccccaagttcccaacgcagaggatcgaactgaatcctccgcaactcgccgccgccgggaccgaccgacccgatcctatcgatcgaggatgtcgtacgcctcctcttcaagtacatcatcatcggcgacacggcgtggggaagcgtgcctgctgctgcagttcacggacaagcgcttccagcccgtgcacgacctcaccatcggcgtcgaattcggcgcccgcatgatcacccatgaaaaatagcccatcaagcttcagatttgggacacggctggccaaggaatcattccggatctattactagatcatactaccgaggcgctggctggggccctttttgggttatggaaattaccagggagggagaacctttcaacctttttcgaaaagtttgtttaaaaaaaatgcaggggaccctggcaaatggcaaacagtaaccgggaaagccttattgggaaaacaaaggggggattttttttcaaaaaaagggggttgtttcctttttgggggaagggggaaaaaattttttcccaaagggacaaaggggccgggggcttttttaggggggggggttttccgtcaaaaaaatggcccacaaaaa

SEQ ID NO: 79453 - protein, 51 aa, Zea mays
  misc_feature: Ceres CLONE 1564517
MSYASSSSTSSSATRRGEACLLLQFTDKRFQPVHDLTIGVEFGARMITHEK

SEQ ID NO: 79454 - DNA, 701 bp, Zea mays
  misc_feature: Ceres CLONE 1564518
  misc_feature: Encodes the peptide sequence at SEQ ID NO. 79455
acccgcggtggcggccgctctagaactagtggatcccccgggctgcaggaattcgtctcacccctagaaaaagctgatgtggcatgtctgcctccacccctccgccaccaccatagctttgcctttgccgcgagcgaccgtagcgaggtgattgcaatggtggcctccactgcttcccgcctctcgcccccgcgcttcagcaccccttccccgtctcttcatcctccaaaccgccgctcgcgcttctcccctgttcgcgcagccaagttggaagctgtgctgtctattggtgctcatctaatcccacaccccaagaaaagctgcaaagtggcggaaaaaaggatgcctttctttggccaataccgatgcctggcggagtatttgccaatttgcaaattggtgtcctccggatgggcaaaaaaaaaatggccaatcccagctctattcccccccaagagccccaggaaaaacaagctctatttccccaaatgtagagggggggccacccaggaaccccccattttcctttcccagaaaaacccatggggggaaatttcttccttttgggatccgccccaaaaaaaattcccccccccttcctctgaaaaaaaacccgggacctcccaaaaaatttccccaggggggggggaaaattttggggggggttaaaaaaaatttttttccccaaaaaggggggaaag

SEQ ID NO: 79455 - protein, 170 aa, Zea mays
  misc_feature: Ceres CLONE 1564518
MVASTASRLSPPRFSTPSPSLHPPNRRSRFSPVRAAKLEAVLSIGAHLIPHPKKSCKVAEKRMPFFGQYRCLAEYLPICKLVSSGWAKKKWPIPALFPPKSPRKNKLYFPKCRGGATQEPPIFLSQKNPWGEISSFWDPPQKKFPPPSSEKKPGTSQKISPGGGENFGGG

SEQ ID NO: 79456 - DNA, 828 bp, Zea mays
  misc_feature: Ceres CLONE 1564524
  misc_feature: Encodes the peptide sequence at SEQ ID NO. 79457
ctccccgcggtggcggccgctctagaactagtggatcccccgggctgcaggaattcgtctcacccctagaaaaaatacccatccactgaccgcgaagtgcacagagggggggaaggaaggagacaccacccagatcgagttaccgtctgcgaggaggaaggagaagaggctgattcgatcgagcagcatggcgcggcggccacggccgtgtgcccacctgacggccacgctccttctgctcgccgtcgccgcggcggtcgccagagccgccgacggcgacgagaagtgcggcagcccgtgcggtaacccctgcggcgagccgtgcgtgtacgcgagcccgccgccgccgccggtctactacccgccgccgccgccgcccgtgtactcgccaccgccgccgccggagtactacccgccgacgaccccgaccccgaccacgccctactgcccgccgccgccgtcgggcggcggctacgagccgtcgcccggatacacgcccgggtacaacccgacgccgccgtccggctccggctggtacacgccctcgtacaactcgccgccgggcacgctctacccgcaggaccccgggttccggcccaacgccgcgccggcccgcgtcgccgcgccgtggcgcgcggcgctcttcctcgccgccacggcgtcggcggcgctggcccgcgcctgcctggccttgtgacgcggtcggaggccgccggggatcacgacctccgccgatgggtgtcgcgtctacatggcgccgcgcacgcgccgtgctgggagatcgtcaagggcgtgcatggcgcgcgggtttagtttcgctttccgccc

SEQ ID NO: 79457 - protein, 169 aa, Zea mays
  misc_feature: Ceres CLONE 1564524
MARRPRPCAHLTATLLLLAVAAAVARAADGDEKCGSPCGNPCGEPCVYASPPPPPVYYPPPPPPVYSPPPPPEYYPPTTPTPTTPYCPPPPSGGGYEPSPGYTPGYNPTPPSGSGWYTPSYNSPPGTLYPQDPGFRPNAAPARVAAPWRAALFLAATASAALARACLAL

SEQ ID NO: 79458 - DNA, 871 bp, Zea mays
  misc_feature: Ceres CLONE 1564530
  misc_feature: Encodes the peptide sequence at SEQ ID NO. 79459
  misc_feature (574)..(574): n is a, c, t, g, unknown, or other
aaaagctggagctccccgcggtggcggccgctctagaactagtggatcccccgggctgcaggaattcgtctcacccctagaaaaaatcattgtcgcgtcctcgtccccgttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctggcgcaagggggacgacnactactgcgcggggatcgtgctcacttccacggggttcaaccacgcccacgggggccgcccaccagggggggatttctcgaattcctgggtccgaaggagaactaagtgggttccggtcccccaagggcctggggttggacccaaccggcccctttgttttggccgggggtatacgtggtaaagccccttggagggccccgggctcaaaaaacccgggaaagccctttggggtttttggggcctgggggggtctggccaattttcccttaaaatttggaaaggcctccggggagaaa

SEQ ID NO: 79459 - protein, 170 aa, Zea mays
  misc_feature: Ceres CLONE 1564530
  misc_feature (33)..(150): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature (111)..(111): Xaa is any aa, unknown, or other
MEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSWRKGDDXYCAGIVLTSTGFNHAHGGRPPGGDFSNSWVRRRTKWVPVPQGPGVGPNRPLCFGRGYTW

SEQ ID NO: 79460 - DNA, 812 bp, Zea mays
  misc_feature: Ceres CLONE 1564533
  misc_feature: Encodes the peptide sequence at SEQ ID NO. 79461
ctggagctccccgcggtggcggccgctctagaactagtggatcccccgggctgcaggaattcgtctcacccctagaaaaagcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtcaagctgttcaacgccgtggccgtggaggacctcatcgtcaggggaaggcgcgtcggcggcgtcgtcaccaactgggcgctcgtgtccc

SEQ ID NO: 79461 - protein, 214 aa, Zea mays
  misc_feature: Ceres CLONE 1564533
  misc_feature (64)..(214): Pfam Name: Thi4 Pfam Description: Thi4 family
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVAVEDLIVRGRRVGGVVTNWALVS

SEQ ID NO: 79462 - DNA, 841 bp, Zea mays
  misc_feature: Ceres CLONE 1564535
  misc_feature: Translation starting site: 227
  misc_feature (784)..(784): n is a, c, t, g, unknown, or other
ggagctccccgcggtggcggccgctctagaactagtggatcccccgggctgcaggaattcgtctcacccctagaaaaactcttgcgcgttcctcttcttcctagtcctaggctactttctccgagtcgcctgtcatctctctctaccagattagattggggatctcatctcatccgaatccttcatagtattacacaaccagcaaggccgcccgcttgccggcaacatgaagaagatcttcggcgccaagaagaacaaggatccgccgcccacaatccaggacgcaaccgacagaatcaccaagcgcggcgacaccgtcgatgaaaagatcaagaagctcgacgccgagctcgcgcgctacaaggagcagatcaagaagacgcgcccaggccccgctcaggaggccgtcaaggcacgagccatgagggtcctcaagcagcgcacgatgtacgaagggcagcgtgacatgctctacaaccaaacatataaccttgaccaagttgcttttgcggcagagggacttaaagatgctcagcaaactatgactgcgatgaaggctgccaataaagagctcaaagggatgatgaaaactgtcaagctcgaagatattgatagtatgcaagatgagatgatggactcttatggatgtgagcactgaaatacaagaaactcttggcagaagctacaacgtcccagatgacatcgatgaggaagaacttatgggggagctcgatgctttggtagccgacatggacttcgaatcagagtcagtcccatcttaccntcaaccagaacaagaacctgaactcagcttacctgctgcaccaactgggcatgcagc

SEQ ID NO: 79463 - DNA, 885 bp, Zea mays
  misc_feature: Ceres CLONE 1564538
  misc_feature: Encodes the peptide sequence at SEQ ID NO. 79464
  misc_feature (337)..(337): n is a, c, t, g, unknown, or other
  misc_feature (352)..(352): n is a, c, t, g, unknown, or other
tggagctccccgcggtggcggccgctctagaactagtggatcccccgggctgcaggaattcgtctcacccctagaaaaaacaccgagcagcaagcaccaccaccgcccgggcggccactccacttcctcccctgctgcactgacgcgcccagcgccaaagcatcctttcacctcaaagataaggaggccgtaacctgtcggggccctcccccaatctccagcgacgccgtccccccaactcgccacccatggccatgtcgttccacttccacccgctggccgcctcgcgcgtccacttctccccactcccgttcgccgcccgctgccgcggggggtngccctcccccctccntcttccggtcgcccatcggggggggaaccacccaccaaccacccaggaaggggtcggcccgccccccttcctcccgccaatccgtgggcccacggggcgggccgcccgccgtttgggggggggaacccaccgggaattttccgaacctttcaaggggcgttaaccattgggggggaaaaccccccccccggttccctccggggaaaaaaccggggggccccctttggaaaagaagggggcccggtccccccccccgcgggggggggaaaccccccccccccggggggggggtttttgtaaaaaaaaaaaaaacacccccccccccctggggggggggggaaaaaaaaaaaaaaaaaaaaaatcttctctccccccccccgcgtggaaaaaaaccccccccccccctgtgtcccacgaggtttttttttctttaaaagagggggggggagagaaccacccctatattttgggggcgttgttctcttctttctttgcggggggaggagaaaagaaaaccactccttctttttttt

SEQ ID NO: 79464 - protein, 63 aa, Zea mays
  misc_feature: Ceres CLONE 1564538
GAPRGGGRSRTSGSPGLQEFVSPLEKTPSSKHHHRPGGHSTSSPAALTRPAPKHPFTSKIRRP

SEQ ID NO: 79465 - DNA, 780 bp, Zea mays
  misc_feature: Ceres CLONE 1564540
  misc_feature: Encodes the peptide sequence at SEQ ID NO. 79466
  misc_feature (334)..(334): n is a, c, t, g, unknown, or other
  misc_feature (645)..(645): n is a, c, t, g, unknown, or other
ctccccgcggtggcggccgctctagaactagtggatcccccgggctgcaggaattcgtctcacccctagaaaaaccgctggagcagccgacgatgatccacgacttcgccatcaccgagaacttggtggttgtgcccgaccaccaggtggtgttcaagctccaggagatgctgcgcggcgggtcgcccgtggtgctggacaaggagaagacgtcgcggttcggcgtgctccccaagcacgccgcggacgcgtcggagatggcgtgggtggacgtgccggactgcttctgcttccacctgtggaacgcgtgggaggacgaggcgacgggcgaggntggtggtgatcggctcctgcatgacccccgccgactccatcttcaacgagtccgacgagcgcctggagagcgtactgactgagatccgcctggacgcgcgcacggggcgggtcacgcgccgcggcgttcctgccgccgtcgcagcaggtgaaacctggaggtgggcattgtggacccgccaacttggctgggcccccgcagaaccccgggaaacccctatcccctccggggggggcccaaaaaaccctgggcccccaaaagggggggggggggtgtcttttcccccggggggggggggggggttttttttntttgcggggggggggggcccccccattttttaaaagggggtggggggggggggttttttttttttggaaaaaaaaacacccccttcttttttttcccacacaaaaaaaaaaaaaaggggggggggggcccccccc

SEQ ID NO: 79466 - protein, 137 aa, Zea mays
  misc_feature: Ceres CLONE 1564540
  misc_feature: SWISSPROT Homolog: EC 1.13.11.51 9-cis-epoxycarotenoid dioxygenase
  misc_feature (111)..(111): Xaa is any aa, unknown, or other
PRGGGRSRTSGSPGLQEFVSPLEKPLEQPTMIHDFAITENLVVVPDHQVVFKLQEMLRGGSPVVLDKEKTSRFGVLPKHAADASEMAWVDVPDCFCFHLWNAWEDEATGEXGGDRLLHDPRRLHLQRVRRAPGERTD

SEQ ID NO: 79467 - DNA, 897 bp, Zea mays
  misc_feature: Ceres CLONE 1564542
  misc_feature: Encodes the peptide sequence at SEQ ID NO. 79468
ctccccgcggtggcggccgctctagaactagtggatcccccgggctgcaggaattcgtctcacccctagaaaaaaaaacacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctcctacccgcggcgctgctcccttcgttgcagcccgccaggaagcacacgctgcagccgcccgccgcagccgccgagtccgcaggggaggccaagtctgtgggttccctggagaagtacccggccctggtcaacggcttcttcttcttcatgtggtacttcctcaacgtcatattcaacatcctcaaaagaagatctacaattacttccccaaacccaaactttgtggcccctgacccatcaaaaaagggggggtccataacggccctaccagcgtggagtggcgggtccccccaagggaagccccttaaaatggaaccgccccctaaagttttctttttcaattcccccttggcccaggggtttgggcccctaacaaaaaaaagggcccctccccggggggggggacccctttttgtcccacattaaaaaaagttgggggggccttttttttgggaggggggtattttttttttcttttgggaaaagagaccccccccccccggggggtgttttccccccccccccggggatcaattgggtattaaa

SEQ ID NO: 79468 - protein, 205 aa, Zea mays
  misc_feature: Ceres CLONE 1564542
MSALGTLSGGAAGVSGLLRLRRRAAPAPAIAAPSHLPAGTVKCAAAVPDAAPIVWGRQLRPALLLPAALLPSLQPARKHTLQPPAAAAESAGEAKSVGSLEKYPALVNGFFFFMWYFLNVIFNILKRRSTITSPNPNFVAPDPSKKGGSITALPAWSGGSPQGKPLKMEPPPKVFFFNSPLAQGFGPLTKKRAPPRGGGPLFVPH

SEQ ID NO: 79469 - DNA, 814 bp, Zea mays
  misc_feature: Ceres CLONE 1564543
  misc_feature: Encodes the peptide sequence at SEQ ID NO. 79470
  misc_feature (799)..(799): n is a, c, t, g, unknown, or other
ctccccgcggtggcggccgctctagaactagtggatcccccgggctgcaggaattcgtctcacccctagaaaaatcgtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaaagactggagggaggatggggattgtgagcccagtgaaaaacagggccactgtggatcatgctggaccttcagcactactggtgcacttgaggctgcatatacccaggcaactggcaagcccatctctctctctgagcaacagcttggtgactgtggttttgcatttcaacatttcggatgcaaacggagccttccatcccagncctttgatacatcaa

SEQ ID NO: 79470 - protein, 219 aa, Zea mays
  misc_feature: Ceres CLONE 1564543
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
  misc_feature (215)..(215): Xaa is any aa, unknown, or other
MAPRRLLVLAVLALAATAAAANSGFADSNPIRPVTDRAASALESTVFAALGRTRDALRFARFAVRYGKSYESAAEVHKRFRIFSESLQLVRSTNRKGLSYRLGINRFADMSWEEFRATRLGAAQNCSATLTGNHRMRAAAVALPETKDWREDGDCEPSEKQGHCGSCWTFSTTGALEAAYTQATGKPISLSEQQLGDCGFAFQHFGCKRSLPSQXFDTS

SEQ ID NO: 79471 - DNA, 871 bp, Zea mays
  misc_feature: Ceres CLONE 1564544
  misc_feature: Translation starting site: 125
  misc_feature (434)..(434): n is a, c, t, g, unknown, or other
  misc_feature (454)..(454): n is a, c, t, g, unknown, or other
  misc_feature (501)..(501): n is a, c, t, g, unknown, or other
  misc_feature (611)..(611): n is a, c, t, g, unknown, or other
ctccccgcggtggcggccgctctagaactagtggatcccccgggctgcaggaattcgtctcacccctagaaaaatcagccatcccctcccgcggcaagtctctctgaattgtgggtctccggcgatggcggctctagctccatccaagattctgggcaccaagctcaacttcgccggctcctcccgctacgccacggcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccggatgggctcttggaccgctcggaggtaccggagtacctcaccggagaggtccctggagactatggctacgacccttttggcctgngcaagaagccagaggacttncgccagtaccaggcctacgagctgatccatgccagatgggccatgcntcggtgccgctggcgctgtcatcccagaagcgtgcaacaagttcggcgctaactgcggccccgagggccgtctggttcaagaacggcgcctttgctcctggacggcacanccttcagctattttcgcacagcatccccatcaacctggtggcgcggatccccccccgaagggcttccctcttcgggggggcccaagtactacccggatcatcaacggacttggacccttaggaaaaagctgcacccccggaaggcccctttaacccccctggggttggggcagggaaccccaaacaagcccccttcctccaagggggaaggaaaatcaaaaacgggccggcccccccatgtcccccaagtgccccttctc

SEQ ID NO: 79472 - DNA, 941 bp, Zea mays
  misc_feature: Ceres CLONE 1564546
  misc_feature: Encodes the peptide sequence at SEQ ID NO. 79473
  misc_feature (420)..(420): n is a, c, t, g, unknown, or other
  misc_feature (528)..(528): n is a, c, t, g, unknown, or other
  misc_feature (568)..(568): n is a, c, t, g, unknown, or other
  misc_feature (569)..(569): n is a, c, t, g, unknown, or other
  misc_feature (612)..(612): n is a, c, t, g, unknown, or other
  misc_feature (613)..(613): n is a, c, t, g, unknown, or other
  misc_feature (615)..(615): n is a, c, t, g, unknown, or other
  misc_feature (616)..(616): n is a, c, t, g, unknown, or other
  misc_feature (618)..(618): n is a, c, t, g, unknown, or other
  misc_feature (619)..(619): n is a, c, t, g, unknown, or other
  misc_feature (837)..(837): n is a, c, t, g, unknown, or other
ctggagctccccgcggtggcggccgctctagaactagtggatcccccgggctgcaggaattcgtctcacccctagaaaaagcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaagaggcttcagctngcattactgccttggatggaaagactctcgatggacggagcatacgtgttaatcatgctaacgagaagacaggtggcttcgtggccggcggtggcttatgtggcggcngctacggtggtgtgaggaaaaaaagggggggggggggggnnttggaataagggtggggggtagaagcaatttgtggttggtggnngnngnnggttgaaacagggggggggaaaaaatgggggggaacccaaaaaggggggggggggggggagaataaggaaattcccttggggagaggtgaaaacgccccctttttttgggtgggagagacgacaaccttttttcacaaaaaaaaaatattggtgtttacaaaaataatttttttggtgaaaaacagggggtgtggtgttttttaaaaaaaaccaccgngggttcccccagggagaaagaaggggttttttcttccgcccccccagagaaaaattattttgggggggcccacaaaaaaagaaaaaaaaacaccgtgttgtttt

SEQ ID NO: 79473 - protein, 138 aa, Zea mays
  misc_feature: Ceres CLONE 1564546
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (87)..(87): Xaa is any aa, unknown, or other
  misc_feature (123)..(123): Xaa is any aa, unknown, or other
  misc_feature (136)..(136): Xaa is any aa, unknown, or other
MALANKLGGLLKKATSSNLSVYQAIRCMSSKLFVGGISYQTDDHSLRDEFAKYGQVIEARIIIDRESGRSRGFGFVTYTSSEEASAXITALDGKTLDGRSIRVNHANEKTGGFVAGGGLCGGXYGGVRKKRGGGGXLE

SEQ ID NO: 79474 - DNA, 845 bp, Zea mays
  misc_feature: Ceres CLONE 1564551
  misc_feature: Encodes the peptide sequence at SEQ ID NO. 79475
ctccccgcggtggcggccgctctagaactagtggatcccccgggctgcaggaattcgtctcacccctagaaaaacttcacggccacatcatcactcgctcggcgccatagccatcggcctcactcactagctgtctagctagcttccagccgcagcagcttgtcgtgcggatagatagaagcgccaagccactcgctgggccggggtacggttgttgttctgtgactctcgcacaatgccggccatggtggaggaggaggagctcatcagaggggcggcgcccgagccggagccggagccgcacctcctggttgtgaccttcccggcgcagggccacatcaacccggcgcggcacctcgcgcgccacctgctgcgcgccacgggggcgcgggtcaccgtctccacggccgtgtccgcgctccgcaagatgttcccgggcgagcaggcgggcgcggagggccaccgcgacgccgcgggggtgtggtacgtgccctactccgacggctacgacgacggcttcgaccgcgacgcgcacgacgccacgcactacatggagcagatcaagctcgtgggcgccgccacgctgggggccgtcctcgaccgcctccgcggcgtgggccgccccgtcacgctcgtcgtgtacacgctgctgctgtcgtgggtggccgacgtggcgcgcgcccgctccgtgcccgccgcgctctactggatccagccggccaccgtgctcgccgtgtacctccacttcttccgcgccacggacggcgtcgaccgggccatcgccgcggcgggcggcgacccgtgggcgacggtcccggttcccggggctcccgccgctccgcgtc

SEQ ID NO: 79475 - protein, 203 aa, Zea mays
  misc_feature: Ceres CLONE 1564551
  misc_feature: SWISSPROT Homolog: EC 2.4.1.210 Limonoid glucosyltransferase
MPAMVEEEELIRGAAPEPEPEPHLLVVTFPAQGHINPARHLARHLLRATGARVTVSTAVSALRKMFPGEQAGAEGHRDAAGVWYVPYSDGYDDGFDRDAHDATHYMEQIKLVGAATLGAVLDRLRGVGRPVTLVVYTLLLSWVADVARARSVPAALYWIQPATVLAVYLHFFRATDGVDRAIAAAGGDPWATVPVPGAPAAPR

SEQ ID NO: 79476 - DNA, 835 bp, Zea mays
  misc_feature: Ceres CLONE 1564553
  misc_feature: Encodes the peptide sequence at SEQ ID NO. 79477
  misc_feature (14)..(14): n is a, c, t, g, unknown, or other
  misc_feature (366)..(366): n is a, c, t, g, unknown, or other
tggagctccaccgncggtgggcgggccgctctagaactagtggatcccccgggctgcaggaattcgtctcacccctagaaaaaacatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgacntacacatccagaaggagtcaaccctccacttggtgctgcgccttaggggaagcatgcagatctttgtcaagactttgactggcaagaacatcaccctggaggtggaggtcttagacccccatggaccatggtcaagccaaagatccaggaccaaggagggcattcccacctgaacaggaaacgttttaatctttcccgggcaagcatttggaaggatggggaggacccttgggtgaattcaaacatccgaaaaggaaagcccccctccccttgggggccgggcccctaagggggggggtttgcccaaatttttgtgaaaaacccttttaggggggaaaacccaccacccttgggggggggggaggtctctccaaaaccccttgtaaaaagtgttaggggcccaaaatcccctgaaaaaagggggggggggttctccccccgggaaaaacaaaaaggggttgtttttttt

SEQ ID NO: 79477 - protein, 115 aa, Zea mays
  misc_feature: Ceres CLONE 1564553
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (59)..(59): Xaa is any aa, unknown, or other
MQIFVKTLTGKTITLEVESSDTIDNVKAKIQDKEGIPPDQQRLIFAGKQLEDGRTLADXHIQKESTLHLVLRLRGSMQIFVKTLTGKNITLEVEVLDPHGPWSSQRSRTKEGIPT

SEQ ID NO: 79478 - DNA, 824 bp, Zea mays
  misc_feature: Ceres CLONE 1564554
  misc_feature: Translation starting site: 141
  misc_feature (689)..(689): n is a, c, t, g, unknown, or other
ctccccgcggtggcggccgctctagaactagtggatcccccgggctgcaggaattcgtctcacccctagaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggaagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccggcggccccgctcngcgaggtcgtcgacccgctctatcccggcggcagcttcgacccgctcggccctcgcgaacgaccccgagggcctcgctgagctcaagggtgaggagctcaagaacgccggcctcgccatgtctcccaggttcgga

SEQ ID NO: 79479 - DNA, 818 bp, Zea mays
  misc_feature: Ceres CLONE 1564556
  misc_feature: Translation starting site: 356
ctccccgcggtggcggccgctctagaactagtggatcccccgggctgcaggaattcgtctcacccctagaaaaactagcctcatcccttctttgattcggcacccccgcctgctctctgctgccctcgccctgagtagaaggcctgcgagatgctatctccggatcaacaacacccgtacccctcttccacgtactgccgtgctgtccctcaccccatatccggatctacaatgttaccatgaacgataagggtgtacatgagttcccctactgtgtatcccttgtccctcgggagaaagagaatgtctccactcaggcctcttgaggctgcccgtcttgccatgctgcttctacatgacaacgtctgcatcacaggatgccttctcccttgcggtcctggctcaccccttccatgtccttcctatcatcaccatgctttcatgcgcttatgctgatacgctccccactggaatgacgggcgcctcttgtaagcctctgggcacctgtgcttcggcggacatcctccaggccctcctatctgatacatgcagaacaactatgctgcacatgccaatgaagctctgcatctcacctagttcaagttccctgctcccctaaagattattgacagcagacagtgccgcttcacctagctcatccgtgccgactgcctgaagtaccatactgaggctagaattcttcctgatggtcgtcacgctgagctgctcaggtactatggtacacttcacaagcctgctcctgggtaagctatcttcggagtcagtgcatgattccagtctacaagtccgtatgcgaa

SEQ ID NO: 79480 - DNA, 836 bp, Zea mays
  misc_feature: Ceres CLONE 1564561
  misc_feature: Encodes the peptide sequence at SEQ ID NO. 79481
ctggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctctcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggtgggctggactacctcgggaacccgagcctcatccacgcgcagagcatccttgctatctgggcctgccaagtcgtgctcatgggcgccgtcgagggctaccgcatcgccggcggcccgcgcggcgaggtcgtcgaaccgctctaccccggcggcagcttcgaaccgctcgggctcgccgaacaacccgaagccttcccccaagctcaaggcaagggagctcaagaaccgccgcctcgcccatgttctccatgtccggaattcta

SEQ ID NO: 79481 - protein, 229 aa, Zea mays
  misc_feature: Ceres CLONE 1564561
  misc_feature (65)..(216): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPRGEVVEPLYPGGSFEPLGLAEQPEAFPQAQGKGAQEPPPRPCSPCPEF

SEQ ID NO: 79482 - DNA, 1207 bp, Zea mays
  misc_feature: Ceres CLONE 1564563
  misc_feature: Encodes the peptide sequence at SEQ ID NO. 79483
  misc_feature (69)..(69): n is a, c, t, g, unknown, or other
  misc_feature (70)..(70): n is a, c, t, g, unknown, or other
  misc_feature (948)..(948): n is a, c, t, g, unknown, or other
  misc_feature (1040)..(1040): n is a, c, t, g, unknown, or other
  misc_feature (1144)..(1144): n is a, c, t, g, unknown, or other
aacgctgttgttctccccccctatgctgtcccggacctctttgatcctttttaaacgcttttttcattnnattttaaacctggagctccccgcggtggcggccgctctagaatagtggatcccccgggctgcaggaattcgtctcacccctagaaaaagccattagctgtcgctgggacggaaccggaacgtttctctagccctcgttcccgttcggccttgacaacccaccccgaccccaagttcccaacgcaaaagatcgaactgaatccatccacacatcgaccgccggcgggacagaccgacccgatcctatcgatcaaggatgtccaaaacgcctactctcttttaaagttacattattcatcggcgacacaaagcgtggggaaaagtcgtggcccgctggctgcagttcaaggaaaaagcactttccgccccaggcgacaacctcaccatcaggggcgaaatttcgggggccccccatggagtccccccccccccccaaaaaaccttttaaaccttcaaaaaattttggggaaaacgcggtttgggcccaaaagaaaccatctccaaaaacccagggccccagagtatcatattctaaccgaaaggcgccctctacagagggacccccccgtttgggggggtattattagtaaaaaacccccccggggagaggggagggggagtctcttaagaaaaaaaagttctgtctgctaaagatagtgtggggggttctacgcacaaaaaataatttaccaggggggcggcgcataaataggtaggaggtggcacgagttgtggaattgttataaaaataggtgtataacgagcgatagaataagacgtcgggcgggcggtgggggggaacacccgacacaagagctggtgagaaaaaatgatcgtacgtcacgtggagacaaaatagaacactctttcgcgtcatancggccatgagtgctaagtagcagagcaagaagagcggctctaagaaccggcctatatgtttttataatgagtgtgcggcctagcccgccgcncttgctgctctccaagcttatttatattgtataggaggggaagtgccaccgcatgtttgtagctccaaaaaagtatatgagccaccgaacatgaaacatagtcngacctggtggacgcgagacatatatatgtttcgtgaacaaaacgcgctatcgcgcagcgggaa

SEQ ID NO: 79483 - protein, 57 aa, Zea mays
  misc_feature: Ceres CLONE 1564563
MESPPPPKKPFKPSKNFGENAVWAQKKPSPKTQGPRVSYSNRKAPSTEGPPRLGGYY

SEQ ID NO: 79484 - DNA, 866 bp, Zea mays
  misc_feature: Ceres CLONE 1564565
  misc_feature: Encodes the peptide sequence at SEQ ID NO. 79485
ctccccgcggtggcggccgctctagaactagtggatcccccgggctgcaggaattcgtctcacccctagaaaaaagccgctagtaccagtagtcgtcgcgttagcaggcagatctgagttagccggcggatccgatccgtgcgcgtgcagtgtacgtgtgtcggtggagatggccacagcttacgctcccatggcgagccaggtgatgaagagcagcctcgtcgtgcactcgaggccgaggggcctgtcaggcgctgctgcgctcacgaggcggccgcggttcaccgtcaaggccatccagcccgagaaggcaacgtaccaggtggtgcagcccatcaacggcgaccccttcatcggcagcctggagacgccggtcacctccagcccgctcgtcgcgtggtacctctccaacctcccggcctaccgcaccgccgtgagcccgctgctgcggggcgtcgaggtcggcctcgcgcacggctacctcctcgtggggcctttcgcgctcacgggcccgctccgcagcacgcccgtgcacgggcaggccggcgcgctcggcgcccgccgcctcgtcgccatcctcagcgtctgcctcaacatgtacggcgtcgccttcctcaacgaaggggacccgtccagggggccttcgttcaagcttaccggcaggaagaggaggccaacaaactgcaaacttcccacggctgggccaagttacccgggggattcttcttcgggggattctccgggtggctttgggccaactttccccccaaagggctcgaactccccctaattttttaagaggaaaattccccgaagaagcgctatacaaagtctcgggccaaccccccctttaaccggcaaggaag

SEQ ID NO: 79485 - protein, 199 aa, Zea mays
  misc_feature: Ceres CLONE 1564565
  misc_feature (43)..(170): Pfam Name: PsaL Pfam Description: Photosystem I reaction centre subunit XI
MASQVMKSSLVVHSRPRGLSGAAALTRRPRFTVKAIQPEKATYQVVQPINGDPFIGSLETPVTSSPLVAWYLSNLPAYRTAVSPLLRGVEVGLAHGYLLVGPFALTGPLRSTPVHGQAGALGARRLVAILSVCLNMYGVAFLNEGDPSRGPSFKLTGRKRRPTNCKLPTAGPSYPGDSSSGDSPGGFGPTFPPKGSNSP

SEQ ID NO: 79486 - DNA, 829 bp, Zea mays
  misc_feature: Ceres CLONE 1564567
  misc_feature: Encodes the peptide sequence at SEQ ID NO. 79487
  misc_feature (715)..(715): n is a, c, t, g, unknown, or other
  misc_feature (761)..(761): n is a, c, t, g, unknown, or other
  misc_feature (777)..(777): n is a, c, t, g, unknown, or other
ctccccgcggtggcggccgctctagaactagtggatcccccgggctgcaggaattcgtctcacccctagaaaaagaaaaggccacttctgcctgtgtgcatcgcttgccagcttccgcctttccatgaccacgccgctcctgctgtgattctaggacgacgtgccgcccgggccggctgccttctcacgccgggagggttggggaacgagcgccgcagccgccgccgccaccacgaactcgcggaagaccataccgagatccaggggcaacgagccgccgctgcggacgtcgcagcgcgcgccgctgcacctcaagacgacggcctgctccgaggcgaatggcgcgcaccaccgccccgtcgccgaccggagtagccccagggtctcgccgcgcagccctctgcccgagaagaagcgtgcggcgggaacacgtgttgcggagctggagggcaagctggggaaggtgcaggaggagctcaagaagctgcgggagcagctcgcgtccgccgaggccgccaagaaggacgcgcaggtcgcgctcgaggaggccaagaagcgcgtcggtaccaagggaagcccagcctccaccaccaccaccactcctctctcccccccttcgcctggggtcgaaatcgccaagaagaccgaggagctgaagctgcctcagccggcagccgaggaggagagcagcatatacgtcccggcgaccgatgtngtttgagtcgtccggggcgagtcgggggacaaggagaaccagagcngcgctgaagtcctgcnaagtcgttagctgcggcggcggttaggcggcgggtgacctggccaaatatga

SEQ ID NO: 79487 - protein, 30 aa, Zea mays
  misc_feature: Ceres CLONE 1564567
  misc_feature (2)..(2): Xaa is any aa, unknown, or other
  misc_feature (23)..(23): Xaa is any aa, unknown, or other
MXFESSGASRGTRRTRAALKSCXVVSCGGG

SEQ ID NO: 79488 - DNA, 831 bp, Zea mays
  misc_feature: Ceres CLONE 1564568
  misc_feature: Encodes the peptide sequence at SEQ ID NO. 79489
  misc_feature (512)..(512): n is a, c, t, g, unknown, or other
ctggagctccccgcggtggcggccgctctagaactagtggatcccccgggctgcaggaattcgtctcacccctagaaaaaaaggccaatcccgagcagtggtgcgaaacctcgagcgctcgcgccggtgaccataacaaagaggaagccgcggtagcactggtagcggcagcagtaaggggaagatgtcgtcggcgttcagcggcgatgagaccgcccctttcttcggcttccttggcgcctccgctgcgctcgtcttctcatgcatgggggcggcgtacgggacagccaagagtggcgttggcgtggcgtccatgggtgtcatgcgcccagagctcgtcatgaagtccatcgtgcccgtggtcatggctggtgtgctcggtatctacggcctcatcatcgccgtcatcatcagcactgggatcaaccccaaggccaagccatactacctctttgacggctatgcccacctgtcgtctggccttgcctgtggtcttgctgggcttgctgcangcatggccattggcatcgttggtgatgctggtgtcagggcgaacgctcagcagccgaagtttgttgttggcatgatccctcatcctatttttgctgaagcgcttgccctctatggtctcatcgtcggcatttatcctctcgtctcgtgccgggccagtccccggccaaattgaaggcccgttttcgaattccaaccccccggcccccccaaacattttccctggcccaaaccgggggtcaggttttatatcccgggaaaaaaaaaacctggggcccctttggaccttttggaaggggctcccttttgagcccgcgccgt

SEQ ID NO: 79489 - protein, 166 aa, Zea mays
  misc_feature: Ceres CLONE 1564568
  misc_feature (14)..(79): Pfam Name: ATP-synt_C Pfam Description: ATP synthase subunit C
  misc_feature (93)..(158): Pfam Name: ATP-synt_C Pfam Description: ATP synthase subunit C
  misc_feature: SWISSPROT Homolog: EC 3.6.3.14 H(+)-transporting two-sector ATPase
  misc_feature (110)..(110): Xaa is any aa, unknown, or other
MSSAFSGDETAPFFGFLGASAALVFSCMGAAYGTAKSGVGVASMGVMRPELVMKSIVPVVMAGVLGIYGLIIAVIISTGINPKAKPYYLFDGYAHLSSGLACGLAGLAAXMAIGIVGDAGVRANAQQPKFVVGMIPHPIFAEALALYGLIVGIYPLVSCRASPRPN

SEQ ID NO: 79490 - DNA, 775 bp, Zea mays
  misc_feature: Ceres CLONE 1564570
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (316)..(316): n is a, c, t, g, unknown, or other
  misc_feature (331)..(331): n is a, c, t, g, unknown, or other
nnnnnnnnnnnnnnnnnnnnnnnnnnnnnnnnnnnnnnnnnnnnnnnnnnnnnnnnnnnnnnnnnggctnnnnnnncaaagctggaactcaccgcggtggcggccgctctagaactagtggatcccccgggctgcaggaattcgtctcacccctagaaaaaaaaaactccgtttcgaattctagggttttgctgctctccgaccccgagctccaaggccgcagcatcaggcgcgccccccctcgcgtgtgaccgagatggcgctgccgaatcaggggaccgttgattaccccagcctttcagctcgtcatcgtccngcgatggtgaaactngtaaaactacatttgtgaagaggcatctcacctggaaagtttgagaagaaatttgaaaccaaccctttggtgttgaaagtccatccgtttggatttcacccactaactgggggaaaaaatcaggttcctaccgggctggggaaatcccccaggggcaaaaaaaaaaaattttttgggggggccccccccgggggggggggaaatcccttttttccccccgggggccccatgtgggggcaaaaaaacccccaaggggttttggaaagggaaaaacccccccagggaggtgttttttttttttcaaaaaaaaaaaaagtttttcccccacccaccggggggagaaaaaaaaaggacaccccacctttttttaaaaggagggttcttttttttaaaaaaaaaaaaaaaccccccccccccccgtttgtgggccccccccccgccggc

SEQ ID NO: 79491 - DNA, 925 bp, Zea mays
  misc_feature: Ceres CLONE 1564571
  misc_feature (925)..(925): n is a, c, t, g, unknown, or other
acccgcggtggcggccgctctagaactagtggatcccccgggctgcaggaattcgtctcacccctagaaaaaaggcgagccgaggtgccgctttttcaattttcgggggccgtttcttggtttttccgcttgctccttcctcctatgttcctctcgctcgctcccctcccttccccgctcctcctcctccacctcctcctccctttcattgctacctccgctcgcgccactgtgctccgaccaaggggcaggatcggtgcccgtccgccagcatggactctggcgggcgcacacgacatggctgatgaggcgtcgggctcctcgctcggaaccaggtctgcggggaggaaaggtcacctccgaggggggatcagatggcaaccaaaaaaagcctaaccaggaagacaaagtcgtggccttgtttccagaaaccgggtgaacgaaaaaaaaatgtcgccgccatggaaaacccggggggcccaaatccccttttgttttccgagccccccggaaagttacatgggatcctttccttccacaaagcgaataggaatccgccgcgggggggggataccaaaaaacatcccgtatatatttttgttaccaccgggtggtgagtctcctccccccacttaacaaagaattgttggggggaggggataacccctcatattatccgcagggcggcgctaataaaaaaaaaaaagctttttggatttaaatgagagggagagggtgcccccagagaaaaacattaatttttttttgtggcggggggggggggaaaaaagaaaaaatgtatcgaccccttcttttttttggtgtagtatagcaccacattcttaggggggtgaggcgcctcacacaggggaataataaggcaaaacaattcctttttttgggtgtatcacagaaaaagagttgn

SEQ ID NO: 79492 - DNA, 1013 bp, Zea mays
  misc_feature: Ceres CLONE 1564574
  misc_feature: Encodes the peptide sequence at SEQ ID NO. 79493
cttagctggagctcacctgcggtgcggccgctctagactagtggatcccccgggctgcaggaattcgtctcacccctagaatagacgctcgcttctccaaatccccccttcgccttgcgagggggcggaggggaggtggtagtggtagggtatacaggagtgctctgcccatggagaacgcggggcaacaacgccatgttatcggcggcggcggcaacaaggcacccgcgctgggcctgcaaaagcagaactcttggccgccagacatcaatcactacgaggcatgagtacaccagcgcaaggtcatgcaccacgagtccaatgatcaacatccagcccatcttcttcacggactaaaacctactactagctcatttcactcatctacctagcgcctttgcttgcaaccacggcacacccattccgcattgctcctagaacctgcaacacaaaaggaaatagaccttctgaattattacttgcctccgcttatacctattatctaactacctaaccccagtcttgtctatcccccaccccccctccctcaaaataaaacatttctatcccctctacaattccaaacttaaaaattaattatcaaaatattaccactaaaagaataaatataaaattattaataacacttctctctacctatctaatataatctaaaactaaaaccaattaacccaatacataaagaatcgaaacaaactcaaataatgcaaatagactatcctcataaataccgtctatgagatcactccgtcaatcaacttagctcttcagacaaccactaatttgacaccattcattccaatactctctctacacctccccaactctctccagactcatctgcttacaagtcttcaaaatcctctatttacattttatttaatttattacactcaaacctcccacaccactatacaaaataacttttttacatcatataagtagcctaccctcctctattcacattaaaactcatttggactatcttactt

SEQ ID NO: 79493 - protein, 38 aa, Zea mays
  misc_feature: Ceres CLONE 1564574
MENAGQQRHVIGGGGNKAPALGLQKQNSWPPDINHYEA

SEQ ID NO: 79494 - DNA, 1280 bp, Zea mays
  misc_feature: Ceres CLONE 1564575
  misc_feature: Encodes the peptide sequence at SEQ ID NO. 79495
  misc_feature (62)..(62): n is a, c, t, g, unknown, or other
  misc_feature (70)..(70): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (1113)..(1113): n is a, c, t, g, unknown, or other
gtgtgtctgttctctttcccttttccgcctggttggggtacggcaccttcattccccccccncccccgcnntnnccaaaactggagctcaccgcggtggcggccgctctagaactagtggatcccccgggctgcaggaattcgtctcacccctagaaaaatcattgtcgcgtcctcgtccccgttccatttcattatccccccggagctggtgcgcgagtcggagctggtgcaaggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcccccccagcgactggcgaaacgccatgtacccagtcgtccccgggggcacgaagatcgtggggcgttgttgacacggcggtcgggcgggcgggcgttcacgcccggtttccaagggaccggcgaatcaccggttcggggccgtgggggcctaccttttcgttgggggggtcctttgccccggtttccctttggcgaacaagccttggctggctaaaagagggggggaaaccgaaaccaacatctaccttggccctcggaggggggaaattccgtgtggtctgttaagactcctatccacagaatgtggggccagtttgcttgaaaaaaccatatagtgggaggttcaatagaggaggtcgttgggaatgaaccgcgaccctctctatccaacatgagtggtggaggagggcgagttatatatctttctctccagaacacgtgttctccttatggtgtttcttccgccgatagacggaagaagcacacgcatataagcggtggtggtttcgccggcgggtttactccctccgagaacaggggcccctgtggtctcccctctggggagcacctgacaccccacgggggcccccgccttgttcttctttgatggtcctgcggggtgttatcacccgtggggtntatacgcgcctccccccataataatgggcgcccaccggcgacttcttctatatacgaactctctggggaaaagcagtacctcttctaggcgttgtcttcttcgggcttcttataggggggcctttttggctaacaatttgcccctcacggaagttgcgggcgagagg

SEQ ID NO: 79495 - protein, 75 aa, Zea mays
  misc_feature: Ceres CLONE 1564575
  misc_feature: SWISSPROT Homolog: EC 1.1.1.195 Cinnamyl-alcohol dehydrogenase
MEEQGGQAALGWAARDDSGVLSPYSFSRRVPKDDDVTIKVLYCGICHTDLHVPPSDWRNAMYPVVPGGTKIVGRC

SEQ ID NO: 79496 - DNA, 810 bp, Zea mays
  misc_feature: Ceres CLONE 1564576
  misc_feature: Encodes the peptide sequence at SEQ ID NO. 79497
ctggagctccccgcggtggcggccgctctagaactagtggatcccccgggctgcaggaattcgtctcacccctagaaaaacatcccttcctcaagaagccgagagcgagaggcgcaatgggcgaccgggcgtacgcgccggccgtgaagccggttcccgtgcgggccaccaacggcaccgcgaacggcggcggcgtggggcctccgcggcccgcgccgccgtccatggtgcccggcgggcgcgtgccccctccgccgatgtacaggcggaggcccgcgcagtcgcgtcctccggcgcggcgccccgggcggagcgcccgcgggtggtgctgcgcgtgctgcctgtggctgacgctggtgctggtggggctggcgttcctgggcgccatcgcggcgggggtgttctacgtggtgtaccggccgcggccgcccagcttcgcggtgacgtcgctgcgcctggcggcgctgaacgtgtcggactcggacgcgctcacctcccgcgtggagttcacggtgacggcgcggaacccgaacgacaagatcgccttcgactacggcgacatggcggtgtccttcgcctcgggcggcgcggacgtgggcgacgccgtggtcccggggttcctgcacccggcgggcaacacgacggtcatccgcgccgccgcgtccaccaccgcgtccaccatcgaccccgtccaggcggcggcgctcagatccaagaagtcccacgtgatgtcggcgcagatggacgccaaggtcgggttccagatcgggcgggtcaagtccaagagcatcaacgtccgcgtcagctgca

SEQ ID NO: 79497 - protein, 231 aa, Zea mays
  misc_feature: Ceres CLONE 1564576
  misc_feature (97)..(231): Pfam Name: Hin1 Pfam Description: Harpin-induced protein 1 (Hin1)
MGDRAYAPAVKPVPVRATNGTANGGGVGPPRPAPPSMVPGGRVPPPPMYRRRPAQSRPPARRPGRSARGWCCACCLWLTLVLVGLAFLGAIAAGVFYVVYRPRPPSFAVTSLRLAALNVSDSDALTSRVEFTVTARNPNDKIAFDYGDMAVSFASGGADVGDAVVPGFLHPAGNTTVIRAAASTTASTIDPVQAAALRSKKSHVMSAQMDAKVGFQIGRVKSKSINVRVSC

SEQ ID NO: 79498 - DNA, 735 bp, Zea mays
  misc_feature: Ceres CLONE 1564582
  misc_feature: Encodes the peptide sequence at SEQ ID NO. 79499
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (623)..(623): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
ccgcggtggcggccgctctagaactagtggatcccccgggctgcaggaattcgtctcacccctagaaaaaaaccccccaactccgttcattgcggcagccaaatcgagatctcgcccgtgctcaatcccaccactctcgccgactcatccggccgcagcaagcgcagcgcatcgacaggagccgaagaaccgaagaggagatggcgtcggcgctgtcctccctgcgctacggcgacagcctctcggtggtgggcatctccgccgcgacggccgtgctctgcgaggccatgtcctggctcctcatctaccgcaccgccacctacaactcccctnnncgcgcctccatcgagcgcccactccccgcaaggctagaagcccctgaaagtcccggtttccccctccccccctcccccccggggaccggccgccccctccttcccgggggaagacccccaatttttgttgggggggggttaaaaaaaaaaaaggggacccccgccctcaaaaaaacccccccccccaaagggaaaacccccccgcgccgggggggggaaaacctttttcttctttcccccccccaaaaatttttttaattttggggggggggggcgcccccccccccncaagccnnnngggggaagaaaggaaaggacccccctcctcttcggggggggagggggttgttttttgggggggggggggggggggggggggggataacaaaccacccccccc

SEQ ID NO: 79499 - protein, 130 aa, Zea mays
  misc_feature: Ceres CLONE 1564582
  misc_feature (45)..(45): Xaa is any aa, unknown, or other
MASALSSLRYGDSLSVVGISAATAVLCEAMSWLLIYRTATYNSPXRASIERPLPARLEAPESPGFPLPPSPPGTGRPLLPGGRPPIFVGGGLKKKKGTPALKKTPPPKGKTPPRRGGENLFLLSPPQKFF

SEQ ID NO: 79500 - DNA, 885 bp, Zea mays
  misc_feature: Ceres CLONE 1564586
  misc_feature: Encodes the peptide sequence at SEQ ID NO. 79501
  misc_feature (38)..(38): n is a, c, t, g, unknown, or other
  misc_feature (63)..(63): n is a, c, t, g, unknown, or other
  misc_feature (182)..(182): n is a, c, t, g, unknown, or other
ccgcggtggcggccgctctagaactagtggatcccccngggctgcaggaattcgtctcacccnctagaaaaaaaaaaaaaaaaaactacgggttccgggctttcggtggctattacttgcatctagcaagctccaccagtcacagccacacgggcggaaaaacgaaccgaggaacaatccgnggttctgcaggaacccactccaactgtgcggcgcgtccaaaaatacaaaaggcaagcgagcgagctccaagttcggctgctccaatttcactcggcatggctcctcaggcgtgggtcgtggcggagaacggcgaggacctccaacaacccagggaattcctgccgctctctaagcttgaagatgttggcgtgttgtattggcatttggaccctaagaagtctgaaagcgaggaggaactagcaaaaatccgcagagacagaggctacagttacatggatcttattgagatatgtcccgaccaacttggaaaactatgaggagaaggtgaaagaacttctttctgtgagcacatgcctcgcttacaaaagaaatccccctattggcttggaggggcaagcggggtacttttgacgtcccgcgaacaaaaatgaacaagtgggattccgaaatttcggattaagagaaagggaaaacatgaatcatcccttacccagctggggattttttcaatcgggtttcacccccccaaccgacggctaaatttacacgaacgctcattgaagagcttttctctatggggggaaaacacttcttggtgaccgcgtcttaaaaaccccccctctaaaaaaggaaccatgccccgtgctgagcgctaagaataattgtctgttaaagtgtgcacagtgcggtggctcctgtggt

SEQ ID NO: 79501 - protein, 73 aa, Zea mays
  misc_feature: Ceres CLONE 1564586
MAPQAWVVAENGEDLQQPREFLPLSKLEDVGVLYWHLDPKKSESEEELAKIRRDRGYSYMDLIEICPDQLGKL

SEQ ID NO: 79502 - DNA, 1042 bp, Zea mays
  misc_feature: Ceres CLONE 1564587
  misc_feature: Encodes the peptide sequence at SEQ ID NO. 79503
acccgcggtggcggccgctctagaactagtggatcccccgggctgcaggaattcgtctcacccctagaaaaaaagaacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctggggaccgtcaagtgcgcggccaccgtgcccgatgccgccccgatcgtctggggccgtcagctccgcccggggctcctcctaccccgggcgctgctcccttcgttgcaggtgtgtcccccccacacacttgaatccacccttccgcaaccccccgaggtccgcagggggagggccaagttctgggggttttccttggaaaaaataacccccgccccttggttacccgggctttctttttttctttcatgggggggaagcctccctccgaagggccgcatttgcaacaatctcctttcatccaagaaaggaaatttacccaagcctaacctttccccattaccccctataaaatattcgttaggtgcctttctgaaggcccgaattaccggttacagagtgtggcgggtggtcggaacactaacactgccccgtctaaataatacgtgtgggaatgtttctgcggtctcctcccccccaaaattagaagcgccccttattcccagatgaggaatacctcccccctcaagaggctgttcctttcttattcacaagtcgagcccctcggtagtcaaggggggaggtgtgtttctcgcatctcctctagcgcaagagtgggggctctattcccacgctggtggggagcagggcctccaatgtgtgaccctgcaccctagttgtgaacgtctttgtgagaccctttttatttaaacgaatgagaggctaacacttctgatccttccccgtgtgacacaaattcgctatgttttgttt

SEQ ID NO: 79503 - protein, 81 aa, Zea mays
  misc_feature: Ceres CLONE 1564587
MSALGTLSGGAAGVSGLLRLRRRAAPAPAIAAPSHLPAGDRQVRGHRARCRPDRLGPSAPPGAPPTPGAAPFVAGVSPPHT

SEQ ID NO: 79504 - DNA, 896 bp, Zea mays
  misc_feature: Ceres CLONE 1564589
  misc_feature: Encodes the peptide sequence at SEQ ID NO. 79505
  misc_feature (845)..(845): n is a, c, t, g, unknown, or other
tggagctccccgcggtggcggccgctctagaactagtggatcccccgggctgcaggaattcgtctcacccctagaaaaaacagcaccgaggcaggagcggcgatccattccacacaaccaccactgctcttgccccagcccgccgcaggagttgccagatctgccccggtcacaggaactccgactccgagccctctccaatggcggttaaggtctacgtcgtgtactattccatgtatggacatgttggcaaactagctgaagagatccagaaaggtgcctcgtctgttgaaggtgttgaagctaaaacatggctggtccctgaaaccctccctgaggaagtgcttggaaagatgggcgcaccccctaagcctgacgtgccagtcatcacgccgcaacaactcgcagaggccgacggaatcctcttcgggttcccaacgaggttcggaatgatggcagcgcagatgaaggcgttcttcgatgccactggggggctctggagggagcagagccttgccggcaaagctgccggcgtcttcttctgcactggatcccaggggtggtgggccaagaatacaaacgccgttgacagctatttcccagttgacccacccccggcatggtggttcgtgccttgtgggctaacacctttcagcgccccaaactgtttcggcatggaaccaggtttaagggcggggaagccccctaaagggggcccgggaacgtttaccccgccccaaggggtccaagggggggccccaaaccaagtgtggaaaccttgggagccccccccttctcaccccaggggggaagagtatctttcttaggggggtttccgctccaanaaagacccttcaagggggtttacaagccctgtaattcctccaccaacataa

SEQ ID NO: 79505 - protein, 208 aa, Zea mays
  misc_feature: Ceres CLONE 1564589
  misc_feature (7)..(133): Pfam Name: Flavodoxin_1 Pfam Description: Flavodoxin
MAVKVYVVYYSMYGHVGKLAEEIQKGASSVEGVEAKTWLVPETLPEEVLGKMGAPPKPDVPVITPQQLAEADGILFGFPTRFGMMAAQMKAFFDATGGLWREQSLAGKAAGVFFCTGSQGWWAKNTNAVDSYFPVDPPPAWWFVPCGLTPFSAPNCFGMEPGLRAGKPPKGGPGTFTPPQGVQGGAPNQVWKPWEPPPSHPRGEEYLS

SEQ ID NO: 79506 - DNA, 860 bp, Zea mays
  misc_feature: Ceres CLONE 1564590
  misc_feature: Encodes the peptide sequence at SEQ ID NO. 79507
ccgcggtggcggccgctctagaactagtggatcccccgggctgcaggaattcgtctcacccctagaaaaaccctcccggcctcccctcccttgccgtccacttcttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatccacgccgccaacaagctcgccagcaagcaccagcgcctcccgctcgaggcgctctccgccaagctcccgcgctgcgacgtctgccaggagaaagcggcgttcatcttctgcgtggaggaccgggcgctcttctgccaggactgcgacgagcccatccacgtcccgggcacgctctccgggaaccaccagcgctacctggccaccggcatccgcgtcggcctcgcctcggcttccgcctgcagcgacgcctgcgacgcccacgactccgaacaccacgccccgcccagggcaccattgaggcaccggaagccggcgttctcggcggcgtggaccatgtggccctccccgccccagtttcctgccccagggttggggccgccaaaaacctcctggatttccccaaatacgaattccggggacaaattggccaagggagcccaacccccgggtttcaaggaactgggaaggggttcccccaaaattgaactttttttcaaaaaaggggcccccaaaaaccaaaaaggaaattttgccgaaaggtcccgaaaatt

SEQ ID NO: 79507 - protein, 215 aa, Zea mays
  misc_feature: Ceres CLONE 1564590
  misc_feature (1)..(47): Pfam Name: zf-B_box Pfam Description: B-box zinc finger
  misc_feature (52)..(99): Pfam Name: zf-B_box Pfam Description: B-box zinc finger
MKIQCDACEGAAATVVCCADEAALCARCDVEIHAANKLASKHQRLPLEALSAKLPRCDVCQEKAAFIFCVEDRALFCQDCDEPIHVPGTLSGNHQRYLATGIRVGLASASACSDACDAHDSEHHAPPRAPLRHRKPAFSAAWTMWPSPPQFPAPGLGPPKTSWISPNTNSGDKLAKGAQPPGFKELGRGSPKIELFFKKGAPKNQKGNFAERSRK

SEQ ID NO: 79508 - DNA, 793 bp, Zea mays
  misc_feature: Ceres CLONE 1564593
  misc_feature: Encodes the peptide sequence at SEQ ID NO. 79509
tccccgcggtggcggccgctctagaactagtggatcccccgggctgcaggaattcgtctcacccctagaaaaaagcgcgctcctactctcccgcgatcgccaccggggaaggggcaatagaataaagtgagggcagccaatgcaggccgccgtcaacaccaccactgtcggcgctcacccgcacccaacaaagtcctcgttcctccgtccgtcccctccttgccgcgtctacttccacgcttctccacgcccgaaccttagggcgatcgccatggccagcaagtcgcagctgcaggaccaactgatcatcactcgccccgacgactggcacctccatcttcgcgaaggcggtgtcctcgaggctgtagtgccacacagcgcgaggcattttgggagggccatcatcatgcccaacctgaagccgccggtgaccacaacggcacgggccgtggagtacagggaggagataatgagggcgctgccgccagggagtagcttcgagccgctcatgacactatacctcacagacaacacaagcccagaggagatcaagctcgcaagaaagagtggtataatttttgctgtgaagttgtatcctgctggagcaactaccaatccccagatgggtgtcactgatatatttggggaatgcttgcccgtcctccaaggaaatgtcaggccagaaatgccgttgcttgttccatgaaaagtcccgaatccactgtttaaccatttgacccccagaaggttttccttgacaaatatttacaccccttgtaaaaaaaatccccat

SEQ ID NO: 79509 - protein, 144 aa, Zea mays
  misc_feature: Ceres CLONE 1564593
  misc_feature: SWISSPROT Homolog: EC 3.5.2.3 Dihydroorotase
MASKSQLQDQLIITRPDDWHLHLREGGVLEAVVPHSARHFGRAIIMPNLKPPVTTTARAVEYREEIMRALPPGSSFEPLMTLYLTDNTSPEEIKLARKSGIIFAVKLYPAGATTNPQMGVTDIFGECLPVLQGNVRPEMPLLVP

SEQ ID NO: 79510 - DNA, 849 bp, Zea mays
  misc_feature: Ceres CLONE 1564596
  misc_feature: Translation starting site: 617
ccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggagatggacggcacccccatcaaggtgggctccttcggcgagggccgcatcaccatgcgcaagacacgtgggcaagcccaatgtggcggcgtccggcagcccctggtacggccccgaccgcgacaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaactgcgtcaagttcggcgaggccgtctggatcagaggccagctcccagatcttcagcgagggcgggctggactacctcggcaaccccagcctgatccacgcgcagaacatcctcgccatctgggcctgccaggtcgtgctcatgggtgccgtcgagggctaccgcattgtcggcaggacgctcggcgaggtcatcgacccactagtacctggcggcagcttcgaccccctcggactgggcgacgacacgatgccttacgcgagctcagggtgaggagctcaagactgcccgctctcatgttatcatgtgcggcttcgcgtccggacatcttcaccggcatggaccgctcgagaactcgctgaccactcgctgac

SEQ ID NO: 79511 - DNA, 809 bp, Zea mays
  misc_feature: Ceres CLONE 1564597
  misc_feature: Translation starting site: 159
ctcctcggtggcggccgctctagaactagtggatcccccgggctgcaggaattcgtctcacccctagaaaaaagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctggtgcgcggtgggcgccatcgccccggagatcttcggcaagatgggcatcatcccgccggagaccgcgctgccgtggttcaagacgggcgtcatcccgcccgcgggcacctacaactactgggccgactcctacacgctcttcgtcttcaacatggcggctcatgggcttcgccgagcaccgccgccttcaggactggtacaaccccgggctccttggggcaagccagtacttcctcgggcctcgagaaaattccctcgccggctccgggcgaacccgtccctaccccgggccgggcccccttctttcaaacccgcctcgggctttcggcaaagacccgaaaa

SEQ ID NO: 79512 - DNA, 787 bp, Zea mays
  misc_feature: Ceres CLONE 1564599
  misc_feature: Encodes the peptide sequence at SEQ ID NO. 79513
  misc_feature (462)..(462): n is a, c, t, g, unknown, or other
ctccccgcggtggcggccgctctagaactagtggatcccccgggctgcaggaattcgtctcacccctagaaaaaatacccatccactgaccgcgaagtgcacagagggggggaaggaaggagacaccacccagatcgagttaccgtctgcgaggaggaaggagaagaggctgattcgatcgagcagcatggcgcggcggccacggccgtgtgcccacctgacggccacgctccttctgctcgccgtcgccgcggcggtcgccagagccgccgacggcgacgagaagtgcggcagcccgtgcggtaacccctgcggcgagccgtgcgtgtacgcgagcccgccgccgccgccggtctactacccggcgccgccgccgcccgtgtactcgccaccgccgccgccggagtactacccgccgacgaccccgaccccgaccacgccctactgcccgccgccgccgcngggcggctgctacgagccgtcgcccggatacacgcccgggtacaacccgacgccgccgtccggctccggctggtacacgccctcgtacaactcgccgccgggcacgctctacccgcaggacccctggttccggcccaacgccgcgccggcccgcgtcgccgcgccgtggcgcgcggcgctcttcctcgccgccactgcgtcagcggcgctggcccgcgactgcctggccttgtgacgcggtcagagaccgccggggatcacgacctccggcgatgggtgtcgcgtctacttggggccgcgcacgcggcgttgctgggagattctc

SEQ ID NO: 79513 - protein, 169 aa, Zea mays
  misc_feature: Ceres CLONE 1564599
  misc_feature (92)..(92): Xaa is any aa, unknown, or other
MARRPRPCAHLTATLLLLAVAAAVARAADGDEKCGSPCGNPCGEPCVYASPPPPPVYYPAPPPPVYSPPPPPEYYPPTTPTPTTPYCPPPPXGGCYEPSPGYTPGYNPTPPSGSGWYTPSYNSPPGTLYPQDPWFRPNAAPARVAAPWRAALFLAATASAALARDCLAL

SEQ ID NO: 79514 - DNA, 849 bp, Zea mays
  misc_feature: Ceres CLONE 1564600
  misc_feature: Translation starting site: 143
  misc_feature (622)..(622): n is a, c, t, g, unknown, or other
  misc_feature (630)..(630): n is a, c, t, g, unknown, or other
  misc_feature (631)..(631): n is a, c, t, g, unknown, or other
  misc_feature (668)..(668): n is a, c, t, g, unknown, or other
  misc_feature (709)..(709): n is a, c, t, g, unknown, or other
  misc_feature (710)..(710): n is a, c, t, g, unknown, or other
tggagctccccgcggtggcggccgctctagaactagtggatcccccgggctgcaggaattcgtctcacccctagaaaaaatcactgcactggtggtgtccgtggtgctccacagagtgaagcgatagccaggagaggcgacgatgcgcaagtgggcgctctcctccgcgctcctcctcctctttctcctcaccacactccccgacccagctaagaagctacaagtgaatgccgaggagagcagcgatgacttggctaacccacccaaggtagaggagaagcttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttcccttactgataaggaagttctgggtgaaggggacactgcaaagcttgagatcagattagttggacaagagaagaaatcctctcattcgggataggggtattggtatgaccangaagatcnntataagaaccttgaaacgatgctaaatctggcacttncagctttgtggaaaagatgcagtctgggagtgacctcaatnnctatggaagtttgggtgtgggcttctactctgtggactgggttgctgactatgttgaagtggtccgcaggcccatgatgataaaccgtttgtgtgggaaatcaaaagcgaagggatcattggccatttctggaggaaca

SEQ ID NO: 79515 - DNA, 841 bp, Zea mays
  misc_feature: Ceres CLONE 1564601
  misc_feature: Encodes the peptide sequence at SEQ ID NO. 79516
ccgcggtggcggccgctctagaactagtggatcccccgggctgcaggaattcgtctcacccctagaaaaaatcccttctcccgatcacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaagggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggccgtgatgcgcacccacgaccacatcttcgcgtcccggccgtggtccatggcctcccacatcctccgctacaacacctgcgacgtggccttctcgccgctcggcgaatactggcagcagaccaggaagctgatgaacacgcacctgctcagcaacaagtaggtctactccttccgccatggccgcgaggaaagagtgtgcctcgtcgtggacaacctccgcgaggcgggccgcaagtcgccgtcaacggccgtgtacatgagcgaggtgctggccgcgtacacaacaacctgttgagccggtcggtggctgggctccacccaccggaagaaaggccggaacagtttgttcgggaaaatgaccctgaaccaacggggacccccgggtgggggttcaacccgggagataccact

SEQ ID NO: 79516 - protein, 166 aa, Zea mays
  misc_feature: Ceres CLONE 1564601
  misc_feature: SWISSPROT Homolog: EC 1.14.13.68 4-hydroxyphenylacetaldehyde oxime monooxygenase
MALQAAYEYLQQAVGHGAWSSTQTLTLLLIAVPTVLLLLASLAKSTSSSGKGKPPLPPSPPGTLPIVGHLHHIGPQTHISLQELVAKYGHNGFLFLRAGAVPTLIVSSPSAAEAVMRTHDHIFASRPWSMASHILRYNTCDVAFSPLGEYWQQTRKLMNTHLLSNK

SEQ ID NO: 79517 - DNA, 1066 bp, Zea mays
  misc_feature: Ceres CLONE 1564603
  misc_feature: Encodes the peptide sequence at SEQ ID NO. 79518
  misc_feature (19)..(19): n is a, c, t, g, unknown, or other
  misc_feature (20)..(20): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (72)..(72): n is a, c, t, g, unknown, or other
  misc_feature (74)..(74): n is a, c, t, g, unknown, or other
  misc_feature (75)..(75): n is a, c, t, g, unknown, or other
  misc_feature (529)..(529): n is a, c, t, g, unknown, or other
  misc_feature (779)..(779): n is a, c, t, g, unknown, or other
agatagtaaggaaaacggnnaagagaacccaacacacgccccggggggccgcgcnnnccacgctaaaagggnannaaaaaatggaactccccgcggtggcggccgtctctagaactagtggatcccccgggctgcaggaattcgtctcacccctagaaaaaatcccttctcccgatcacgatggctctccaggcagcctacgagtacctgcagcaggccgtcggccatggcgcgtgggcgtccacgcagacactgacgctgctgctcatagccgtacccaccgcactactgctgctagagtccctcgcctagatcacgtcgacgtccggtaagggcaagcagccgctccctccctcgccgccgggcaccctccccatcgtggggcacctacaccacatcgggccccagacccacatctcgctccaggagctggtggccaagtacgggcacaacggggttcctgttcctccgcgccggcgcccccgcgcaaccctgatcgtgtgcgtcgcccaggcgccgccgtaggccntggattcgcacccagcgagcacacctcttcgcgatcccgggacgtaggtcccatgagccctccccactatccggccggctgacaaccagcctggcgcacagggggactttacttccgccggcctcggggcgaaaaaactggggccagcaagaacccacgggacaagcctggaatggaaaccaccggcgacccttgggcttcaggcccaaacggaaaggaaagggggtcctaaacaatccctttttccccnccccattgtgagcccgcccaaagggaaacaggaaggagtggtgggccccttcggttcaaatgggaaaccaaagcccttccccccggaagagcccgaagccaaccccaaaaattccgacccgattcggaaacggggcccaatggggaaccattgtaagccttaaaggtggccttggggcggggcttttaccacccaaaccccacgcttgggtggaaaagcccggagtccggggtggcctcggggagttccgaagcggccaccccggaaaaagaaagagggccccggaa

SEQ ID NO: 79518 - protein, 43 aa, Zea mays
  misc_feature: Ceres CLONE 1564603
MALQAAYEYLQQAVGHGAWASTQTLTLLLIAVPTALLLLESLA

SEQ ID NO: 79519 - DNA, 841 bp, Zea mays
  misc_feature: Ceres CLONE 1564604
  misc_feature: Encodes the peptide sequence at SEQ ID NO. 79520
acccgcggtggcggccgctctagaactagtggatcccccgggctgcaggaattcgtctcacccctagaaaaactctatcttcgcatctggcacgagcagccaagcaaataaaagtagagcggcgagcgacgaccggcctgggccaccctttcggccgagcgtagccgagcaggtcgtcgtcgtcgtcgcagcaccccgccggctagcatggccacgaggaggcagtggtggtggtggtgcctgctgctgctggcggcgtggtgctgcgccgcggccgcgcagtcgccgccggcggcgggcccgctgcagagcaagtgccagggggacttcgggaagctgacggactgcatggactacgcgacggggcacgcggcgtcgccctcgtccacctgctgcggcgacgccggcgacacggagaaggcgcgccccgagtgcctctgctacatcatccagcaggtgcacacggggcgcaaccaggtgcagtcgctcggcctgcgcttcgaccgactcatggcgctccccggcgcctgcaacctcccccactccacgtctcgctctgcatcagtgagtgctagcgactcccgctccctccctcactgaccatggcagtgttagctctgattaaaggcggctgatcacctgcaaatgatgaaaccccagtgggcttgtgtgctttggtttggcccggctttgcctgggatcgggatttcagcccaggctccctagctttccaaccctcccgaattaccaattttttaaccggacccgcttttgtggaattcccaacctatacctttcccctttgcgaaaaaaccctctttggagaaattaaatatttttt

SEQ ID NO: 79520 - protein, 130 aa, Zea mays
  misc_feature: Ceres CLONE 1564604
  misc_feature (37)..(115): Pfam Name: Tryp_alpha_amyl Pfam Description: Protease inhibitor/seed storage/LTP family
MATRRQWWWWCLLLLAAWCCAAAAQSPPAAGPLQSKCQGDFGKLTDCMDYATGHAASPSSTCCGDAGDTEKARPECLCYIIQQVHTGRNQVQSLGLRFDRLMALPGACNLPHSTSRSASVSASDSRSLPH

SEQ ID NO: 79521 - DNA, 779 bp, Zea mays
  misc_feature: Ceres CLONE 1564605
  misc_feature: Encodes the peptide sequence at SEQ ID NO. 79522
ctccccgcggtggcggccgctctagaactagtggatcccccgggctgcaggaattcgtctcacccctagaaaaacatcccttcctcaagaagccgagagcgagaggcgcaatgggcgaccgggcgtacgcgccggccgtgaagccggttcccgtgcgggccaccaacggcaccgcgaacggcggcggcgtggggcctccgcggcccgcgccgccgtccatggtgcccggcgggcgcgtgccccctccgccgatgtacaggcggaggcccgcgcagtcgcgtcctccggcgcggcgccccgggcggagcgcccgcgggtggtgctgcgcgtgctgcctgtggctgacgctggtgctggtggggctggcgttcctgggcgccatcgcggcgggggtgttctacgtggtgtaccggccgcggccgcccagcttcgcggtgacgtcgctgcgcctggcggcgctgaacgtgtcggactcggacgcgctcacctcccgcgtggagttcacggtgacggcgcggaacccgaacgacaagatcgccttcgactacggcgacatggcggtgtccttcgcctcgggcggcgcggacgtgggcgacgccgtggtcccggggttcctgcacccggcgggcaacacgacggtcatccgcgccgccgcgtccaccaccgcgttcaccatcgaccccgtccaggcggcggcgctcagatccaggaagtcccacgtgatgtcggcgcaaatggacgccaaggtcggggttccagaatcggcggtccaaagtcaa

SEQ ID NO: 79522 - protein, 223 aa, Zea mays
  misc_feature: Ceres CLONE 1564605
  misc_feature (97)..(222): Pfam Name: Hin1 Pfam Description: Harpin-induced protein 1 (Hin1)
MGDRAYAPAVKPVPVRATNGTANGGGVGPPRPAPPSMVPGGRVPPPPMYRRRPAQSRPPARRPGRSARGWCCACCLWLTLVLVGLAFLGAIAAGVFYVVYRPRPPSFAVTSLRLAALNVSDSDALTSRVEFTVTARNPNDKIAFDYGDMAVSFASGGADVGDAVVPGFLHPAGNTTVIRAAASTTAFTIDPVQAAALRSRKSHVMSAQMDAKVGVPESAVQSQ

SEQ ID NO: 79523 - DNA, 1326 bp, Zea mays
  misc_feature: Ceres CLONE 1564607
  misc_feature: Encodes the peptide sequence at SEQ ID NO. 79524
  misc_feature (1041)..(1041): n is a, c, t, g, unknown, or other
cgaataaaaaagtaacaaacaacatactttaatacaatataaaacaaaagatataataagaaaccacggcggggaattggaactcccccggtggcggccgctctagactagtggatcccccgggctgcaggaattcgtctcacccctagagaaaaaactaaccccaaaccccaatccaccccatcccctcctcatccactccgggcggccatggcctgctccttctccgccgccatcaccgtctcttccgcccctaccccggtcgccagacccctcgctgctgccccgcagtccgtctgcatcgctcgctacgcggtcgccaccactgccaggccgctccgactcgccgcctcaaggtccgcgcgggctaccagactcgttgcccgcgccagcgtaatcgatgacttgccgctggtcgcggaacaaggcgccagacttagaagccgaggctgcgctcaaccaatatttcatcaaccttgaaggctctctgattacatttgagaaagaaataacacaattactgattcattctacccctagataatctcaaccttccatctagccacgaaacagaaagattaacctgccattttctgtaggaacagaattacctataagaaattttggaagaaaaactagaaacccaccttgaaggggttcccatgggcgatggtctttcaccataccgggcaccaattggtgttgaattttctatcaatccaaacaccttttgggcctaattggctggggtggtgccctagattaacacagaaaaacctagagcgaagaaaaatagtatattcatcgcgtgctaattttaacatggcccatatctacaaatgcacggacgataaagctctattttacagaaatataacaaacgccccgcgaacacctctatgcgatctctttagcgatctagaactagaaggcgtaaaataaataccgcaatgaatcgctcaagaattccaattggctcaggagagagcggggaggcaagttgataatgagagatgcggttttttctgtgctgatatctancgccctcgctgtataacaccgaagtcggggaagacgcttatgtaactttaagtagattctccctctctcatatagcccggaccacacactacagaaacattgtctacgatgcagcagtgatgaaaattgtaaattatttttgattagttagagatatactatctatatacttcctaatttaagattacaaataagacacgtatgatcccaaatattctagactctgcttcaaatatattgtgatataaaggtacacccccttttaagcgtatatctctcctctat

SEQ ID NO: 79524 - protein, 47 aa, Zea mays
  misc_feature: Ceres CLONE 1564607
MTCRWSRNKAPDLEAEAALNQYFINLEGSLITFEKEITQLLIHSTPR

SEQ ID NO: 79525 - DNA, 672 bp, Zea mays
  misc_feature: Ceres CLONE 1564608
ctcacccgcggtggcggccgctctagaactagtggatcccccgggctgcaggaattcgtctcacccctagaaaaaatctctctcttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggaatggaggtgtcactcaagttcgctcctttgccaaggatgcagctccagctgaccgtcctcctgtcggtggggatgatctcctgaagggcatattctttgaggtaaagaagaagtttgagacagctctttggtgtttctttaaaaggaaaaagatcactattgatccagatgacccaagcgggcagtttctcgtttatggccaaaatcaatgtaaaaaactgttaaagggaaaaaggggggaaatcttccccccggaaattccccaaagggggtttaaaaatttcccccttttggggaaacccttttccccccaagggggggccttccccccccttattttaaccccccgggaaaagatttttttttgtgaaaaaaaaaacttttttttaaaaaaaaggtttcctaaaaaaaaaaaaaaaggaaggggggggggggtttttttatta

SEQ ID NO: 79526 - DNA, 816 bp, Zea mays
  misc_feature: Ceres CLONE 1564609
  misc_feature (668)..(668): n is a, c, t, g, unknown, or other
ctccccgcggtggcggccgctctagaactagtggatcccccgggctgcaggaattcgtctcacccctagaaaaaactctcctccttcctccaccgccgccaacgtcgcctggcggccgtctgcagctccgcgcctctgctcggaaggtgttgcaaccgtcgaaaccttctttccctttgtttctgccttagactagctgttgcgctcgccttatctcgtacggttatcactagaaccgtccctaattccattttcgtgatctggtttcggtcatttgatggttttatttgttccacctgtagttgtttaggtctagtcactgttggttgccttacttttcgttgtgctatatggaccagggaacccgctttgcagcagagatttgttctgtgtttctgctgccagtagtcaccagacagctaaatctagttttgaattatattggtcatttagatgttgtgtcaccctttcgaattgaatgcccattcatttggttgctatgtgttttggcgttgcatagttgcctatttcattaatgtgcgagatgcacgaggattgaaccgttgcagcaggaatttacttttggttgtgtttctgctgcctgtaaaatcctggtatttctgtggctgtaaactaaactggtttctgccgcctgtctaatcctgttnattcgtgtggctgcaaacttaacttgttacttaataacattgtttgctgaatctctcagggtttttgaacttagtttgcatccataaaccataccaaatcatccattccggttttttcctttcctttggtttcaagtaaaaaatatgg

SEQ ID NO: 79527 - DNA, 980 bp, Zea mays
  misc_feature: Ceres CLONE 1564610
  misc_feature: Encodes the peptide sequence at SEQ ID NO. 79528
  misc_feature (807)..(807): n is a, c, t, g, unknown, or other
ggcggccgctctagaactagtggatcccccgggctgcaggaattcgtctcacccctagaaaaaacaccatcgacgacagcacagctaacccaatcccaaatcaatcttccatggcgccggcgaccttgctactggcgagactggccgtggcgtgcgcgctggcgctcggcgccatggcgcagctgtcgccgacgttctacgacgcgagctgccccagcctgcaggccatcgtgcgggccgggatggccgccgccgtgcagcaggagccgcggatgggggcctccatcctccgcctcttcttccacgactgcttcgtccaggggtgcgacgcgtccgtgctcctcgacgactcgcctacgctgaccggggagaagaacacggggcccaacgccaacttcctgcgcggcttcgagggcatccactccatccagtccccggggggagggccgcctgccccgggaaccgtctccttgggccggacgtccctagtccctccccgccgcgccgccggggtctatcctgcctaaaggcggtcccgaccttgtgcgcggtggcaacctggggctcgccccggtcctcaccctcccaggcgaagtcctgcgcgggcggcctgaaatatatcagcactaaggcggcgcgccgcgctgttggatagccgccgtcgggcggcttgggggtgtgcgcggcgcttcttccgtcaccccggcgggggcgctagaccttctcgtgagaaccacctgggggtgtctcccgctaggaggtaaaaccacaacatcgtgcagggatagcgcccgggcgtccccgctnggtcgcgtgcctagtcggcgcgggtgggagacggttggttgcacgccggtggcgtgtttggcccgaacagttacactcgatatcgtgtgagtgtggaagtttcctgtgcgcccagacagtggagaccactcgcacgccgcaagaaataattcgagtatgtcgtgcggtgcccg

SEQ ID NO: 79528 - protein, 138 aa, Zea mays
  misc_feature: Ceres CLONE 1564610
  misc_feature (41)..(139): Pfam Name: peroxidase Pfam Description: Peroxidase
  misc_feature: SWISSPROT Homolog: EC 1.11.1.7 Peroxidase
MAPATLLLARLAVACALALGAMAQLSPTFYDASCPSLQAIVRAGMAAAVQQEPRMGASILRLFFHDCFVQGCDASVLLDDSPTLTGEKNTGPNANFLRGFEGIHSIQSPGGGPPAPGTVSLGRTSLVPPRRAAGVYPA

SEQ ID NO: 79529 - DNA, 799 bp, Zea mays
  misc_feature: Ceres CLONE 1564613
  misc_feature: Encodes the peptide sequence at SEQ ID NO. 79530
  misc_feature (597)..(597): n is a, c, t, g, unknown, or other
ctccccgcggtggcggccgctctagaactagtggatcccccgggctgcaggaattcgtctcacccctagaaaaagtgttccttgcttcgtcctcacgtgccgtggcccttccgcttcccccgtatccgcccgcccgtcctgttcccgccccgagcgaaccggcggcgtgtcggtcaggggagagggcggaggcgatgcagcacgagccgtggcggcctggcgctgagcccgccgccggggctggggcgggtcctgcccccaccaccgtcgacgaggcgtccatggagcggagcatgagcttcgtcaaggcgcttcaggagctcaagaacctgcgcccgcagctctactcggcctccgagtactgcgagaagtcctacctccgcagcgaacagaagcaagtggtgctggacaacatgaaagattacgctgtcagggccctggtcaacgctgtcgaccatcttggcacagtggcctacaagctgacagacctatacgaagagcaggcttcagaaataacaaccctcgagttgaaagtagcatgcttgaaccagcaagtccgtacctgccagacatacacggacaaaagaagcctcaganctcagcagatgatgggggctgccagaagacaccataccattacatcgtaccatatgcgggaaacaaaagatgcaggccttctctgttacgcagccgatgctgatttcgacccacgccaaggcctttctcttcagcagggacccctgaagtgccatttgggttccgagaagatttccaaaacagtagaccagatcagtctgaa

SEQ ID NO: 79530 - protein, 201 aa, Zea mays
  misc_feature: Ceres CLONE 1564613
  misc_feature (135)..(135): Xaa is any aa, unknown, or other
MQHEPWRPGAEPAAGAGAGPAPTTVDEASMERSMSFVKALQELKNLRPQLYSASEYCEKSYLRSEQKQVVLDNMKDYAVRALVNAVDHLGTVAYKLTDLYEEQASEITTLELKVACLNQQVRTCQTYTDKRSLRXQQMMGAARRHHTITSYHMRETKDAGLLCYAADADFDPRQGLSLQQGPLKCHLGSEKISKTVDQISL

SEQ ID NO: 79531 - DNA, 1185 bp, Zea mays
  misc_feature: Ceres CLONE 1564614
  misc_feature: Encodes the peptide sequence at SEQ ID NO. 79532
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (758)..(758): n is a, c, t, g, unknown, or other
  misc_feature (762)..(762): n is a, c, t, g, unknown, or other
  misc_feature (776)..(776): n is a, c, t, g, unknown, or other
  misc_feature (777)..(777): n is a, c, t, g, unknown, or other
  misc_feature (828)..(828): n is a, c, t, g, unknown, or other
  misc_feature (839)..(839): n is a, c, t, g, unknown, or other
  misc_feature (840)..(840): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (910)..(910): n is a, c, t, g, unknown, or other
  misc_feature (927)..(927): n is a, c, t, g, unknown, or other
  misc_feature (929)..(929): n is a, c, t, g, unknown, or other
  misc_feature (930)..(930): n is a, c, t, g, unknown, or other
  misc_feature (1106)..(1106): n is a, c, t, g, unknown, or other
  misc_feature (1148)..(1148): n is a, c, t, g, unknown, or other
aacgcaggggttacacgccaggcgttcattccccccccaccagtaagatattacacccttctnnnnntttttaaaaactggactccccgcggtggcggccgctctagaactagtggatcccccgggctgcaggaattcgtctcacccctagaaaaatcggttcctcccctttcgccctacttgcttcccacgccagggcccgagctccgagctagggtttcctctctcgacgccgccgccgccgccgccgccgacggagaagaggagtaggtgaagccgagttattagcgccaggggaggaacatggggacgccggagacgtcgcgggagccatgcccggaccggatcctggacgacgtcggcggcgcgttcgggatgggcgccgtctggggctcgggccttcaccttcatccagggcatctacaactcccccaacggggatgcccatttccggggggcgcgcagggcgttggccccccacacccccccccccggtggggggtgaggctttccaccctttttgggggcgggccttctttcttataacctttctgaatgggccccccccacggctataattaccctgcgtcgaaaaaggggagggattcccccgtgggagaaaactcccccttttatatcgcggcgggggggctcccccccccctcgccggggggtagggggcggaattttacctcaccccctaataaagagccacccaccccagatgggtggtcaaaataggggtagggtggtgctcntctntgtgtgaggggcannactcatcagttgatctctcccctgagaagtgttaattcatattatatacgnggagtcttgannggggaggagagaggaacactagcatccagagaaggtgagagttgnnncctattaatcatatatagatagnatggacgagtcactccntnnaccacacgtaataacgcaaatcatcatacagaggtgtggtagtatagagacagtgaaagagtgagagagtgattctatataatcgaatgaatactccgactagtgcgcggtgtgttgaacacttaatatactaggacgagaagaggatagaagtggactatcacccaaatcaatgntactacacgtagagaggcgtgtagggagtaagtagattcgtntgtaaataccaatatacaaggctatcagcggtccctg

SEQ ID NO: 79532 - protein, 80 aa, Zea mays
  misc_feature: Ceres CLONE 1564614
MGTPETSREPCPDRILDDVGGAFGMGAVWGSGLHLHPGHLQLPQRGCPFPGGAQGVGPPHPPPRWGVRLSTLFGGGPSFL

SEQ ID NO: 79533 - DNA, 766 bp, Zea mays
  misc_feature: Ceres CLONE 1564615
  misc_feature: Encodes the peptide sequence at SEQ ID NO. 79534
ctccccgcggtggcggccgctctagaactagtggatcccccgggctgcaggaattcgtctcacccctagaaaaaaatcccatcccctcaggcctcagtcgtcagtccctcacacactcactatacactgctctgctgcagcaagaaggaagaagctagcgcctccctagctctcgttgtcagcaatggcctgtcctgcgcgtacgagccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtggctgggcgggcagctgttctcggccatggtggtgcgcaggccggcgcacctgttcctggacgagctgggcgtgggctacgacgaggccgaggactacgtggtggtcaagcacgcggcgctgttcacgtccaccgtgatgagccggctcctggcgcggcccaacgtgaagctgttcaacgccgtggcggtggaggacctgatcgtgcggcgggggcgcgtccgcggcgtggtcaccaactgggcgctcgtgtccatgaaccacgacacgcagtcgtgcatggacccccacgtgatggaagccaaaggtggtggtcagcctcctgcggccacgaacgggccctt

SEQ ID NO: 79534 - protein, 144 aa, Zea mays
  misc_feature: Ceres CLONE 1564615
  misc_feature (1)..(144): Pfam Name: Thi4 Pfam Description: Thi4 family
MTRRYMTDMITHADTDVVIVGAGSAGLSCAWLGGQLFSAMVVRRPAHLFLDELGVGYDEAEDYVVVKHAALFTSTVMSRLLARPNVKLFNAVAVEDLIVRRGRVRGVVTNWALVSMNHDTQSCMDPHVMEAKGGGQPPAATNGP

SEQ ID NO: 79535 - DNA, 840 bp, Zea mays
  misc_feature: Ceres CLONE 1564619
  misc_feature (312)..(312): n is a, c, t, g, unknown, or other
atagctggagctccccgcggtggcggccgctctagaactagtggatcccccgggctgcaggaattcgtctcacccctagaaaaaaggatagagaagagatacacgcagaccagtagcaagccaagcagcgcccacgcccccacgagggccacgaccaccaccacccccgccgccgccgcggcaaactgctactgcccaaccgcgggatggaggtggacgccactgccttctgcccgccgtcccagcccgcgccttgctgcctcccgggcttcaagccgcctgcgcccgtgcttggcgcccgttgaaccgtcncgcccgttggcaagtcaccgcccccgccggaagaagcaattacgcggcgttcggatgcgcaagtgggggaagtggggggggggagatacccgaattgaaaaaaagggcccggatattgggttggggcctaatccaacacccttgtcccccccggggggcctacaaaaagggaggttttttggctccccgggcggctccccgcggggtttaattttccccaaaaattttaagggggggggggtgggggacaaaccccccaggggggccaaaaaaaggcgccgggggtttaaaaacggccgccattccccaaaaaagagggggccagagtttttttcccccctttttaaaacacccacctttttttggggggcaaggaggggggagttctggggcaatcttccctcaacccggggttgtgttttttttggcgcgccccccccaaaataaaccacccccacacacggggggggggggcccccggggggagataatactttaaaagatatattacgcccgccttttttatat

SEQ ID NO: 79536 - DNA, 850 bp, Zea mays
  misc_feature: Ceres CLONE 1564620
  misc_feature (459)..(459): n is a, c, t, g, unknown, or other
  misc_feature (524)..(524): n is a, c, t, g, unknown, or other
  misc_feature (638)..(638): n is a, c, t, g, unknown, or other
agctccccgcggtggcggccgctctagaactagtggatcccccgggctgcaggaattcgtctcacccctagaaaaattctgaggatgaattgagagaaaaatctgttttggccattcgggaatattacagtgcaaaagatgaaaaggaggttgctttgtgtattgaggagctgaatgctccgagtttctatccttctgttgtatcactttgggtaaatgattccttcgagagaaaagacatggaaagagagttgttggctaaacttctcgtcagcctttgcagtggtcgacataatttgttgagcaagcaacaactcagtgatggcctttcatctgttcttaccttattggaagatactctaagtgatgctccaagggctaccgagtaccttggacgactttttgcaaggtttgtggaggaaagcatattgctcttggaagaggtaggtaaattgattncagaagttggagaagaacagggtatctaatacgagatggcatcgccgctgacatccttggtgctngtctggatccataaaatcagacaaaggggatcattctttgatgaggtaagttccactcgagttaaaaattggtgatttcagacacatcatctaagcgatcaagttgggatgccntcatgtagccacatggagttattattacctgattcccccatgggtgccgcccgcaagcagttactttggttcgccccaaatcccatccgcccttttttagtgccggggaaaaatcccccggaaggcacccccaatggggggcacgcgaacgggccctttttaaaaagaggagggcatgggcccccctttttttcaaaggggagggcggggga

SEQ ID NO: 79537 - DNA, 778 bp, Zea mays
  misc_feature: Ceres CLONE 1564621
  misc_feature: Encodes the peptide sequence at SEQ ID NO. 79538
  misc_feature (639)..(639): n is a, c, t, g, unknown, or other
  misc_feature (656)..(656): n is a, c, t, g, unknown, or other
  misc_feature (667)..(667): n is a, c, t, g, unknown, or other
  misc_feature (702)..(702): n is a, c, t, g, unknown, or other
  misc_feature (709)..(709): n is a, c, t, g, unknown, or other
  misc_feature (717)..(717): n is a, c, t, g, unknown, or other
  misc_feature (718)..(718): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (729)..(729): n is a, c, t, g, unknown, or other
  misc_feature (736)..(736): n is a, c, t, g, unknown, or other
  misc_feature (743)..(743): n is a, c, t, g, unknown, or other
ctccccgcggtggcggccgctctagaactagtggatcccccgggctgcaggaattcgtctcacccctagaaaaagcgcaaccggggtggcaacgagcagaggtgtgcctagctcatcgatcaacaagtgagtagtagcaccttcaccatggcagacaagaagaaggtggaggtcaaagagacgaaggtggaggtgaagacggccgtctacaaggtgtacgtccactgcggccagtgcgcgcgcgacatccagacgcagttcaccgagttccaaggggttgaagaggtgaaagtggacgccggggccgggaaggtgacagtgaagggcttcggcttcgacgtcgagaagctgaggaagaaagtcgagaagggttgccggaagaaggtcgagctgattccgcccgcgcctcccaaggacgacatggtcgttgatgtcaagaccaaaaaggaggagctcaaggtcataactgtaaagctgccgttgcattgccccgattgtgcagtcagggtcaaggaggttttgcttgagaacaagagtatctacgaagccaagacggatctcggcaagaacacgtgcaccatcgagggtgtcatttgagaggacaagctcgtcaagtacatctacgagaggatgcgcaangaagggcgtcgtcgacnagggtcgaaangaaggtgatcatcaaggaggagaagtcttataaanggcgggntaaggggnngggggnnnaanggggggnggggggnaagggaaaaaaaaagggaaaagcccggggaaaggt

SEQ ID NO: 79538 - protein, 149 aa, Zea mays
  misc_feature: Ceres CLONE 1564621
  misc_feature (19)..(84): Pfam Name: HMA Pfam Description: Heavy-metal-associated domain
MADKKKVEVKETKVEVKTAVYKVYVHCGQCARDIQTQFTEFQGVEEVKVDAGAGKVTVKGFGFDVEKLRKKVEKGCRKKVELIPPAPPKDDMVVDVKTKKEELKVITVKLPLHCPDCAVRVKEVLLENKSIYEAKTDLGKNTCTIEGVI

SEQ ID NO: 79539 - DNA, 1212 bp, Zea mays
  misc_feature: Ceres CLONE 1564623
  misc_feature: Encodes the peptide sequence at SEQ ID NO. 79540
aagctttcaggcaatgtttctgcattgcgtgcgcgtgactgcatcttccgttttcagagctcagagttttcgttgtttgtttcggatgacgacctgtcgcaccgcgaacgcagccgccgtcgtccgtctcctgctgctgtgctctttctgcgccgccgccgccattgcctgcgaccctcctaatggcgccaagttcgggtacaccggctccgtcggtcccgaccactggggcgcactgagccccagcttcaggcagtgcgcgacagggacgaagcagtccccgatcgacatctccacggcccaggcggtctccaacccggcgctgcagccgctccacagggactacaccgtggccaacgccaccctcgtcgacaacgtcgtcaacgtcgcgctgcgcttcgacggcgacggcggcgccgggagcgtgagcgtcggcgggaagctgtacacgctgaagcaggtgcactggcactcgccttccgagcacaccgtcgacggccgccggttccccgtcgagctccacatggtccacgccagcgacgacggcaacgtcaccgtggtggccatgctctaccggtttggcaggccggatcctttgctctggcagatccaggacaagctggccgcgctgcacgcggagggctgcagagcggacaagggcgctccggtcgccgccggagacgtcagcctgtggtcgctcaggctctactcccacacgtactaccgctacgtcgggtcgttcaccacgccgccctgcaccgagaacgtcatctggagcgtcctggcccaggtgagggagatgacggtggaccaggccgccgccctgatggcgcccctggagcaagcttacaggcgcaacaacaggccgacgcagccgaggaacggccgcgtcgtccaggtctaccgcaacgggttcatcaacaagaagacggcgccgtagccgtgccatgcgctgccccgtatgcgtggcctggtccttggtggcgacgccaagtcctctgggttacttgtcagttgtttctcgtcgaagtctttgtgttcttctgcacttgttctgccgccggttttggtgctctcgggactgaatgttcgtcagtgggtctgtgggtttagctaggttaggagatttaagctgtttagtttctgcaaaatctatcctccttatctgttagtaatgattagcatgttgttggtcaaaaaaaaaaaaaaaaa

SEQ ID NO: 79540 - protein, 308 aa, Zea mays
  misc_feature: Ceres CLONE 1564623
  misc_feature (61)..(301): Pfam Name: Carb_anhydrase Pfam Description: Eukaryotic-type carbonic anhydrase
  misc_feature: SWISSPROT Homolog: EC 4.2.1.1 Carbonate dehydratase
MFLHCVRVTASSVFRAQSFRCLFRMTTCRTANAAAVVRLLLLCSFCAAAAIACDPPNGAKFGYTGSVGPDHWGALSPSFRQCATGTKQSPIDISTAQAVSNPALQPLHRDYTVANATLVDNVVNVALRFDGDGGAGSVSVGGKLYTLKQVHWHSPSEHTVDGRRFPVELHMVHASDDGNVTVVAMLYRFGRPDPLLWQIQDKLAALHAEGCRADKGAPVAAGDVSLWSLRLYSHTYYRYVGSFTTPPCTENVIWSVLAQVREMTVDQAAALMAPLEQAYRRNNRPTQPRNGRVVQVYRNGFINKKTAP

SEQ ID NO: 79541 - DNA, 868 bp, Zea mays
  misc_feature: Ceres CLONE 1564626
  misc_feature: Translation starting site: 193
  misc_feature (530)..(530): n is a, c, t, g, unknown, or other
  misc_feature (534)..(534): n is a, c, t, g, unknown, or other
  misc_feature (535)..(535): n is a, c, t, g, unknown, or other
  misc_feature (553)..(553): n is a, c, t, g, unknown, or other
  misc_feature (560)..(560): n is a, c, t, g, unknown, or other
  misc_feature (572)..(572): n is a, c, t, g, unknown, or other
  misc_feature (603)..(603): n is a, c, t, g, unknown, or other
  misc_feature (604)..(604): n is a, c, t, g, unknown, or other
  misc_feature (634)..(634): n is a, c, t, g, unknown, or other
ctccccgcggtggcggccgctctagaactagtggatcccccgggctgcaggaattcgtctcacccctagaaaaaacgctcccgcactctctctcaactcattggcagcagcaaccgcagccgcgagggccaagcaggggggacaaggaaaagggccgacgaagaggaaaaaggaagaacgcgtcgcggagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcacttgtccttggtgcggttggaatatactttgctttcaaaatcacaatgagagtgggatngccnnatcttacagcctgcactnctggatngggataggaacnatactttgtatggtattcagtggataatggnnatcgtcacgttcttcttccctggggcttgncccaacgtggaagaaggttggtcctcctttgcccgtacctcttggggcccctttgcctacacctaaaccctgggtaaggcagaatctcggctttcttgaaaaagttccttttcctcaaaagctcggggtttccaaaaaattggcaaaaagggctttttttgggaacttccacccacatgggggggcccggatttttggccccccccgttggggggggggggtaaaaaacccccc

SEQ ID NO: 79542 - DNA, 883 bp, Zea mays
  misc_feature: Ceres CLONE 1564631
  misc_feature: Translation starting site: 88
gcggtggcggccgctctagaactagtggatcccccgggctgcaggaattcgtctcacccctagaaaaaaaacgcgaggtcacgagatatggcggacggcaagcgaggggaggattcggccgtggcgttgaagacctcgccgtcgtcggcggtgatggctgggggtttacgcggcgttagcaaccctctggaggagtggagcgggcgcgtgaaggcgattgaggccgggttccgcgcgtggatggcgaagcaacccatccaaatcgaggccgcggtgaccacggccgtgggggcggtgcagggcggggctctgggtgggctcatgggctcgctcacagctgacggcgggtcgcccgttccccatcccgcagccgccggccaacggcaacccagaggccatggcgtcgttcaagcaggcccaggcttttagctgtggacccttggtgcagccccggaactttgcagtcatgaacggcgcaaacgcaagcatatcctgtgtcttgagaagggttccaagggaaagagggtattcccgggcagcattgcgagctgcctttcgggtctgggggcccttttctcccaaaaggagcggaaagggggactccccaatcccgtagcccaagccggttcaaccggggggtgccttttgccgaattttcagggggggttttttctggtccgggggaaaaattctccaaggcccccagggagaaattcttcctctctttctaacaaaaaagatgtgttgcccaaaattggggccttttaaaaattttggaaaaaattttttagaggggggttccccccatgggataaaacgtttcccccccctttttggaaaaggggttttttaagaaaagtgagaaaaccatcctcggggaccc

SEQ ID NO: 79543 - DNA, 1008 bp, Zea mays
  misc_feature: Ceres CLONE 1564632
  misc_feature: Encodes the peptide sequence at SEQ ID NO. 79544
  misc_feature (34)..(34): n is a, c, t, g, unknown, or other
  misc_feature (41)..(41): n is a, c, t, g, unknown, or other
  misc_feature (792)..(792): n is a, c, t, g, unknown, or other
  misc_feature (988)..(988): n is a, c, t, g, unknown, or other
ccccgcggtggcggccgctctagactagtggatncccgcgnctgcaggaattcgtctcacccctagaaaaaacagagcacttttgctaaatcgctagttcgtttcctaaaccctagcaaagtacgaatggcgtcggcgagcatgctcgcgcgctcccttctccgcaccccagaccctacccaaacgagccacccgaaccgccggagcgccgctgtcgtctccttcccccgacgccaccgccccgtgtccttgcgcgcctccttctccgcaggctcgccttaccacgcgcacagccctctgctggtggtgccggccggcagaaacacgcttccggcggcgcggccccaagggtaaatcgaacacgggacgaattccctacattccccacccaattcaccgggtggtccacacgcacaccccatcataatcctcccaactcaggccgagggagagtttgagatgacccccccccccctatacgggagttgtattctccacaggaggtcccccaccccgctgtacacacagaagagattccacctcacgccacgaaaaaaccacaacctccccaccccaaaccaggcgcttttccgccccacacgttaacacgccgccttgcgcgaggatggtcacaggtcaaagtggaaaagtgctcctctccccaatcttactaaccaccatactcactcaccccaggtcaacaacggagggctcgtcggcgtaacacaacgaggaaggatcacggactccgtcgccattacccaagaatatgtatctgaatgaccccacttnaaagaaagatccatctctatttacccacggctcgtcgcgcaaggttacaacaccacccccgcacacccacgccggaagcgcgtaggttgctcgcctcgcgggacgcgcacggaactctactgccaccccactcgagtccgcgagcgcggcaatcgcccgcgatggaagcgcgaggcacctcaaacaatgtggggcnttagctatcgtatgttaaaa

SEQ ID NO: 79544 - protein, 75 aa, Zea mays
  misc_feature: Ceres CLONE 1564632
MASASMLARSLLRTPDPTQTSHPNRRSAAVVSFPRRHRPVSLRASFSAGSPYHAHSPLLVVPAGRNTLPAARPQG

SEQ ID NO: 79545 - DNA, 859 bp, Zea mays
  misc_feature: Ceres CLONE 1564636
  misc_feature (396)..(396): n is a, c, t, g, unknown, or other
  misc_feature (415)..(415): n is a, c, t, g, unknown, or other
  misc_feature (452)..(452): n is a, c, t, g, unknown, or other
  misc_feature (496)..(496): n is a, c, t, g, unknown, or other
  misc_feature (497)..(497): n is a, c, t, g, unknown, or other
  misc_feature (512)..(512): n is a, c, t, g, unknown, or other
  misc_feature (526)..(526): n is a, c, t, g, unknown, or other
  misc_feature (575)..(575): n is a, c, t, g, unknown, or other
  misc_feature (576)..(576): n is a, c, t, g, unknown, or other
  misc_feature (605)..(605): n is a, c, t, g, unknown, or other
  misc_feature (622)..(622): n is a, c, t, g, unknown, or other
  misc_feature (638)..(638): n is a, c, t, g, unknown, or other
  misc_feature (688)..(688): n is a, c, t, g, unknown, or other
ctccccgcggtggcggccgctctagaactagtggatcccccgggctgcaggaattcgtctcacccctagaaaaaaataataaaaagatgattattgcgtgccgggggaggagatcgcacgggggttgatgtttttggccccgggttctcctccctcatcttgttccgtgttcctgtatgcgttgcttccgctcctgttggtccgctacgcacgccggatttttgcatcgagcacggagatctacaacaaaaacatggagctacgacgcgattcccaaggtacaatcgtaattatgttcaaacaatttttaagtcgtcctgcgctccttctattacgagcaacgttttatattctgtgcttgcataataaatgcgaagaaatcctgacaccaatcgnaactgaagatcctgaaacngcacgttaataccgttgaacgtccgcttcacccagcntcgatttttcagtcttggtaataataatgtgagaactccaatgnnaactgagagttactnaatcgctccatganggtctgaagcgtgcaaaaaattttaggtcgcagctacacaaattttacnnacgctgttctatattcctatattctatanttaatattttaggtcgncagcctacccgtgaantctcctatttttgaaaagggtcactgctttttttatttcattctatattnctatattatatttttggaaaatttcagtcctcgttttatttgctttccagacttaatggtttagataaatggtttacaattttcctacatttcagtctgggactattgtgcttttggaacttatggtggagataactcataaggtttcttgcgtctaaaagcattttcatt

SEQ ID NO: 79546 - DNA, 836 bp, Zea mays
  misc_feature: Ceres CLONE 1564637
  misc_feature: Encodes the peptide sequence at SEQ ID NO. 79547
  misc_feature (683)..(683): n is a, c, t, g, unknown, or other
  misc_feature (698)..(698): n is a, c, t, g, unknown, or other
ctccccgcggtggcggccgctctagaactagtggatcccccgggctgcaggaattcgtctcacccctagaaaaagcgccgcggccttatcccaaagttgcattgcatccatcgtgcctgatctccctcccaataagcacgtctgtttctccccagctccaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatcaacgccaccatcgagaagacaagcgcccggtcgagaactacggcaaagtcggggctgctgtgcggcgccgacggcctgccgcacctcatcgtcagcggcgaccagcggcactgggggcgagttcgtcaccccggggcctgctcttcctctaatcgncggcttggatccggntgggtcggcaggaaactacctcatggccttcagcggcaaagaaaagcccgcccgtgagggaaaatcttatcgaacgttgagctcgcccacccgccctcctcccccaggggggttcaacttgggccccttccccccccc

SEQ ID NO: 79547 - protein, 183 aa, Zea mays
  misc_feature: Ceres CLONE 1564637
  misc_feature (42)..(179): Pfam Name: PSI_PsaF Pfam Description: Photosystem I reaction centre subunit III
MAALAAASTAAFAAKPRARLSVACSAATGDSSSVSLASSVKTFSAALALSSVLLSSAATSPPPAAADIAGLTPCKESKAFAKREKNSIKKLTASLKKYAPDSAPALAINATIEKTSARSRTTAKSGLLCGADGLPHLIVSGDQRHWGRVRHPGACSSSNRRLGSGWVGRKLPHGLQRQRKARP

SEQ ID NO: 79548 - DNA, 763 bp, Zea mays
  misc_feature: Ceres CLONE 1564640
  misc_feature (271)..(271): n is a, c, t, g, unknown, or other
  misc_feature (640)..(640): n is a, c, t, g, unknown, or other
  misc_feature (645)..(645): n is a, c, t, g, unknown, or other
  misc_feature (646)..(646): n is a, c, t, g, unknown, or other
  misc_feature (690)..(690): n is a, c, t, g, unknown, or other
  misc_feature (715)..(715): n is a, c, t, g, unknown, or other
  misc_feature (740)..(740): n is a, c, t, g, unknown, or other
ctccccgcggtggcggccgctctagaactagtggatcccccgggctgcaggaattcgtctcacccctagaaaaagcccaagcgcgcgcgcaaattccacaccccctcgaccctcgattcgttcccgccgccaaccaagcgacggctcctcttcgacgctatcctaggggcggtcgacacctggccatagatacacccgtcgcccgcggctctccccggatgggcgaaccaggcgattgagacttcgcccccaaatcgaacctccccctttnggggggggggaaaaaggggcccacacccctggtggtggggccccaaaaaaaggtaaaaaaacccccccctccacagggggggggcccccctttctctcaaaaaaaagaggcaccgccccccccccaaaagaagaccgtcccccccccaaaaaaagggggggggcgcccccccccccccacaaataaaaaaaggggggggggggggggggggggggagggaaagaggaccctcccccccccccccccgcggggggggggggggggtggttttttttttttcctccccccccccccccccaacccaggggggaaaagaaaaaatgttgtttttttttcttccccccccccccccccccgccggggcccctncgtgnnggcggcgggggcagagaagggaacggcccttttttttttttgtnttctcccctcccacaaccaaacaangaaggaggaaagggggggggtgggngtttttggcatggggacaataaa

SEQ ID NO: 79549 - DNA, 794 bp, Zea mays
  misc_feature: Ceres CLONE 1564642
  misc_feature: Encodes the peptide sequence at SEQ ID NO. 79550
  misc_feature (528)..(528): n is a, c, t, g, unknown, or other
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatnctcagcgagggcgggcttaactacctcggccaccccagcctgatccacgcgcagagcatcctcgccatctgggcctgccaggtcgtgctcatggggtgcccgccagggctacccccattgccgggcgggccgcttcggcgaggtcgtcaaacccgctgaaccctgggcggaagctttcaacccccctcgggcttgggccaacaaacccccaaggcccttcgcccaaactccaaggtgaaggaaactccaagaaacggcccgcccca

SEQ ID NO: 79550 - protein, 186 aa, Zea mays
  misc_feature: Ceres CLONE 1564642
  misc_feature (61)..(184): Pfam Name: Chloroa_b-bind Pfam Description: Chlorophyll A-B binding protein
  misc_feature (134)..(134): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQXLSEGGLNYLGHPSLIHAQSILAIWACQVVLMGCPPGLPPLPGGPLRRGRQTR

SEQ ID NO: 79551 - DNA, 784 bp, Zea mays
  misc_feature: Ceres CLONE 1564644
  misc_feature: Encodes the peptide sequence at SEQ ID NO. 79552
ctccccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaataagacgttgttgtgactattcacccgtcacgttccatatggcttcctgcaggatggcactccctcctgggcttgctgctgctagtagtagctttcgcccgcaatcgctgatgacaactccggtatctactaacagctgggttcttaggggggccagaaacatactgggaagaaaacaaacgcttgggtgcttgaaagccaacaacccggggtttccgcccgggggccgaaatttttaaaaaaaaggggttttccccggtccttaaaagggaacaccccgaaagctgtgtgg

SEQ ID NO: 79552 - protein, 63 aa, Zea mays; identical to SEQ ID NO: 28299
  misc_feature: Ceres CLONE 1564644

SEQ ID NO: 79553 - DNA, 656 bp, Zea mays
  misc_feature: Ceres CLONE 1564647
  misc_feature: Encodes the peptide sequence at SEQ ID NO. 79554
  misc_feature (302)..(302): n is a, c, t, g, unknown, or other
  misc_feature (340)..(340): n is a, c, t, g, unknown, or other
ctccccgcggtggcggccgctctagaactagtggatcccccgggctgcaggaattcgtctcacccctagaaaaagacgcaggcaccccagcagctcttgcggtcgtccctcagccgcgtcgcaccgcatcgcattctacgattcgaagctctctgctcgcaggggaccatggcgaagaactacccaaccgtgagcgccgagtacagcgaggccgtcgagaaggccaggcgcaagctccgcgccctcatcgccgagaagagctgcgcacccctcatgctcccgcctcgcgtggcactcccgcngggggacgttcgaacgtgtccgtcgaaggaccggcggntccccttcgggtactatgaaagtggcccgggcggaaactgggcttcaccggcggcccaacgcggggggctgtggaaaattccccggggggcggggttgggctcgagggccccttttaagggggagggggtttccccccacccccttttttctttttggcccccgaaaattttttttaaaccaaaattttttttcccccggaaaaattttttggtgggcccccctcccaaaggggggccccccccccgggggggggggggcccccaaaaaaaaaaaaccccccccttttttccccccccccggggggggggggggga

SEQ ID NO: 79554 - protein, 162 aa, Zea mays
  misc_feature: Ceres CLONE 1564647
  misc_feature: SWISSPROT Homolog: EC 1.11.1.11 L-ascorbate peroxidase
  misc_feature (45)..(45): Xaa is any aa, unknown, or other
  misc_feature (58)..(58): Xaa is any aa, unknown, or other
MAKNYPTVSAEYSEAVEKARRKLRALIAEKSCAPLMLPPRVALPXGDVRTCPSKDRRXPFGYYESGPGGNWASPAAQRGGLWKIPRGAGLGSRAPFKGEGVSPHPLFSFWPPKIFFKPKFFFPRKNFLVGPPPKGGPPPRGGGGPQKKKTPPFFPPPRGGGG

SEQ ID NO: 79555 - DNA, 775 bp, Zea mays
  misc_feature: Ceres CLONE 1564648
  misc_feature: Encodes the peptide sequence at SEQ ID NO. 79556
  misc_feature (454)..(454): n is a, c, t, g, unknown, or other
ctccccgcggtggcggccgctctagaactagtggatcccccgggctgcaggaattcgtctcacccctagaaaaagaagttcttcggattgttaaaccacaacatttcttgcctgttcatggagaactcctatttctcaaagaacatgaatcacttggaagatcaactggcatacgacacacaactgtaataaaaaatggagaaatgcttggtgtatcgcatctaagaaacagaagacttttgtccaatgggtttgtttcattagggaaggaggatcttcagctcatgtatagtgatggtgataaggcttttggtacatccactgatctttgcattgatgagagactaagaatcgcatctgatggcattatttttgtcagcatggagatctttcgacctcagaaggaacatggtttagcgtagactgggttgaaaggaaaattttagattactancagatgtctatggcttgataatggaagattgttggacgcactctacaaagcagctcatgctgcattgtccggttgtccctgggaatttggccacttattcccattggaaaagaatgggtaccttaaaacccttgaagaaaaaagggtacccgaaaatataaattggggaaaaaaaggccctaaaaccctcttttgcgggggggtctttttggagaaaaaaccccccccccccgtggtttttttcttaaaaaaaacccccccccggggggagaaaaaaaaaatcgcggggggaaaaaatttttttaccacacaccccccccc

SEQ ID NO: 79556 - protein, 139 aa, Zea mays
  misc_feature: Ceres CLONE 1564648
PRGGGRSRTSGSPGLQEFVSPLEKEVLRIVKPQHFLPVHGELLFLKEHESLGRSTGIRHTTVIKNGEMLGVSHLRNRRLLSNGFVSLGKEDLQLMYSDGDKAFGTSTDLCIDERLRIASDGIIFVSMEIFRPQKEHGLA

SEQ ID NO: 79557 - DNA, 785 bp, Zea mays
  misc_feature: Ceres CLONE 1564652
  misc_feature: Translation starting site: 167
ctccccgcggtggcggccgctctagaactagtggatcccccgggctgcaggaattcgtctcacccctagaaaaaatccctccattgtcctaccaaaaatcgcagcgccgcccgcaccaatctcgaagtgttcgaaagtttccagacccccaaaaggcgaagcggcgatgagttccaccggaggcggcggccgcgggaaggcgaagccagcgaccaagtcggtgtcgcggtcctccaaggctgggcttcagttccccgtcggtcgcatcgcgcggtacctcaaggccgggaaatatgccgagcgcgtcggcgccggggcccccgtgtacctctccgctgttctcgagtatctcgccgccgaggtgctcgagctggccgggaacgctgctcgggacaacaagaagaaccgtatcgtgccgcgccacatccagctggcggtgcggaacgacgaggagctgagcaagctgctgggcactgtgacgatcgcggccggcggcgtgatgccgaacatccatcagaccctgctgccccagaagctggtcagaaggggacatcggctctgcctccaggagttctaagcgttccgcgggaatgaggagagggaccgccccctggtttctgtctcgtcccccgtggtttgggtttcagctcctgcgggtttttttggggggagtgcctgccaatgagttggattgattggggttttgtagggggggagtaattataaacaaaccccggccgccggtggtttccaggaaaaaaaagtgttggggataaaaaaggaaa

SEQ ID NO: 79558 - DNA, 842 bp, Zea mays
  misc_feature: Ceres CLONE 1564653
  misc_feature: Encodes the peptide sequence at SEQ ID NO. 79559
ctggagctccccgcggtggcggccgctctagaactagtggatcccccgggctgcaggaattcgtctcacccctagaaaaagataagccccggatgagcccccgatggccaaggtctcgcctcctcctcgggatcatcatgtcgtcgttggtccctcgagagcggcaaattaataagtaaatgagcaactttttctcgcgtgtggtccagactcccgtcttcttcctcgaccgctaaccttaccggtccccaaatgtcgcctctcgtgctgctgctcctcgcgcacctactcgccacggccactgcagcgggagcagcgcggaccagggacgacgggcctcctgctccgtcgtcgtcgtccccgcgggtgccggcgacgacgccgccgtggccggaccagttccacgcggtggtggtgacgaacctgagcgcgcgcggcggcgggctgcagctgatcgacctgtactacgactggccgcgagggcgcgacctgaacatcgtccgcgaccagctgtccggcgagcggcgctggagctggaacgtggagtggagcaacggcaccgccttcctgttcgactccgcgtcctgccgcaccttccagttcgccgtgggcctcctgccgcccgactggaaggcccgcggcgccgcctacctggggcgcgaccgcgtcgacggcttcgactgccacgtctggtccaacttcgtcttcgcccgctactacgaggacgtcgccaccggacgccccgtcagctggaactttcatgggctgcagcggcatgtgctgagcttcgaggcgggggcagtgctgcaggactcctccagtgggcagcgcccggctactgc

SEQ ID NO: 79559 - protein, 196 aa, Zea mays
  misc_feature: Ceres CLONE 1564653
MSPLVLLLLAHLLATATAAGAARTRDDGPPAPSSSSPRVPATTPPWPDQFHAVVVTNLSARGGGLQLIDLYYDWPRGRDLNIVRDQLSGERRWSWNVEWSNGTAFLFDSASCRTFQFAVGLLPPDWKARGAAYLGRDRVDGFDCHVWSNFVFARYYEDVATGRPVSWNFHGLQRHVLSFEAGAVLQDSSSGQRPAT

SEQ ID NO: 79560 - DNA, 840 bp, Zea mays
  misc_feature: Ceres CLONE 1564655
  misc_feature: Encodes the peptide sequence at SEQ ID NO. 79561
  misc_feature (735)..(735): n is a, c, t, g, unknown, or other
  misc_feature (738)..(738): n is a, c, t, g, unknown, or other
  misc_feature (739)..(739): n is a, c, t, g, unknown, or other
ctccccgcggtggcggccgctctagaactagtggatcccccgggctgcaggaattcgtctcacccctagaaaaaaatatcttcgtcttcccccttctcgccgatggctgcaacacccactgccgccgttttgctcgcgcgcccgctcatcgcactctccagtgctttcacctcccctcatcgtgcgcgggtgccgagcgatccctcctccatctcggtgccgccactgaggagtcgatggtgccagtggcgcggcccgctccgatcgctgccccccgaaggagctccggccgagctgatggaagaggactccaagtttgtgccgttgaacgcggacgatcccatgtacgggccaccggcgctactgctcatcggatttgagaaaggcgaaactgtcacgattcaggccttcctgaaagagcttgaaagtgaattccctcaaaggtgatccattgttacagaggagatgaacaagccaaaccttatggggatgccatgcacaactgagcagccctgaatttggaagctgtccaaaattgccaaggaccaactgcccaggaatatggcatatttttccgggtctaactgggcgaaggaaaaatgaatgaatgtttcataaaacggcccttccccaaaaaacccggccttggaaaaccacctgccccttttggctgccgccttggggtccctaaataagagttggggaaaaaaaagggttttttccccccgggaaaantgnntttttcccccggaagatatgggaacctgaatgcctgcccgaaagactcccaatgaaaaaattttaaccccgacatgccttcaagaaaattgtcccctttga

SEQ ID NO: 79561 - protein, 114 aa, Zea mays
  misc_feature: Ceres CLONE 1564655
MAATPTAAVLLARPLIALSSAFTSPHRARVPSDPSSISVPPLRSRWCQWRGPLRSLPPEGAPAELMEEDSKFVPLNADDPMYGPPALLLIGFEKGETVTIQAFLKELESEFPQR

SEQ ID NO: 79562 - DNA, 867 bp, Zea mays
  misc_feature: Ceres CLONE 1564658
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
ctcaccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccacccgccctacgacctgacgtcctttcgcgttcagccccatcaaggagtccatcgtgtccccgcaagatgaccccgtcgcctacatgaccggacatgaatcaccttacgcccgaacaccgaaggttgttatcccccgcgccccggggttcccgcgggggcttgtccctggggcggtaacaaaacccctcccaaaggaacccccccccgggagaccatctcccccttccggggaaaaaatccctggtggtcccccccggggcggggggcccccctgggtttttggggcggggaaactctttttttctccgggnnnntggggggggggggccaaaaaacgggggcccccctttttttccctggaaaaaaaattgggggggggggggttcccaaacaaaggccccgaaagaaaaaacacggggggccataaaagagagacccccgggtctttttttttatttcaccaggggaataaaagaccccgcccctcgggggggccccccccacaaaaaaaagagtgtgtttaaacacccggggggggtg

SEQ ID NO: 79563 - DNA, 942 bp, Zea mays
  misc_feature: Ceres CLONE 1564665
  misc_feature: Encodes the peptide sequence at SEQ ID NO. 79564
  misc_feature (942)..(942): n is a, c, t, g, unknown, or other
gcggtggcggccgctctagaactagtggatcccccgggctgcaggaattcgtctcacccctagaaaaatctccacgccaagaaacacgcggcggttaatccgcatccctccagaactcgcggggaatatccgagtcgtggacatcaccctgccgcgcgtggagcgcctgccggaggacagcgaggcgagcatagacctcccgtccgacgacctccgcccgtacctccgcgtagcctacgacgctgccttcgccaacaaactctcggccatcctgcaggagccggggccggagaggcccgactgggtggtcatcgactatgccgcgtactgggcgcccgcggcggcggcgaggcacggcgtgccatgcgcgttcctgagcctgttcccccccccggcgctcagtttctatggccccccggaggggctcatggcaccccgcaagtacccccgggacaaagccggaggacctcccccgttgtaccccgactacgtgcccggacccgaaccccctacgcgtaccgcgcgcttgggaggggaccccgaatttttcacactcggtggtcggccccctggaacgaaatcctggctatttcggaaagggttacccggtctcgggtagggtgaatccgaatcaggaggccagcttcctgggggatctgtgggcacagccccgtaatttctcaaaccgggacgggggttttccagggggtctccgtggaggcccatgcccctgagtaacgggctcgcccagggaacaggactgagatcccactccacccgacctcgtctcttgaaaaaacctcctgggaggctcttccaagcgaaaacaccctggaataagaggtgtgaacccccgccgaaacgcttaccgccccctcatatagagcacgcgcacgccgctttatatttcaggggatgagttggaaatatcctacacaacgn

SEQ ID NO: 79564 - protein, 63 aa, Zea mays
  misc_feature: Ceres CLONE 1564665
MAPRKYPRDKAGGPPPLYPDYVPGPEPPTRTARLGGDPEFFTLGGRPPGTKSWLFRKGLPGLG

SEQ ID NO: 79565 - DNA, 783 bp, Zea mays
  misc_feature: Ceres CLONE 1564672
  misc_feature (54)..(54): n is a, c, t, g, unknown, or other
  misc_feature (191)..(191): n is a, c, t, g, unknown, or other
  misc_feature (291)..(291): n is a, c, t, g, unknown, or other
  misc_feature (461)..(461): n is a, c, t, g, unknown, or other
  misc_feature (462)..(462): n is a, c, t, g, unknown, or other
  misc_feature (505)..(505): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (652)..(652): n is a, c, t, g, unknown, or other
  misc_feature (760)..(760): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (774)..(774): n is a, c, t, g, unknown, or other
tccccgcggtggcggccgctctagaactagtggatcccccgggctgcaggaatntacgtctcacccctagaaaaaacctatccgccgcctcccatcatcctgcccccaaactcccaccccgcagcatccccacgccaccacacctcgtcgcgtcgcgtcgtcaccggcgtgaagatggtcgggccaggccntctacaccgagatcggcaagaagaccagggatctgctgtacaagactaccagactgacccaagttcaccctcactacctacacctccaatggcgtcgctngtaactggctttctagccaccaaaggaaaaggctggacccctggattcccctttggggggggagaaaatatccccccctttcccccccccaattttttaaagaaaaaccacgggggaacacacttggtggcccccccctttttatgtttttgggggaaaaaaaaaaaaannaacaccccaccgtgcggggagaaggggggagaaaaaaaaaaanaattttttttttttttttttataagaaaaaaaaaaatattatttgtggtgggaaaagaaaaaaaaaaaaaannnnnaaacacccaccccccccccggcgggggggggaggagaaaaaaaaaaaaaccaccccccaccnnntannntnttttttttttgtgggtgggggccccccccccccccaacaaaaaaaaaaaaaaaaaaaaaaaaattttttttttgaagggaaagagggagggggggggtcccctcgcgntaccaccnnnnncntctcccacc

SEQ ID NO: 79566 - DNA, 785 bp, Zea mays
  misc_feature: Ceres CLONE 1564674
  misc_feature: Encodes the peptide sequence at SEQ ID NO. 79567
ccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtcaagctgttcaacgccgtgggccgtggaggacctcatcgttcaggggagggcgcgttcggcggcgtca

SEQ ID NO: 79567 - protein, 207 aa, Zea mays
  misc_feature: Ceres CLONE 1564674
  misc_feature (64)..(204): Pfam Name: Thi4 Pfam Description: Thi4 family
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVGRGGPHRSGEGAFGGV

SEQ ID NO: 79568 - DNA, 831 bp, Zea mays
  misc_feature: Ceres CLONE 1564678
  misc_feature: Encodes the peptide sequence at SEQ ID NO. 79569
  misc_feature (725)..(725): n is a, c, t, g, unknown, or other
ctccccgcggtggcggccgctctagaactagtggatcccccgggctgcaggaattcgtctcacccctagaaaaaaaaacgacccccgcaaccaaagacctctccccttctatctatctactatatatcgatccacccatccctcgcagctccaaagcattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgaggccaagctcaaggtcaagttctacctcccgcccttcctccccatcgtccccgtcgtcggcgactactgggtgctctacgtcgacgatgactaccagtacgcgctcgtcggcgagccgcgccgcagaacctctggatcctgtgcaggaagacgagcatcgacgaagacgtgtacaacccagctgtggagcgggccacaggaggaaggctacnacttgagcaagctgcacaggacgccgcaggacgaaccgtccgccggagagcgacgcccgcgcctacgacaaccaaggggggtggggtgggttcaagtcgctcttcc

SEQ ID NO: 79569 - protein, 197 aa, Zea mays
  misc_feature: Ceres CLONE 1564678
  misc_feature (24)..(172): Pfam Name: Lipocalin_2 Pfam Description: Lipocalin-like domain
  misc_feature (163)..(163): Xaa is any aa, unknown, or other
MAAEEGEKAKSGGGGQQMTVVRGLDVARYMGRWYEIASFPSFFQPRDGRDTRATYRLLEDGATVHVLNETWSKGKRDYIEGTAYKADPGSDEAKLKVKFYLPPFLPIVPVVGDYWVLYVDDDYQYALVGEPRRRTSGSCAGRRASTKTCTTQLWSGPQEEGYXLSKLHRTPQDEPSAGERRPRLRQPRGVGWVQVAL

SEQ ID NO: 79570 - DNA, 870 bp, Zea mays
  misc_feature: Ceres CLONE 1564682
  misc_feature: Encodes the peptide sequence at SEQ ID NO. 79571
  misc_feature (632)..(632): n is a, c, t, g, unknown, or other
  misc_feature (646)..(646): n is a, c, t, g, unknown, or other
  misc_feature (657)..(657): n is a, c, t, g, unknown, or other
  misc_feature (665)..(665): n is a, c, t, g, unknown, or other
  misc_feature (666)..(666): n is a, c, t, g, unknown, or other
  misc_feature (735)..(735): n is a, c, t, g, unknown, or other
ctccccgcggtggcggccgctctagaactagtggatcccccgggctgcaggaattcgtctcacccctagaaaaaacctcatctcgctccccgcgtcggcgcctactaatggcagccggatctcgccgcccgccgcgcccacggagatgaagcgccggcgcctgccgcccgtcctcttcctcctcgcgctcgcgctcttgtccctcgccttccgccgccacctctccctccccctcggcgttccccagttcgccgccggtggcgtcagcggcgacgcgctcctccgcctcctcgcggccaccgacgtcggcggggaccagatcctggcggaggcggccgcgctgctggccaacgcgtcggtgtccaccttccccagcatcggcaaccaccaccgcctcctctacctccgcgtcccctaccgcatcaacgccacctccgcgccgcggcagcggacagtgtcccgtctccgcattcccttccacgacgtccccaacgacgacgccctcctcgccgccttccgcgcatccctccgcggcttcctcctcgcgcgccaccgccagcgccaccgccgaggcggcgacgacgtcgcgggcgccatggccgacctccccgccctcctcctcggccgcgccnggctgccggcgcgnccccgacctgngaccgacnntcggggacagcgagcccccttctcggcgtcctgccggggcggcgcgaatcagacacgcactaccttccnggattccgggtctaccacggcccgccatctccgggggttccgcggagcaaagaccgggagcctcgaacccggggatttgcgttttgtgaaacagtaaaaatgggtgcaacgtcctgggcccctgcggcttgcggt

SEQ ID NO: 79571 - protein, 228 aa, Zea mays
  misc_feature: Ceres CLONE 1564682
  misc_feature (163)..(163): Xaa is any aa, unknown, or other
  misc_feature (171)..(171): Xaa is any aa, unknown, or other
  misc_feature (174)..(174): Xaa is any aa, unknown, or other
  misc_feature (197)..(197): Xaa is any aa, unknown, or other
MKRRRLPPVLFLLALALLSLAFRRHLSLPLGVPQFAAGGVSGDALLRLLAATDVGGDQILAEAAALLANASVSTFPSIGNHHRLLYLRVPYRINATSAPRQRTVSRLRIPFHDVPNDDALLAAFRASLRGFLLARHRQRHRRGGDDVAGAMADLPALLLGRAXLPARPRPXTDXRGQRAPFSASCRGGANQTRTTFXDSGSTTARHLRGFRGAKTGSLEPGDLRFVKQ

SEQ ID NO: 79572 - DNA, 716 bp, Zea mays
  misc_feature: Ceres CLONE 1564686
  misc_feature: Encodes the peptide sequence at SEQ ID NO. 79573
  misc_feature (137)..(137): n is a, c, t, g, unknown, or other
  misc_feature (150)..(150): n is a, c, t, g, unknown, or other
  misc_feature (159)..(159): n is a, c, t, g, unknown, or other
  misc_feature (168)..(168): n is a, c, t, g, unknown, or other
  misc_feature (169)..(169): n is a, c, t, g, unknown, or other
  misc_feature (182)..(182): n is a, c, t, g, unknown, or other
  misc_feature (352)..(352): n is a, c, t, g, unknown, or other
acccgcggtggcggccgctctagaactagtggatcccccgggctgcaggaattcgtctcacccctagaaaaagcaggagcggagctccccgccgcttctctctccgccttccgagaggcccgacccctgataccacngctgagggcggtnggtattagngagattagnncgatggcgaggtnggcggccggcggcgctgctggtagtggctctggcggcggttctatcggcggcgtggcgggcggatgcgctatcggttacggtgaccgacaccgagtgcatccacgagttcgtgccctatgagggcgacaccgtgtccgggaacttcgtcgtcgtcgaccacgacatcttnctggagctccgaccacccaggaatcgacctcacggtaacgtcaccaggtggcaacactgtgtacacattgaagggaaaatctggtgagaaaattgagtttaaagctcccagaggtggcatgtataagttctgcttccataacccatattgagcacctgaaactgtttctttctacctccctgttgggcaccttccccatggaagccattccgggcgaaagaatgagcccttgggaccccttccattgtttaaaatccccgaaaacctaaagaaaactttttaaatcccgttcccccccccgaaaggaaaaattccccttaaaaaaacccgctaaaattttttttcccccaaaaccacccttttt

SEQ ID NO: 79573 - protein, 67 aa, Zea mays
  misc_feature: Ceres CLONE 1564686
  misc_feature (15)..(67): Pfam Name: EMP24_GP25L Pfam Description: emp24/gp25L/p24 family/GOLD
  misc_feature (18)..(18): Xaa is any aa, unknown, or other
MRATPCPGTSSSSTTTSXWSSDHPGIDLTVTSPGGNTVYTLKGKSGEKIEFKAPRGGMYKFCFHNPY

SEQ ID NO: 79574 - DNA, 785 bp, Zea mays
  misc_feature: Ceres CLONE 1564687
  misc_feature: Translation starting site: 337
  misc_feature: SWISSPROT Homolog: EC 1.1.1.195 Cinnamyl-alcohol dehydrogenase
  misc_feature (463)..(463): n is a, c, t, g, unknown, or other
  misc_feature (515)..(515): n is a, c, t, g, unknown, or other
  misc_feature (530)..(530): n is a, c, t, g, unknown, or other
ggagctccccgcggtggcggccgctctagaactagtggatcccccgggctgcaggaattcgtctcacccctagaaaaaatcattgtcgcgtcctcgtccccgttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccaaagggtcctaaagagacgatgtcacgatcaggtgctctactgcgggatctgcccaccgacctgcacgtcatcaagaacgactggcgaaacgccatgtacccagtcgtcccggggcacgagatcgtgggcgtggtgaccggcgtcngcggcggcgtcacgcggttcagggcggcgacacggtcggcgtgggctacttncgtggggtcctgccngctcctgcgacagctgcggcaagggggacgaacactactgcgccgggatcgtgctcccctccaacggggtcaaccacgcgcacgggggggcgcccaccagggggggattcttccaacgtcctgttcccagacaagacctaagtgggtccgggttccccaacggccttggggcttggaaccaccccggccccttgtttttggcccgggggtacccgggtaaagccccccgaaagggcccccgggccttaaaaagac

SEQ ID NO: 79575 - DNA, 788 bp, Zea mays
  misc_feature: Ceres CLONE 1564688
  misc_feature: Encodes the peptide sequence at SEQ ID NO. 79576
cccgcggtggcggccgctctagaactagtggatcccccgggctgcaggaattcgtctcacccctagaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaagagtgggcggccgtccccggcgggcaggccacgtacctgggcgccccggtgccgtggggcacgctgccgaccatcctggtgatcgagttcgtggccatcgccttcgccgagcaccagcgcaccctgggagaaggaccccgaaaaaaagaagtcccccggcggcgcccttcgacccgctcggcttctcccagggaccccgccaagttcgagggagtacaaggctccaaggaaattcaagaacgggcccgcctcccccttggtggggcctttcgttcggcctttttggcggtccaaacaaagtgggggg

SEQ ID NO: 79576 - protein, 219 aa, Zea mays
  misc_feature: Ceres CLONE 1564688
  misc_feature (54)..(211): Pfam Name: Chloroa_b-bind Pfam Description: Chlorophyll A-B binding protein
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGNWVKAQEWAAVPGGQATYLGAPVPWGTLPTILVIEFVAIAFAEHQRTLGEGPRKKEVPRRRPSTRSASPRDPAKFEGVQGSKEIQERARLPLGGAFRSAFLAVQTKWG

SEQ ID NO: 79577 - DNA, 834 bp, Zea mays
  misc_feature: Ceres CLONE 1564689
  misc_feature: Encodes the peptide sequence at SEQ ID NO. 79578
  misc_feature (396)..(396): n is a, c, t, g, unknown, or other
  misc_feature (834)..(834): n is a, c, t, g, unknown, or other
ctccccgcggtggcggccgctctagaactagtggatcccccgggctgcaggaattcgtctcacccctagaaaaaactgttcgcgccgccgtagcccccaaaccaccatcaccctccggagcgtcgcagcgatcccaccctcattctcccctttacccgtccatggcggagcgcggcggcgagcgtggcggcgagcgcggcgggtttggccgcggcttcggtcgcggcgggcgcggcgaccgtggcgggcgccgaggcggccgtcgcggcccgcgtcaggaggaagagaagtgggtccccgttacgaagctcggccgcctcgtcaaggagaacaggatcaccaagatcgaggagatctacctccactcgctccccgtcaaggagcaccagatcatcnagaccctcgtgccggggctcaaggacgaggtgatgaagatcacgcccgttcagaagcagacccgcgccggacagcgcacgcgcttcaaggcctttgtcgtcgtgggcgactgcgacggccacgtcggcctgggagtcaagtgcgccaaggaggtggccaccgccatccgcggcgccatcatcctcgccaagctctccgttgttcccgtcaggagaggctactggggaaacaagatcgggcaagcgcacaccgtggcctggcaaggtcaccggcaagtgcgggttcgttccccggggcgcatgttgccctgcgcccagggggttctgggcatcgtcgcccgcgcggcgtggcccaagaagggtgctggcatttccccgggcatttaaaggaagtctttcaccctcgtccccggggggctccccctaaaaaacccttggn

SEQ ID NO: 79578 - protein, 206 aa, Zea mays
  misc_feature: Ceres CLONE 1564689
  misc_feature (84)..(150): Pfam Name: Ribosomal_S5 Pfam Description: Ribosomal protein S5, N-terminal domain
  misc_feature (79)..(79): Xaa is any aa, unknown, or other
MAERGGERGGERGGFGRGFGRGGRGDRGGRRGGRRGPRQEEEKWVPVTKLGRLVKENRITKIEEIYLHSLPVKEHQIIXTLVPGLKDEVMKITPVQKQTRAGQRTRFKAFVVVGDCDGHVGLGVKCAKEVATAIRGAIILAKLSVVPVRRGYWGNKIGQAHTVAWQGHRQVRVRSPGRMLPCAQGVLGIVARAAWPKKGAGISPGI

SEQ ID NO: 79579 - DNA, 924 bp, Zea mays
  misc_feature: Ceres CLONE 1564690
  misc_feature: Encodes the peptide sequence at SEQ ID NO. 79580
ctccccgcggtggcggccgctctagaactagtggatcccccgggctgcaggaattcgtctcacccctagaaaaagactatcgtacaacaacagttctttagacggccatatcagctggacacagccaccgtactccgagattagcgcccccgtcggccaaacagtaccggactggccgccgttcacagttcacgccccgcgtggtccctatttcccggcgagcactaggctaccgccgccgccgtcaggtgccggtgcccagaccttcgtcgtgcccatttcaccggcgacgagcacccactagcccctgcccgcaggtgttgggaactggggatagagatggatcaccaccacccgcagcagcagcagcagcagtacggcgatccttaccgtgggctcatgacgtccccgcagcccgaccaccacctccacgctcttcagtaccatcaggccgcaagccgcaacaacagccggcgctttatgtctccacccgcagccaccggccagcaactgatgttctccacagccgccagcagaaaactgatgttctccaaccgcaaccccgcagcaacatcacccacgcccatttttttggcttcccaatttccaaccttcctaacatttgggtaaacaaaaattaagcccaaagcctatattggttccgggaaacaaggggaaccaaaaattttccttgcccccttgggtgaaaaaaatttacccaaccccggttttgtctggggggcccaaaaaattgttttgaactcccaattatcgggaaacaaataaagcctcaaaggtctcactacacggtttaggggaacaaagggaaaaaatttggaaaaaaacacagggcacctgctttttttaaagaaaaggggttttgatttctcaaattacgaaaggtccttttccaaaaaacctctc

SEQ ID NO: 79580 - protein, 96 aa, Zea mays
  misc_feature: Ceres CLONE 1564690
MDHHHPQQQQQQYGDPYRGLMTSPQPDHHLHALQYHQAASRNNSRRFMSPPAATGQQLMFSTAASRKLMFSNRNPAATSPTPIFLASQFPTFLTFG

SEQ ID NO: 79581 - DNA, 796 bp, Zea mays
  misc_feature: Ceres CLONE 1564692
  misc_feature: Encodes the peptide sequence at SEQ ID NO. 79582
ctccccgcggtggcggccgctctagaactagtggatcccccgggctgcaggaattcgtctcacccctagaaaaagcagcagcagcatccgtgtgtatagatcggcaagctaagcgcggctacacataaatatattccggccttccctctcttgtgctcttggcatctcgttgctttcgtgcacaaggtcgtcagagaccaggtgtggcagcttgggcacgagaggtcgatcagcagcaggccggtgcagcaatggcggccattatgggcgtgaagaagggtctgctggtgctggctcttgggctcgccatggccgctacctcgtcggccgtcatctacaaggtcggcgacacctccgggtggaccatccttggcaacgtcaactacaccgactggacttccaagaagaacttccgtgtcggagacaccatagagttcacgtacccgccgggcatccacaacgtgctggaggtgaagaaggccgactacgacagctgcaccaactcgacgccgatcgccacgcacagctcgggcgacgacaagatcgtcatcaagagccccggccaccgcttcttcatctgcggcgtgcccggccactgcgccgcgggccagaagctcaacgtccgcgtcctcaagacgcgctcctctgacgccccttccccggcgccctccgcgcgctcagcagcaggctcggcggcggcgacccccagccccaccaccgagaccacgggcgcgtcgtcggcctcgggcggcagcagcacgcccgacgccacgaccgcgcctgcgcccaatgccaa

SEQ ID NO: 79582 - protein, 181 aa, Zea mays
  misc_feature: Ceres CLONE 1564692
  misc_feature (37)..(120): Pfam Name: Cu_bind_like Pfam Description: Plastocyanin-like domain
MAAIMGVKKGLLVLALGLAMAATSSAVIYKVGDTSGWTILGNVNYTDWTSKKNFRVGDTIEFTYPPGIHNVLEVKKADYDSCTNSTPIATHSSGDDKIVIKSPGHRFFICGVPGHCAAGQKLNVRVLKTRSSDAPSPAPSARSAAGSAAATPSPTTETTGASSASGGSSTPDATTAPAPNA

SEQ ID NO: 79583 - DNA, 862 bp, Zea mays
  misc_feature: Ceres CLONE 1564693
  misc_feature: Encodes the peptide sequence at SEQ ID NO. 79584
acccgcggtggcggccgctctagaactagtggatcccccgggctgcaggaattcgtctcacccctagaaaaaatccgttcttcagccggcgcctcccacgtctccagtccgacactccgactcactccccctccgccgccccaaccggtcgcaatggccgccgtctccgcagccccgaggccctcgatgcctccccgactcgccctccgtgcccacctcttctcctccgcctctgcgctcgcaatgcgcgcgctccccttacaccgcagccgcttccgctccttgagcactgcctacgctgtcaagcaggacacggccctctggacccctgcacccgactccttcatcagtgctgccaaggacgacggctccgtctccctcatcgtcgtctacctatctgacaccacggacctcgaggactcgtacacgaaccgcggccaatacctcctgatgcgcgtactcggctacgagctcaagccggagtacatgttcatctcatcgccgccataaagcagggcaccgttcgaattcagagtcaaaagcgtgccgggagctaccgaggggccgttctgcgccctccgagaagggtatgcttgtgaagctctgctccatcaagggggaagcggttcccccctccacgggatcaattccacccgacggtgagaaagaccgtcgcaaattctaacaggctgggaacgggttataaagggattctcatccctttttcgctttcgggcttcccctgccaaaaaaaaaaggggagctaaagggccttataaaggggaaaaaaccccccgaaatctatggcccaaaccaggaaagggcttatctctctgggggggtcccctgggaaaaaaaaatt

SEQ ID NO: 79584 - protein, 118 aa, Zea mays
  misc_feature: Ceres CLONE 1564693
MAAVSAAPRPSMPPRLALRAHLFSSASALAMRALPLHRSRFRSLSTAYAVKQDTALWTPAPDSFISAAKDDGSVSLIVVYLSDTTDLEDSYTNRGQYLLMRVLGYELKPEYMFISSPP

SEQ ID NO: 79585 - DNA, 856 bp, Zea mays
  misc_feature: Ceres CLONE 1564697
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (792)..(792): n is a, c, t, g, unknown, or other
  misc_feature (793)..(793): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (801)..(801): n is a, c, t, g, unknown, or other
  misc_feature (802)..(802): n is a, c, t, g, unknown, or other
  misc_feature (805)..(805): n is a, c, t, g, unknown, or other
  misc_feature (806)..(806): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (813)..(813): n is a, c, t, g, unknown, or other
  misc_feature (814)..(814): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (839)..(839): n is a, c, t, g, unknown, or other
  misc_feature (840)..(840): n is a, c, t, g, unknown, or other
ctcaccgcggtggcggccgctctagaactagtggatcccccgggctgcaggaattcgtctcacccctagaaaaaactctcctccttcctccaccgtcgccaacgtcgcctggcggccgtctgcagctccgcgcctctgctcggaaggtgttgcaaccgtcgaaaccttctttccctttgtttctgccttacactaggctgttgcgctcgccttatctcgtacggttatcactagaaccgtccctaattccattttcttgatctggattcggacatttgatggttttatttgttccacctgtagttgtctacgtctagccactgttggttgccttacttgtcctcgtgctatatggaccacggaagccgctttgctgcagagatttgttctgtgtttgtgctcccaccactcaccagacaggtaaacctagttttgaactatagtgatcatttagatgttgtgtccccctttcggattgaatgcccattcatctggttgcgatgtgttctggcgtttccatagttgccctttctctttaatgtgcgagagccccaaggattgaaccattgccccaagaaattacctttttgatggtgttccggctgcctggaaaatccccggtatttcctgatggctgtaaaaataacctgggtttctgccagctgatttcatcccggtttattcgtgggtggggagaaaaaataaccttgtttaccttaaaaaatttggtgggcgaaatatttaagttgatatgctaccaaatgtctcgtccnnnnnnnnnnnntnnnnaanngnnnaaannaannatnnntnngggnnnnnnnnnnnnnaaaaataannaaaaaaaggaaaatgg

SEQ ID NO: 79586 - DNA, 846 bp, Zea mays
  misc_feature: Ceres CLONE 1564701
  misc_feature: Encodes the peptide sequence at SEQ ID NO. 79587
  misc_feature (420)..(420): n is a, c, t, g, unknown, or other
  misc_feature (433)..(433): n is a, c, t, g, unknown, or other
ggagctcaccgcggtggcggccgctctagaactagtggatcccccgggctgcaggaattcgtctcacccctagaaaaagagcctcgtagacgaagcagaggaaaccagcgaaatcaaagagcaaggaagcaagaagcagggagccatggcgttcctccttcccaagctcacaacgccgtcctgcaagttgcccccaagtcccctcctcaagccccagctcgctcagccggtccacggcggcggcaagattcaaggctccgtcttcggctctgttgcggcgcaggtcgcggccccgggccacctcagtctcctgctcctgctcagcgcctcgcagcaggcagccgccccggcggccaaatccacggcgaccaagaaccggggcaagggcggcggggatcccgcaaggtcggaattttaccntcacctcgggacngcggtgcgcacgctgcgggaacgactgcccgacgtcttcgtccgggaacccaactaccatatctaccgtgaagacatcccatttgtcgaccaactaaaaaactttcctggggattgacaactacaagaactatctttcgggggcctttgaattccccgggggccctactatttcaaaagaaattgggccttagatgtttccccccatttggccacctggcccgaaaattccattaatttttcccgggggagaaccttgggggggccctccccctgtttccatggggaaaacaaaaggggcccttccccggggggaccctccaaaaaacaaaggtttttaccggaacggggaaaaattttcaagaacccaagaggcaaaccattgggggtgtggaattccccccacaaaagaag

SEQ ID NO: 79587 - protein, 134 aa, Zea mays
  misc_feature: Ceres CLONE 1564701
  misc_feature (92)..(92): Xaa is any aa, unknown, or other
MAFLLPKLTTPSCKLPPSPLLKPQLAQPVHGGGKIQGSVFGSVAAQVAAPGHLSLLLLLSASQQAAAPAAKSTATKNRGKGGGDPARSEFYXHLGTAVRTLRERLPDVFVREPNYHIYREDIPFVDQLKNFPGD

SEQ ID NO: 79588 - DNA, 885 bp, Zea mays
  misc_feature: Ceres CLONE 1564704
  misc_feature: Encodes the peptide sequence at SEQ ID NO. 79589
  misc_feature (449)..(449): n is a, c, t, g, unknown, or other
ctggagctccccgcggtggcggccgctctagaactagtggatcccccgggctgcaggaattcgtctcacccctagaaaaaagttcatccacgacccaccgaaccacaatggccacgttcctgggaagctcaccggcgctcctcgctcgtcccatcgccaagccgcacatctcctgcgcgcagaccccgcgcccggcaattgcccagaaccagacgccgtccagcgagcagccggaaccacagaaacagcggcactccgtgcaagcgcagccacagcaggcggcggcggcgaggccgaagcacgcgggcgtcgcggactccactgactggatagcctcgtcgttgacgcggcggtccggaatcggtgcggggctggcgtgggccggcttcctggccgtcggcgtcgtgtcggagcagctcaagacacgcttcgaggtcgcgcagcagcangcaacacccaggacgtggagcaggagcacgaggtcgtgttgcccaacgggatccggtactacaagatgcccgtcgggggcgggaacgtcccgccgcccgggcaaactggtggggaccaaccttcaagggccggtttggccgggaaccgccgggaaagccttttgtggaaacctttcgggcaaaggaaagcggcccctgggccttggggaaagggcctcccggccttaccccaggggcattttccaaaggggttttaaaacccgtgtgcgccccccctaagagcccgggaaaaaaggggggggggggttccccccccgggggcctcctttttttggagaagagggggcccccaattttggggggagaaagaacttttaaataaccccccggggggggaacctttaaaaaatccttgggggggggacaaaaggaggct

SEQ ID NO: 79589 - protein, 206 aa, Zea mays
  misc_feature: Ceres CLONE 1564704
  misc_feature (114)..(114): Xaa is any aa, unknown, or other
MATFLGSSPALLARPIAKPHISCAQTPRPAIAQNQTPSSEQPEPQKQRHSVQAQPQQAAAARPKHAGVADSTDWIASSLTRRSGIGAGLAWAGFLAVGVVSEQLKTRFEVAQQXATPRTWSRSTRSCCPTGSGTTRCPSGAGTSRRPGKLVGTNLQGPVWPGTAGKAFCGNLSGKGKRPLGLGERASRPYPRGIFQRGFKTRVRPP

SEQ ID NO: 79590 - DNA, 791 bp, Zea mays
  misc_feature: Ceres CLONE 1564706
  misc_feature: Encodes the peptide sequence at SEQ ID NO. 79591
  misc_feature (421)..(421): n is a, c, t, g, unknown, or other
  misc_feature (617)..(617): n is a, c, t, g, unknown, or other
aaaagctggagctccccgcggtggcggccgctctagaactagtggatcccccgggctgcaggaattcgtctcacccctagaaaaactcgcgtagcaccgcctctcaacctccgccgccgctcgcccggggcgtcacccacccgcgcagaaggcccccgccgctcaaattaccggtgccctaaaccccgatatcttcttcgcctccctttcctcctcagcaccccaaaccctgaccttcagggttccgccgccatgccgcagggagaccacatcgagcttcaccagaagcgccatggcaagcgcctggaccacgatgaacgcaagcgcaagcgcgaggcgcgcgaggtgcacaggcgctcgaaggacgcccgcaatttgattggtgctaagggcaagaggttcgccaagaaacgctatgctngagaaggcgcagaatgaagaagaaccctgaaaatgcatgatggaatcaaaataagcggacagaaaaggtgaatgatgaatgtccccaagaaggggggccccttccccccccttatttaaaccccaaaaccggggataaaaaaaacaaaagggggggcccaagggggttttctttctcttccacccattttttgggnggtaaaaatggttgagggggaaaaaagaggggtgcggcgcaaaaaaaaaggggagggggttttttttttttctcaattccccaaaaaggagggggaaaacacaccccccctggtgttgttaaaaaaaataaaaaaaaaaaaatatttttttgaggggggggggctgcccatcaa

SEQ ID NO: 79591 - protein, 61 aa, Zea mays
  misc_feature: Ceres CLONE 1564706
  misc_feature (57)..(57): Xaa is any aa, unknown, or other
MPQGDHIELHQKRHGKRLDHDERKRKREAREVHRRSKDARNLIGAKGKRFAKKRYAXEGAE

SEQ ID NO: 79592 - DNA, 848 bp, Zea mays
  misc_feature: Ceres CLONE 1564709
  misc_feature: SWISSPROT Homolog: EC 2.7.11.1 Non-specific serine/threonine protein kinase
  misc_feature (848)..(848): n is a, c, t, g, unknown, or other
ctggagctccccgcggtggcggccgctctagaactagtggatcccccgggctgcaggaattcgtctcacccctagaaaaaaatccacttttaaaaattaaaagatctcgaaaacaatgaattgaaggatttgattactcaatatttgattggaatagattcacaataattctaaaaaaaaattatgaattttctatttcataatcattcctaatttcattctaaaaataaaataaagaacctatattataatatgggttctgtgaaagcaggagagatgacttagagtctcttggttatgtgctgatgtacttcttaagaggaagccttccttggcaaggcctgaaagctggaacgaaaaaacaaaagtatgacaaaattagtgagaagaaaatgctaacctcaattgaggccctgtgtaaatcttatccatcagaattcgttacatatttccattattgccgctctttgcaatttgaagataagccagactacagctatttgaagaaaaattttcgggatttattcatccgtgaaggttaccagcctgattatgtatttgattggactgtatcaaggcaagctgcggacaataacagattgcgactgagtgggaagacaggtggggttggtgggaccatctgtggatcgggctgaacgagctgcagcaaaacaggatgttccacatagattcactggtccagctgatgcattggctaaaagaactggctctggttctggtcattatggagaacacacaaagcacagaactctgttggattcccttatgcattccatatgggtgttgactcggataaaagaagcattcatcatctcgcaatggaagcn

SEQ ID NO: 79593 - DNA, 1673 bp, Zea mays
  misc_feature: Ceres CLONE 1564710
  misc_feature: Encodes the peptide sequence at SEQ ID NO. 79594
agttctttgcccactttcaccttgctttccccatttcacacgctttccttccgcccattgacgagttgacgaccaacagacccaggcctccgaccagatcgaggtgagcgaacgtgccccgcctgcgctggtgacggtgagggtgaggccgcacgccatccgccatcctcactgatggttccgtcccgccgccatcggagagtgtagaagtggaagcaagcagataaaccccaggttctgtacttctgtcaactgtcctgtttttcagacgaaatcgaaacatgttagatcaatcaatggagacctctttttagtgtcgcacttgttgaaacggatccactcgagactttttcagatcgattaggcttattcttggggctggtaatgtgagcttctcactaccggattttcctgctgttttctgatgcccatgcccgtctctcgcccgtgcagcacaagtagttcgtaacgccatccatgggatcctccttatcgaacctcaccgacgccgcttgcatcgtgcaccagtttaagatcaacggctactcggctaccaaatccatggcgaggacggactcgctcccgtccaagcggctggccgtgggagggtacgagtgggaggtccactacaccccaagcctcctcgtcgacggcagctacatgatagcgttcaggctcgtcctcctcggcgcgccgcgtcggaacgacgtgaaggcggcgttcagatgtcggctgctgtatccttccaccaactacggtcatcaacgcggtgcgtgcgtcagcgattcaatggggaacgtggaaggtcagatgtctcatgcgttcaagcgggcgaaggagagctcgggatggattccgctccgcaaaaggaatgttgtggaggcggcccgggtcatcgagaacgactctctcactgccgaatgtaccatcacggtggtcaccgagctacctgaacctgatacagcaaagactaacgccgtcttgccccgaattcggcgattgacgggcgtgcattccttgcaccatgatctcggtgagctcttgggcaagggaaccggatccgatgtcgtgctggtggtttgcggtgagtccttcgcagcgcacaaggccatacttgcatcgaggtccccggttttcatggcccagttctttggccccatgaaggagacgcactcgcagtcgcagagggtggagatcatggacatggaggcggccgtattcggggccatgcttcgcttcatgtacaccgacgtggtgcccgagcttgagcggcaggagaacggcgacgtcatcgcgcagcatctgcttgcagctgcggacagatatggactcgacaagctcaaatcgatgtgcgaggacaagctctgcggtggcaccacagtggagacagcagcgacgactctggcgctggcagagcagcacggttgcccaaagctcaaggcttggtgtgttgagttcatcgctgcaaaccttgatgccgtcatggtgaccgagggttacaagcatctgatgacaagctccccgttggttctgaatgaccttctgagagctgtgcgtggaacgaagaactgaagaacattggtagttgtattgtatctgctctctatgaattcggtgtttaagtttatattccttcccattgaggaagggtggattaaaaaaaaaaaaaaaaa

SEQ ID NO: 79594 - protein, 364 aa, Zea mays
  misc_feature: Ceres CLONE 1564710
  misc_feature (185)..(300): Pfam Name: BTB Pfam Description: BTB/POZ domain
MGSSLSNLTDAACIVHQFKINGYSATKSMARTDSLPSKRLAVGGYEWEVHYTPSLLVDGSYMIAFRLVLLGAPRRNDVKAAFRCRLLYPSTNYGHQRGACVSDSMGNVEGQMSHAFKRAKESSGWIPLRKRNVVEAARVIENDSLTAECTITVVTELPEPDTAKTNAVLPRIRRLTGVHSLHHDLGELLGKGTGSDVVLVVCGESFAAHKAILASRSPVFMAQFFGPMKETHSQSQRVEIMDMEAAVFGAMLRFMYTDVVPELERQENGDVIAQHLLAAADRYGLDKLKSMCEDKLCGGTTVETAATTLALAEQHGCPKLKAWCVEFIAANLDAVMVTEGYKHLMTSSPLVLNDLLRAVRGTKN

SEQ ID NO: 79595 - DNA, 877 bp, Zea mays
  misc_feature: Ceres CLONE 1564712
  misc_feature: Encodes the peptide sequence at SEQ ID NO. 79596
ctccccgcggtggcggccgctctagaactagtggatcccccgggctgcaggaattcgtctcacccctagaaaaactccgaccgcacgctccgcgacgcgatggccgcgctccgcctcgcctccttcaccctccgccccgccgccgccgccgccgcctcttccggcgcgactccatcggctccccggtccgcctctttctccagcgtggcgcgggggctcccctccctccgcctggccccgccccgccgccgccgcggggacctcgccaggccccgcgccgcggccgaggccgcggcggagagctacgcgtccgcgctgtcggaggtggccgtcgagaacggcaccctcgagcagacggtctccgacctcgagaagctggagaagatcttctccaacaaggccgtcgccgagttcttcgacaaccccaccgtctcgcgcgaggagaaggccgagctcatcggcgagatcgccaagtcgtccgagcttcagccgcacgtcgtcaactttctcaacgtcgtcgtcgacaactttcgcgcgtccatcgtgccgcagatcgtcgtcgagttcgagaacgtctaacactcgctcacgggcaccgaaggcgccaccgtcacctccgtcgtggcaactcgagtcgcaggaacctcgcggcagatcgccgcagcaccgtccaaaaaaagaaccggggcccaaaaacgtccgccctaaaaaaccaagttttgacaagggggtttattgcccggttttccccggggaaaaaggggcgggaaaagggttcaaaatttatattaaaattaagaggttcccggaaacaaaattcgggagaaaatctcccgccccgaaaattcaaagttgtccccccccgttccccgtatta

SEQ ID NO: 79596 - protein, 159 aa, Zea mays
  misc_feature: Ceres CLONE 1564712
  misc_feature (65)..(160): Pfam Name: OSCP Pfam Description: ATP synthase delta (OSCP) subunit
  misc_feature: SWISSPROT Homolog: EC 3.6.3.14 H(+)-transporting two-sector ATPase
MAALRLASFTLRPAAAAAASSGATPSAPRSASFSSVARGLPSLRLAPPRRRRGDLARPRAAAEAAAESYASALSEVAVENGTLEQTVSDLEKLEKIFSNKAVAEFFDNPTVSREEKAELIGEIAKSSELQPHVVNFLNVVVDNFRASIVPQIVVEFENV

SEQ ID NO: 79597 - DNA, 827 bp, Zea mays
  misc_feature: Ceres CLONE 1564715
  misc_feature: Encodes the peptide sequence at SEQ ID NO. 79598
gcggtggcggccgctctagaactagtggatcccccgggctgcaggaattcgtctcacccctagaaaaaaagaaaaggaaggaagaagggcctcctgtatcctctcacttccctcagtcctcgtccgtctgctccctcctctctctacctagctctagctagccttcctgtagcgcggcagagatggctgcccctgcctccaccacggcggcggcggcggcagcgctgctgctgctgctcctcctgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgccgccgacgcgggcgtccactccttccgcctcggcctcaaccgcttcgccgacctcaccaacgacgagtaccgcgccacctacctcggcgccaggaccaggccgcagagggagaggaagctcggcgccaggtaccacgccgccgacaacgaggacctgccggagtccgtcgactggagggccaagggcgccgtcgccgaggtcaaggaccagggcagctgcgggagctgttgggctttctcaacaatagcagctgtggaaggcatcaaccagattgttacaggcgacttgatctccttgtctgaacaagagcttgtcgactgtgacacttcgtacaatcaggggtgcaatggaggtctgatggactatgcatttgagttcatcatcaacaatggcgga

SEQ ID NO: 79598 - protein, 215 aa, Zea mays
  misc_feature: Ceres CLONE 1564715
  misc_feature (46)..(106): Pfam Name: Inhibitor_I29 Pfam Description: Cathepsin propeptide inhibitor domain (I29)
  misc_feature (135)..(215): Pfam Name: Peptidase_C1 Pfam Description: Papain family cysteine protease
  misc_feature: SWISSPROT Homolog: EC 3.4.22.14 Actinidain
MAAPASTTAAAAAALLLLLLLSLAAAADMSIVSYGERSDEEARRMYAEWMAAHGRTYNAVGEEERRYQVFRDNLRYIDAHNAAADAGVHSFRLGLNRFADLTNDEYRATYLGARTRPQRERKLGARYHAADNEDLPESVDWRAKGAVAEVKDQGSCGSCWAFSTIAAVEGINQIVTGDLISLSEQELVDCDTSYNQGCNGGLMDYAFEFIINNGG

SEQ ID NO: 79599 - DNA, 813 bp, Zea mays
  misc_feature: Ceres CLONE 1564716
  misc_feature: Encodes the peptide sequence at SEQ ID NO. 79600
  misc_feature (787)..(787): n is a, c, t, g, unknown, or other
ctccccgcggtggcggccgctctagaactagtggatcccccgggctgcaggaattcgtctcacccctagaaaaaaagaacagcggcggcggcaaccccaaccaaagccgcaagtatttcttccccaagaacaagaacaacaaggtcgccgcgccgcgcaacaccacctccttcatcatccgggccaagcgcgccggcggcattgcctccctcgtctccccgtgccccgtcacgcccgccgtgctccccaccccgcgtctctccccctcccgcgagggcctagctgacatggcccaggcgcagtggggcgtcgatgggtacggctccatgaagggcctcatccgcctccgtagctccccccagccagccaaccccaatgctgccgcatcagatgacgacgatgaggggaactccagtggaagcgacgtcgaggagcacgtcgaggtggagcgacgcctcgaccatgacctcagccgttttgagatggtgtaccctggtagaggggaggatgctgggggctacgtgttggaggacgatgacgagtatgaccaggatgcgcatgtggctcgccttgaggaagagaacctgaccctaaaggagaggctcttcttgatggagcaagaggttggtgacatgaggcgccgcctggaggctcttgaggcaaaattttcgctaggtggtggttgttgggaggtggcaagaattaaagtggaggaaactccctcctcagaatgatgcagaaaaggatccatacttgggccggataataagcaacaaggatgaagttnaagatggtttaatgccgggaatccga

SEQ ID NO: 79600 - protein, 243 aa, Zea mays
  misc_feature: Ceres CLONE 1564716
PRGGGRSRTSGSPGLQEFVSPLEKKNSGGGNPNQSRKYFFPKNKNNKVAAPRNTTSFIIRAKRAGGIASLVSPCPVTPAVLPTPRLSPSREGLADMAQAQWGVDGYGSMKGLIRLRSSPQPANPNAAASDDDDEGNSSGSDVEEHVEVERRLDHDLSRFEMVYPGRGEDAGGYVLEDDDEYDQDAHVARLEEENLTLKERLFLMEQEVGDMRRRLEALEAKFSLGGGCWEVARIKVEETPSSE

SEQ ID NO: 79601 - DNA, 828 bp, Zea mays
  misc_feature: Ceres CLONE 1564717
  misc_feature: Encodes the peptide sequence at SEQ ID NO. 79602
tccccgcggtggcggccgctctagaactagtggatcccccgggctgcaggaattcgtctcacccctagaaaaacatgaccatctctaaggacagagttaagccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtcagtatcgtgagccaggctctgatcttcgtcacccgttcccgtagctggtccttcgtggagcgccctggtctgctcctggtcaccgcgttcctgctcgctcaacttgttgccaccttcctcgctgtctacgccaactggggcttcgccaggatcaagggtatcggctggggctgggcaggtgtggtctggctctacagcatcgtcttctacttccccctggacctgctcaagttcttcatccgcttcgtgctcagcggcagggcatgggacaacctcctcgagaacaagaccgccttcaccaccaagaaggactacggggcggaaagagagggtaggcgcagtgggccaccgccgcagaggtacgctgcacgggtctccagcccgccgggaggcttccctccaacacccctgtttcaacgacaagaagcagctaccgccaacctgtcccaaaatccgcccagccaggccaaaagaggaaacctgaatatccccgaaggctgaagggaacctcaaacaccccttcaaggggcca

SEQ ID NO: 79602 - protein, 240 aa, Zea mays
  misc_feature: Ceres CLONE 1564717
  misc_feature: SWISSPROT Homolog: EC 3.6.3.6 Proton-exporting ATPase
MTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLLKFFIRFVLSGRAWDNLLENKTAFTTKKDYGAEREGRRSGPPPQRYAARVSSPPGGFPPTPLFQRQEAATANLSQNPPSQAKRGNLNIPEG

SEQ ID NO: 79603 - DNA, 763 bp, Zea mays
  misc_feature: Ceres CLONE 1564719
  misc_feature (241)..(241): n is a, c, t, g, unknown, or other
  misc_feature (242)..(242): n is a, c, t, g, unknown, or other
  misc_feature (254)..(254): n is a, c, t, g, unknown, or other
  misc_feature (652)..(652): n is a, c, t, g, unknown, or other
  misc_feature (698)..(698): n is a, c, t, g, unknown, or other
  misc_feature (699)..(699): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (709)..(709): n is a, c, t, g, unknown, or other
  misc_feature (710)..(710): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (736)..(736): n is a, c, t, g, unknown, or other
ctccaccgcgggtgggcggccgctctagaactagtggatcccccgggctgcaggaattcgtctcacccctagaaaaagagtagaagtagaagtaggctagcaacctgcacgcctacccgtcccacgcacctcccgacttctccggttctcccttcttcatagcagccacccacgcatctcagcgccgaggcgaagcgaggacctcgtggttcgtgccctgctcacctcgtgaggatgtggnnatcgcgaaggcngggctcttcctcgcggcgcggcgctgctgatggctgtgcttctgcttcgtccgcggggggccccggggtgggccggcccccaagggaaaccccgccccgttttgaaaaagggccctttgggcccccccccccctggcggggaaggaagaaaaaaactccggggggggcgaaaaaaaacccccaagggggggcccccagggggaggggggggggggggggggtttttgtggggccccccccccaaaaaatttttgtggggcgccccccccacggggggggaaaaaaaaaaatttccccccccgcggttattaaaaaaaattccccccccccctttgtggggaaaaaaaaaaaaaaaaaacccgggggggggaggtttttttcgggagacaccccccccnaaaaaaaaaattgggggtggggggccgccgcccccccccccccacnncnnnnnnngnncnnnccccccccccccccccccccanaaaaaaaaaaaaaataaggtggtgggg

SEQ ID NO: 79604 - DNA, 875 bp, Zea mays
  misc_feature: Ceres CLONE 1564720
  misc_feature: Pfam Name: Glyco_transf_28 Pfam Description: Glycosyltransferase family 28 N-terminal domain
  misc_feature (339)..(339): n is a, c, t, g, unknown, or other
  misc_feature (345)..(345): n is a, c, t, g, unknown, or other
  misc_feature (804)..(804): n is a, c, t, g, unknown, or other
gcggtggcggccgctctagaactagtggatcccccgggctgcaggaattcgtctcacccctagaaaaatctccacgccaagaaacacgcggcggttaatccgcatccctccagaactcgcggggaatatccgagtcgtggacatcaccctgccgcgcgtggagcgcctgccggaggacagcgaggcgagcatagacctcccgtccgacgacctccgcccgtacctccgcgtagcctacgacgctgccttcgccacaaactctcggccatcctgcaggagccggggccggagaggccggactgggtggtcatcgactatgccgcgtactgggcgcccgcngcggcngccaagcaccgcgtgccctgcgcgttcctgagcctgttcggcgccgccgcgcttcgtttctatgggcccccccgaggggcttctggggaccccgcaagtacccccgggacaagcccggaggaccctccccgctgtgacccccaataacttgccggttcccaccccccccccctcggtataccgggtttttggaggggggcccgcgttttttttcccccccggggtggtgcccccgcacaaaaatattggggggtttttcaaagggggtaccgcgttccgggggggggggggggcaaaaaaaaaaaccccccctctggggggctctggggacccccgcggggattctaatttaacccggggagggggggccttacggggggaggggggggttttacacaaagagcgggggtatccccgcggggggggggggggtattctcctcccccccccccccccccnagcacccccaagaaataggggtataaagctccccacggagcgcgcttgaaattgtgttcgtgggggggcgg

SEQ ID NO: 79605 - DNA, 858 bp, Zea mays
  misc_feature: Ceres CLONE 1564723
  misc_feature: Encodes the peptide sequence at SEQ ID NO. 79606
ccccgcggtggcggccgctctagaactagtggatcccccgggctgcaggaattcgtctcacccctagaaaaaacccacgcacactcttctccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggacgccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcaccgagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctctccgaggagttcctctcccaggtcgactacttgttcggcagggcaggcctacggcgggaaagaccgactccaaaggcggggttcaagactggcgccgggggccaacgcccaacttcctggagagagtccccccccgtgaatcaacggcaaaaaatactacccccgtgttccgggccctcccaggaacgggggaaacggggaacaaggggcggggaaaaacaccagctcttattggggcgcacgcggtttccgaaaggggaagggttttaaatatctgtaaagggg

SEQ ID NO: 79606 - protein, 245 aa, Zea mays
  misc_feature: Ceres CLONE 1564723
  misc_feature (57)..(240): Pfam Name: PsbP Pfam Description: PsbP
MASTSCCLLHQSTARLGASPRLAAAPPRSAQLLVCKARKQDAAADQSDVSRRAALALLAGVTAAAGAKVGPAAAAYGEAANVFGKPKASTEYIAYSGDGFKLLIPSKWNPSKEREFPGQVLRYEDNFDANSNVSVIIQPTSKKTIADYGSLRGVPLPGRLLVRQGRPTAGKTDSKGGVQDWRRGPTPNFLERVPPRESTAKNTTPVFRALPGTGETGNKGRGKTPALIGAHAVSERGRVLNICKG

SEQ ID NO: 79607 - DNA, 870 bp, Zea mays
  misc_feature: Ceres CLONE 1564724
  misc_feature: Encodes the peptide sequence at SEQ ID NO. 79608
  misc_feature (664)..(664): n is a, c, t, g, unknown, or other
acccgcggtggcggccgctctagaactagtggatcccccgggctgcaggaattcgtctcacccctagaaaaaattccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggcccgcatcgggcacttcgtggaggcccagatcctggaggccgtgggcgtcgactacgtggacgagagcgaggtgctgacccccgccgacgacgcgcaccacatcaacaagcacaacttccgcgtccccttcgtctgcggctgccgcgacctcggcgaggcgctccgcagggtgcgcgaaggccgcgccatgatccgcacccaggggggaggcgggcacgggcaaacgtcntcaagccgtgcgccacctgggccttcctcatggggcaacttcccgcgccccccccaaaattggacaaacaacaagggttttcccctaacccaaagggaatggcgccggccccaaaaaccccgttattgaaaacaaaaagttggggccgcctccccccttttggattttccccccgggggggggttccccccccccccccccacccc

SEQ ID NO: 79608 - protein, 224 aa, Zea mays
  misc_feature: Ceres CLONE 1564724
  misc_feature (29)..(225): Pfam Name: SOR_SNZ Pfam Description: SOR/SNZ family
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGRAMIRTQGGGGHGQTSSSRAPPGPSSWGNFPRPPQNWTNNKGFPLTQREWRRPQKPRY

SEQ ID NO: 79609 - DNA, 927 bp, Zea mays
  misc_feature: Ceres CLONE 1564728
  misc_feature: Translation starting site: 145
  misc_feature (543)..(543): n is a, c, t, g, unknown, or other
  misc_feature (544)..(544): n is a, c, t, g, unknown, or other
  misc_feature (647)..(647): n is a, c, t, g, unknown, or other
  misc_feature (649)..(649): n is a, c, t, g, unknown, or other
ctccccgcggtggcggccgctctagaactagtggatcccccgggctgcaggaattcgtctcacccctagaaaaaaaacctcctcactcctcagactcctctccgcacataccctccctacctcgccgtcgccgtcgcatctgccatgggggcgtacaagtacgtctcggagttatggagaaggaagcaatccgacgtgatgcggttcgttcaacgcgtgcgctgttgggagtacaggcagcagccggccatcgtccgcctcaaaggcccacccgccccgacaaggcccgccgcctcggcttcaggccaagcaagggtatgttgtttaacgcgtccgtgtgaagcgtggtggggaggaaaaacccccccccccaaagggtaattggtctatggcaagccccaagccaccagggtatcacccccagctcaagttccagaaggaaaacaaagagaattttttttatttttagaaaacggttggtgaaaaaaaaaccttgggtggggaaactaagagggtcttcaaaaattccctaaacccacgtgnntgtgaaaagagggaggagggccgccccccccaaagtgtccatcctctggaaagaactcacaccccccccccggtatatattatggggaaaccaacggcctttngnaaaaaaaaaccaaaaaaaaaaaccgggcttttatgcaaacccgggggcacaaacactcctgtgaaacgccccggtgggtctccccccttgcacaggcaaaaaaaattcccccctggggccctcgcggtggaaaagggccacccctccccccacaaaaacaagggccctctcaaaagaggggccacctggaaacgccaacccaaaaccttgtgtccctttcggccggttaccgtttaggaaaacaaaccctataaatttctgaggagcgccgcgcccaa

SEQ ID NO: 79610 - DNA, 863 bp, Zea mays
  misc_feature: Ceres CLONE 1564729
  misc_feature: Encodes the peptide sequence at SEQ ID NO. 79611
acccgcggtggcggccgctctagactagtggatcccccgggctgcaggaattcgtctcacccctagaaaaatccctccactccctcttatctgctgcgccatcctccccggcctccaccatggccacagccgccgcggccaccgcctcctcctccctcctcgcgccggcggccagcagcacggcgccggcctcgtcaaacgcgctgctgttcccctcctccgtgccgtcgctgcgtgcgtacccgcggctcctcctcgcgttccgccgccccgccgcggccgccgtcgccgacccgcagggggccgtgctcgaagaggaggcggaggtcgaccagcagggccagtacgacgacgacgacgggtatgaagggcgggcgcggccccgcgttcaccccccccacgcgcccgcgcaccggcaaggccgcgctactgcttaagcgcgaccgcacgaggtcgaagaggttcctcgagatacagaagctgcgggagagcaagaaggactacgacgtgcccaccgccatctcgttgatgaagcagatgtccagtgccaagtttgttgagtcagcggaggcgcacttccgcatgaacctcgaccccaagtacaatgaccagcagctccgggccacggtgaatttgccaaaggaacaggccagtccggggaagatgcggttctcacacaaggtggaaaaaatagatggaaactagagctggcagagctaatattcgtagggggaaaagatttgatttgaacaaataaaaaggaggatttatggagttttgaacaaattgaatggcatcacccttgaataggaagcccaaaagggtgcggggcttttagggaaaaaattttagggaccccaaag

SEQ ID NO: 79611 - protein, 113 aa, Zea mays
  misc_feature: Ceres CLONE 1564729
MKGGRGPAFTPPTRPRTGKAALLLKRDRTRSKRFLEIQKLRESKKDYDVPTAISLMKQMSSAKFVESAEAHFRMNLDPKYNDQQLRATVNLPKEQASPGKMRFSHKVEKIDGN

SEQ ID NO: 79612 - DNA, 855 bp, Zea mays
  misc_feature: Ceres CLONE 1564731
  misc_feature: Encodes the peptide sequence at SEQ ID NO. 79613
gcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgctccccttgctaaggtcattcatgacaactttcggcatttgttgagggttttgatgacaactgttcatgcccatcactggccacccaagaaaactggttgaccggacccttcacccaaggaactggaaaaggttgcaaggtcttgccacctttttaccatcattcccaagcaaccaccgggtgcttgcccaaggcttgttttggtaaaagttccttcccggatactggaatt

SEQ ID NO: 79613 - protein, 192 aa, Zea mays
  misc_feature: Ceres CLONE 1564731
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFRHLLRVLMTTVHAHHWPPKKTG

SEQ ID NO: 79614 - DNA, 847 bp, Zea mays
  misc_feature: Ceres CLONE 1564735
  misc_feature: Encodes the peptide sequence at SEQ ID NO. 79615
  misc_feature (375)..(375): n is a, c, t, g, unknown, or other
  misc_feature (462)..(462): n is a, c, t, g, unknown, or other
ctccccgcggtggcggccgctctagaactagtggatcccccgggctgcaggaattcgtctcaccccagaaaaatacagttttccaactcacattctactatatattaggatgtgttgggcacacatggaagtaaggcaaaatgatgcatcgacatgtgatacgtgagcacgtatttcaaaacccgataggttggttggagtgggcttcttaaaattattactccgaagcgtgcaattgagattgtagtattataatacccacgtatttgtaaatttgttatcgtcgttgctttaaacacccatctatatatagctcactcactgctgctgttactggcatttctcccctcatcccgttcctgaaaacggatctgnaggccgtcgtcttccactgggtcgcgctcctgttcgctccgtcgtcagaaatgcaggcagcgccagcaggtcttgcttcacgctccntcgcggatggtggcccctccggcccgcgccgatgcagttgaaagctcctttcgaagcacaagattaaatagagttttgaatggtctttttagacgccattagacacatgcaagtctcaaccgatgagtttgagggaggtgaccagacgcaaccatgtgcctgaagtatgtagagtacctacgcaaaaatagattatggaggcccatgtggagtgctggttactgaaattgcacaaggtctagaccacttgagcacgaatttgggcggaagtctttattggtcaacaccttcttcctgaagttatgaagccccttggtttgtacaatgattcccaaggcgatgtggaagatatctcttgtggactcgataaaatcaatgatcctcg

SEQ ID NO: 79615 - protein, 31 aa, Zea mays
  misc_feature: Ceres CLONE 1564735
MVAPPARADAVESSFRSTRLNRVLNGLFRRH

SEQ ID NO: 79616 - DNA, 939 bp, Zea mays
  misc_feature: Ceres CLONE 1564737
  misc_feature: Encodes the peptide sequence at SEQ ID NO. 79617
  misc_feature (861)..(861): n is a, c, t, g, unknown, or other
ggcggccgctctagaactagtggatcccccgggctgcaggaattcgtctcacccctagaaaaaatcagccatcccctcccgcggcaagtctctctgaattgtgggtctccggcgatggcggctctagctccatccaagattctgggcaccaagctcaacttcgccggctcctcccgctacgccacggcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccggatgggctcttggaccgctcggaggtaccggagtacctcaccccacaggtccctggagactatggctacaacccttttggcctgggcaagaagccagaggacttcgcccagtaccaggcctacgagctgatccctgcccagaggggcccatgctcggggccccctggcggcttgtcatccccagaggcgtggcaacaaggttcgggcgccaaaactggggccccccaaaggcccgtctggggtttaaagaaccgggggccccctgtttccttggaaaaggcaaaaaacccctccggctaatttttggggcgaacaggcattccccccatcaaaccctggggggggccccccctaaaatccccggagagggtcgttcctctcgttgtggggcggcccccaagaaactatctcggaataataattacagggagcggggagccccccagaggacacaaaactggtgcacctcccggggggaggcgctcttattaacccacctcggtgagggttggggccagaggntacaccccccaacacacaagggtcgcccgtcctcttttgtgtgggttaaagggaggatagcaaaacaaacacacccgc

SEQ ID NO: 79617 - protein, 174 aa, Zea mays
  misc_feature: Ceres CLONE 1564737
MAALAPSKILGTKLNFAGSSRYATAAPTAGAQKIVSLFSKKPAQKPKPSAVSSSSPDISDELAKWYGPDRRIYLPDGLLDRSEVPEYLTPQVPGDYGYNPFGLGKKPEDFAQYQAYELIPAQRGPCSGPPGGLSSPEAWQQGSGAKTGAPQRPVWGLKNRGPPVSLEKAKNPSG

SEQ ID NO: 79618 - DNA, 831 bp, Zea mays
  misc_feature: Ceres CLONE 1564738
  misc_feature: Translation starting site: 76
  misc_feature (354)..(354): n is a, c, t, g, unknown, or other
cccgcggtggcggccgctctagaactagtggatcccccgggctgcagaattcgtctcacccctagaaaaagagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcnacttgtccttggtgcggttggaatatactttgctttcaaaaatcacaatgaagagtgggattgccaatctttacagcctgcactcttggattgggataggaacaattactttgtattggtattcaagtggataattggaatccgtcacgttcttctttccctggtgctggcgccaacgtgaaagaagggtgttcttccctttggcacgtactctttggggctctttggtctaccatcttagccacgggctaatgcaataaactcggcttttcttgaagaagctcacctttcctcgaaaaagctcaagtctcgacaaatatggcacagagggcattccttagtgaactccacagcaatgggttgtcggtggttattggggggcctctggttgtgggggctgcctatagcactcagttcgccttgaagaccaccagggttatgatccaatccccgaaaactagggcaatgaaatgtcca

SEQ ID NO: 79619 - DNA, 905 bp, Zea mays
  misc_feature: Ceres CLONE 1564743
  misc_feature: Encodes the peptide sequence at SEQ ID NO. 79620
  misc_feature (563)..(563): n is a, c, t, g, unknown, or other
  misc_feature (586)..(586): n is a, c, t, g, unknown, or other
  misc_feature (603)..(603): n is a, c, t, g, unknown, or other
agctcaccgcggtggcggccgctctagaactagtggatcccccgggctgcaggaattcgtctcacccctagaaaaactggactcgtagttcatccacgacgcaccgaaccgcaatggccacgttcctgggaagctcaccggcgctcctcgcccgtcccatcgccaagccccacatctcctgcgcgcagacaccgcgcccgccaagcgcccagaaccagccgccgtccagcgagcaaccgcaagcacaaacacagcagcagtccgtgcaagcgcagccacagcaggcgacggcgaggccgaagcgcgcaggcggcgcggactccacggactgggtggcctcgtcgctgacgcggcggttcgggatcggcgcggggctggcgtgggccggctttctggccctccgcgtcgtgtccgagcagctcaagacccgcttcgaggtcgcgcagcagcaggccaacaccaaggacgtggaacaggagcaggaggtcgtcctgcccaacggggtccggtactacgagatgcgcgtcggcggcggcgaacgtcccgcgggcgggcgaacctgntggttgatcgacttgccaggccngggtgggccggcattgncggccggcggggaagcctttcttgggacacatttcctcaacgggaaacggcccccttggccctggggaaggggcccccggccctaaccccaggggaatgtgccaggggccttcaaaacccccttgccctccaagagggcccggcgcaaacgggcggggggggccttcccccccgggccctgggggtttgggaaaaaaaggccccaaattcgggggaagggacactttttgatgtccccccgggggggaagcttcttagaaaaatcttgggagggcaacaaggggggttcctcccgcgcccgg

SEQ ID NO: 79620 - protein, 191 aa, Zea mays
  misc_feature: Ceres CLONE 1564743
  misc_feature (150)..(150): Xaa is any aa, unknown, or other
  misc_feature (158)..(158): Xaa is any aa, unknown, or other
  misc_feature (164)..(164): Xaa is any aa, unknown, or other
MATFLGSSPALLARPIAKPHISCAQTPRPPSAQNQPPSSEQPQAQTQQQSVQAQPQQATARPKRAGGADSTDWVASSLTRRFGIGAGLAWAGFLALRVVSEQLKTRFEVAQQQANTKDVEQEQEVVLPNGVRYYEMRVGGGERPAGGRTXWLIDLPGXGGPALXAGGEAFLGTHFLNGKRPPWPWGRGPRP

SEQ ID NO: 79621 - DNA, 836 bp, Zea mays
  misc_feature: Ceres CLONE 1564744
ctccccgcggtggcggccgctctagaactagtggatcccccgggctgcaggaattcgtctcacccctagaaaaagcacacccgccattgcattcgcagcaccagagccgcttctccttaatgaagctcacccatctcttctacttctcctagtcgctcgcgtgctctctctctctctctctgctgcctcagccgacctcgctgtcactgagacgacagattcattccgccggtcatggctgacgcgttgtgcaacggcgtcttggcgtccccatgaggccgggacgtcgccggcacggccaggggcgccggcagggccgcgctcgcggagtcccttcatgtcgccgggcacgccagacaagacctccttctccgcctggaggatgtcggtctaggacagcaagccgaggcccctgtcgcgtaccctcgatgacgacgcgccaggacagatgaatctgaagttcacaacggcatgcgatgggtgtgataatgagctgcgccccaaacatgcgcgatggcgagtcggcgcaagaactcatcgaatcgctactcagctgcggggaacaactacggggacgacaactccaaacgccaaggctgaggcggctacaaccccttcaaccccaagattcccccatttcccccaaaaaaaacccggaccctggggttcctcacaggtaaactaaaatagggggaaccccaagggggttaaacccccgccggccccaggacaaaacatttttaaaggtttaaaaggggagaaaaaagggaagggtcaaaaattttggttttcccccaattgagataataaaaactttgagaggacccccccgccaa

SEQ ID NO: 79622 - DNA, 821 bp, Zea mays
  misc_feature: Ceres CLONE 1564745
  misc_feature: Encodes the peptide sequence at SEQ ID NO. 79623
gcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctacggcatcgccggcggcccgctcggcgaggtcgtcgacccgctctatccccggcgcagcttcgacccgctcggccctcggcgacgacccccgaggcttcgctgacctccagggtgagggagctcaagacggcccgcctcgccatgttcttccatggtccga

SEQ ID NO: 79623 - protein, 208 aa, Zea mays
  misc_feature: Ceres CLONE 1564745
  misc_feature (65)..(202): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYGIAGGPLGEVVDPLYPRRSFDPLGPRRRPPRLR

SEQ ID NO: 79624 - DNA, 862 bp, Zea mays
  misc_feature: Ceres CLONE 1564747
  misc_feature: Encodes the peptide sequence at SEQ ID NO. 79625
  misc_feature (756)..(756): n is a, c, t, g, unknown, or other
ctccccgcggtggcggccgctctagaactagtggatcccccgggctgcaggaattcgtctcacccctagaaaaaaaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagcgtgtcgctcgcatcctccgtgaagacgttctcggccgcgctggctctgtcgtcggtgcttctctcctcggccgccacctcccctccccccgcggccgccgacatcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagaccaagcggcggttcgagaactacggcaagttcggcctgctctgcggcgccgacggcctgccgcacctcatcgtcagcggcgaccagcggcactgggggcgagttcgtcaccccgggccctgctcttcctctacatcgccgggtggattcgggggggtcggcagggagctacctcattcgccgtcagcggcgagaaagaaacccgccctgaagggagatcatcatcgaaggtcaaggnttggcaaccgggcttcctccccaggggggtttaattctgggcccggtgcgggccctaccggggagctccattcaatggaggaacttcgttcgtctcaacaaaaaaa

SEQ ID NO: 79625 - protein, 235 aa, Zea mays
  misc_feature: Ceres CLONE 1564747
  misc_feature (49)..(195): Pfam Name: PSI_PsaF Pfam Description: Photosystem I reaction centre subunit III
  misc_feature (201)..(201): Xaa is any aa, unknown, or other
MAALAASSTAAFAAKPRLPRARLTVACSATGGDGNGSSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGRVRHPGPCSSSTSPGGFGGVGRELPHSPSAARKKPALKGDHHRRSRXGNRASSPGGFNSGPGAGPTGELHSMEELRSSQQK

SEQ ID NO: 79626 - DNA, 813 bp, Zea mays
  misc_feature: Ceres CLONE 1564748
  misc_feature: Encodes the peptide sequence at SEQ ID NO. 79627
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (795)..(795): n is a, c, t, g, unknown, or other
tccccgcggtggcggccgctctagaactagtggatcccccgggctgcaggaattcgtctcacccctagaaaaacttccttcctctcctttccagacccgagagccagagaccaaccacctgcggcggcgatggggatcggtgagcacttcgagggcgtgaagcagcactgggcgagcaacttcgccttcctcgactactacaagaaggtctacggccgcgccgagcccctccccaagtggtccgacgccgacgtcgacgagttcatcgcctccgacccggtctacgggccccagctcaaggccctgcgggagtcgaggaagttcgcgcttgtcggggccttcgccggcgccgcccacctcggcggcgtcgcgctcaagtactccaaggcgccgcacggcgtcgtgctggcgaccgggttcggggcgatcacgggcgccgtgctggggtccgaggtggcggagcactggtaccagttctacaagatggacaagcagggggccaaccttaggttcatctactggtgggaggacaaggtctcaggacagaagagctgaaccatgttgaattgaatgatgcctatttgagcattcccagttgacaaaaacattgatgtctatttatctgaaatcctannntgttttgtttgtttcctaggttttctctaataaggtgccgtatcggttgtggaaaacaactggacgatgtatttttcatctctgtcagtagtgacattttatccttagaactttacaaggtttaggggcaatctggggcaaacagcaaatcctcccggntttcaagggatggtttcc

SEQ ID NO: 79627 - protein, 141 aa, Zea mays; identical to SEQ ID NO: 9146
  misc_feature: Ceres CLONE 1564748
  misc_feature (66)..(110): Pfam Name: Rick_17kDa_Anti Pfam Description: Rickettsia 17 kDa surface antigen
